United States Patent 11,913,074 (METHODS FOR ASSESSING RISK OF DEVELOPING A VIRAL DISEASE USING A GENETIC TEST) - sequence listing, part 19

SEQ ID NO: 1963 - DNA, 38444 bp, Homo sapiens
  source 1..38444: mol_type = genomic DNA
agtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtgagtcgcagtgaccctacaagtggttcttttacccgagcggctcgtaggcgcgttgcggtttttcgaaactacagctcccggcaggccccaagccgccctcggggccgcgggtcggcggattggccgcgctgcattttgggacctgtagtttcctgcgctcgtggcgctggcgccgcggcgttggctgagcccttgaccggggctggagggaagggccgacattcagtgtgtccgcgtctgttctgttagtcccagttcccgggcgggattgaggcttagagaagttgagtgatttgctgagggctgcacgggttggcatcccggcatgctctttcgctactttggctgcatctggttgcccacccgggcggatggggaatggactccagccagccaggagggcagagggctggagaggcagggccggaggttcagaccctccgctctgacgttgcgcctggtgaggccgggaggggtgccgcttgcctcttcagccctcacgctcttgtggaagtcgcggaattactgcaggcggaacttgcagcactgtgggcgtcttttccagagaaggacggagttgtggggcgggaggataaggcaaggcccagccacttcgcatcttcgccccgccagctcctcgagatgggatataccagggttgctctccaaccctctccgcaggagggactgatggaaacgcctgggaaagtagcccggtacccacaaaggctgtctacaaacagagtcttactgtctttcccaggtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcaggtagagcacaggccccgaggaaaggactgcgggtgggtggagcttcagccaggacggggtgtgcttccctctcccggcccattccagccaggcccctccgggccagaggcagcgtctgtcataaaaagggctggtgttccaggtggggtcagagagaggattgacaagtaaaaacgatcgtcctttgaagggggccggcccctccacacctgtgggtatttctcatcaggcgggacgagagactgagaaaatgaataagacacagagacaaagtatagagagaaaagtgggcccaggggaccggcgctcagcatacagaggacctgcaccggcaccagtctctgagtttcctcagtattcattaattactattttcactatctcagcaagaggaatgcggcaggacagcaaggtgatagtggggagaaggtcagcaagaaaacgtgagcaaaggaatctgggtcacaaataagttcaagggaaggtactatgcctggatgtgcacgtaggctagttttatgcttttctccacccaaacatctcggtggagtaaagagtaacagagcagcattgctgccaatatgtctcgcctcctgccacagggcggcttttctcctatctcagaattgaacaaatgtacaatcgggttttataccgaaacattcagttcccaggggcaggcaggagacagtggccttcctctatctcgactgcaagaggctttcctcttttactaatcctcagcacagacccttcacgggtgttgggctgggggactgtcaggtctttcccatcccacgaggccatatttcagactatcacatggagagaaaccttgggcaatacccggctttccagggcagaggtccctgcggctttccgcagtgcatcgtgcccctggtttatcgagactggagaatggcgatgacttttaccaagcatactgcctgtaaacatattgttaacaaggcacgttctgcacagctctagatcccttaaaccttgattccatacaacacatgtttctgtgagctcaaggctggggcaaagttacagattaacagcatcttagggcaaagcaattgttcagggtacaggtcaaaatggagtgtgttatgtcttccctttctacatagacacagtaacagtctgatctctcttttccctacagtccttgagggtgacagacttaggagtgccttgggggcctctctgaggagcagctgatattcacgggtcaggaggaagcatttccattagaggggcagccggtggccagcctcacttggaaggtctttgaacctcgggggtgcagggaggtggcagtggtgcaggttgccttctcctgggttccttgaggtgccctcttgtacccggctcacacccttcccctccccgagtttcctgctcaggttcccgtctgagagcttgtatgtaggacgtcagataggacagcataaatgtttggatccagaaacgcagaacagtttcctattttgagacttgacacctaattagtcatcttactatttaagctgaaaaatagtgtcgtgttttgggtaacgttctgcaaatcgtttgctaatggcggctgagttgcttcacgccctttagggcaagagtgggacttgcctgtggacttctccgcggtcccacagggctctcgccacctggcagtggcctctgcatctgcaaagagctgcccgctggctgccgaagcttgtctcagggcagcttgtgtggcctcgcctcttcctggcttccccgtaacccttgctccgaactccgttcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccataggtgaccctagttcccaggcctctcctggcctcctgtggggatggttggcaagggatggcgctgagggtggggtgggcccatggggactcctgccgtctctcaagcagaactcaaggagaattttttagctgctgtataatttctcgccatcgtgggtgtaaacctagggttgggcttttttgctgaattagggcacggcagatgcccacttcacccatttttgataaaccagtatctggggtgtcagattcttggctgtctgcagggccgagttagccgaatgccacctgcctttgatacgtgagaacgttgtctgagaaccgtgacttctgtgcttgcttgtgtctggtcagcttgctacacggacatcccaaagattatttacgcctccaggacccactcgcaactcacacaggtcatcaacgagcttcggaacacctcctaccggtgggtcagacgagtttacacctgtctcggggtcctcaagagaaccagcttggcatggtgctgagtccacagccccatgctgtgctgtggtggagggtggtggtctttctagacgctcccccgaagtgtgcagagcgctggtgcccaggggtggggtgcggcctgggctgcctccaatgcccattacttgtgaggaagcagctttgcatctgtgtgctgaccttgggcgggcgtcctgagctcctcgcaggtgctgttgtagcagctgtgcagtaggtcagggctggcccccagtgcagctttgcacatgaagtaggaggaggccctgctgcttgtcagagcccagcagagtcttggtgttctgtcgggttcctgtggccggaccagtggcagggtgctgtggaagctgtcgaatctcctccctctgtccagtacccccgctcgtcttctagctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacaggtaggctcctgggctcccgctccggctcagtgtccgacaggcgagtgctgctgggtgtccagagccccaggctgcgctcccgctgggctagggtttgaagttcactgggggactgcaggggaggacctggtgggggtggggactggcttcggtcctttcttggccgtgcttcagctgcgcactctgcccttcctcccacagatccacttgtgccgtaagaaggtggcaagtcgctcctgtcatttctacaacaacgtagaaggtacaagcagctgggtgggaccagggtcgggttggagtgtgtgcagcctctcagggtggagctcagtggtgtcacagcctggttgtgcttgcccggtggggcggccagtgcggccatgtacctgggccctgtcttctgactcggggccacccatgttagacttctgtgtggaagagctcacacagtggtctgagacagccagccggcaagactgcctctggctggtgcctggggccttggattttgggaaggctccctccatttcctgatgagagggtctccctgcacctaacctgctggtgcaaacagtaggggttttgctgaacaccggctttctcttcggggactttgttgcttgcccagcagcaggtgctccagtgaccggccctcataccatcttgggagggtgtcctggaagccgtgtctggcctcccgcgaccctgccccgtgtgtctttttcctgtgctgaccttgctgcggaaaattatggccctgagtgtgactccaggctgagtcctgtgggtccaacacgggatgccttggggcctcttctggagacgggatgtgagtgacaggagccggccggggcagcttgccctgtgactgcacgtggccacagcctgtgagggccgggggtgcttctccacccacgtggctgcccctcgggtatgtcaagggcttctggggctcatcacggggtcctagagacagtggcagggtgcacccccgttggctgcccttacagtttctgtgacctgagggtggcatctgtgcagtcggcgcggtctgtgcttctgtgggatcagggttccctctgtttcctgcctcagttggggctcaagcctcaggtgaggtggccccggagcactcagaaggcatcggcggtcctgtgggctgctttctgcactcacgtttgctgagtgctcagtgtgccaggactgaggaccctgaagctgctcttgtatttagggcggcgctcccctggcagagactgagccaggtggtcccgcatgacccactaccaggcgtttctgggccctggcccttggagggacagggtgggcggaacatgggcctgcagggaggctcccgcttactggaggcatgtgctgtgttgctggagacatcctctgtgttgcttcttgttcgctgtggtttttggtctggtggcaccaaggaccctcagtcatcttgatgtgtggttgtccaggcctttttgttggtcctaagaaggggctctgcctttgtgcccccaggttccctgacaggagctgccggctcgtcccggtgatgcctgcaggacgtgactctgggacggggggttgggcagatgtgctgatggaaattctcaagcaggcgtcatttccgaggtcctcacctggatttccaggacaggagtgcctgctgggtgtccccagtcccatgcagcgggggtccttgggatagcatggaacgctgagcatgggcctggccggccgtggtcctggacaagggcagtgccccggtggctgctgggcctgggacctggtggggacgctgggcctggtacctggtggggatgctgggcctgggacctggtggggaggcctctgactgcctcctggtgctgcttccgtctgtgttaggcctctgggtattggggcccccatctgtctcctcctccaggcctgtggactcagaccaggaagacacaggccagcccctgcctgtcccccttggcttgggctctcactgcccgacctggcgggaggttgcctagccgtgaaccttcgcaccctgtctgccaccggacaggctgtgagggggtgtctgcagcacctgcaccggcctgagcatcttcagagtgggctgcagctcctggaggggtctgagaggaagggaggcaggtattttgggcgaatgaggagacagctggagagctggcacccttcctggcctgcgtcctgtgaggactctggttggggacagcaagcttggggtcagcctggggcagagcctctgggacggccccgcccctcgtgccccttcccctcgcagctcctgtcctcgccccgccctcagctctccgccaggcaaggtttggcaagtgccgctgtgcggcagtgcctgctgattggctggtctgttgctatggtgctgcccaggggtgtgcttttcctcccctgccttccctgctatccctgggagtatctggggttgggtcatcgctggtgtgtgtgagtgtgtgtgtgtgtgtatgtgcacgtgtgcatatgtgtgcgcttctggcctctgcagctgagtcctggccctcggggggcctggcacctcctggggacaggcacaaagcagccatgatggagtcgggagctgggggaggccccattgccccacgtggctgccctgtgactctggggtgcttgttagaagaggtatctggttctgtctgtgtttaagcaactccctaaggaattcttgtggttccagtttggggggcctgtactgtagaggcaagggaggggcaggacatcccccagactctgacttctgaagccttttctgcccggggcctctccgccagtacaggcagtgtcctttgccagggctgccatgctgcagaggggagtgggccactgtttagcccaggaaaacctggctctcccttagctggaagttctgggcctgttgtggttggcagggaagctgagtgacggtgctaatcacaggggcacctgcaggggtttgtgggagatgcctctgtgggttggggcgataggctgaggggctgttcttccctgccctgaggagggctgagtgtagccgccactcctgtcctgtcttgggctgtctcggagaggatgcgtagaaccctcgggatcctgctggcctccgtctggtccaccctgaacctcaggccttctgggggcagaggaggattccctcaggatcactcgggtgggggcctctcttgggcacctgagaccctcagtgggtgctttgtggcgcgttcacggttggtgggggacgcccagccctgcccgccgtgtaggagccgttctgtcctgggcatccccctgtggtctgggacttagtggaccctgagggtgtgtgtttacccctgcctcacacctgcagaaaaaagcctggagcaggagctggccagccccatcctggacattgaggacttggtcaagagcggaagcaagcacaggtgagacccctcagtgaggccacgaccactgtccttccatggcccagctctcctgtgacctgtggaggcccggatatatttcttcacttttctttgttcctttttaaattatgaaactaaccaccattcagtacgaaaaagtttaagcagctctgaggaagatagagtaaaaaattgtctccctcttccctggccctcagccatccccggtggccaccgtggagtgtggacggagccctgcaggcctgtgtctgtgcggaagcacgcgcagttttgtctgcacagactgtcctgcagttggctgttttcactcagcgttgtgggtatagcttcccatgctggtgctggcagctcggccttgttcttttgaggacagcagatgtctcctatgtctacctcttacagcttcagagattcaagttataataaagctcttcttatattgagggggaaacctccctcccccttttttttgaaacagggtctcgctctgctacccaggctgcagtgcagtgtcacagtcttggctcactgcagcctcagcctcccaggctcaagcgattttcccacctcagcctcccaagtagccgggactgcaggcacacaccaccatgcctggttaatttttgtattttttgtacagacagggtctcactctgttgctcaggccagtctcctgagctcgagagttccacctgccttggcctcccaaagtgctgggattacaggcgtgagaccccatgcctggccagctctttttttttttttttttttttttgagacggagtctcgctctgtcgcccaggctggagtgcagtggtgcgatctcggctcactgcaagctccgcctcccgagttcacgccattctcctgcctcagcctcccgagtagctgggactacaggtgcccgccaccacgtctggctaattttctgtatttttagtagagacggggtttcaccgtgttagccaggatggtctcgatcttctgaccttgtgatccgcccacctcggcctcccaaagtgctgggattacaggagtgagccaccgcgcccggcccagctctgctttttcttagtggttctgcgttgtgtttgtttctatccaggaatagggttggttttacttttccatcgagtttttaaagagacgacgatttacatggtcggaaactcacgaggactccccatcccttggtcggaaactcacatggactccccatcccttggtcagaaactcacgtggactcccatccatcccaggcagcagcttcccacctgggccctacgtgcaggatgagggctccttccgggtcagaagacatggcggcctcggggcaccgtcccctgcatggggtgctcacaggatcttctcctctctccttcccagggtgtgcccttactacctgtcccggaacctgaagcagcaagccgacatcatattcatgccgtacaattacttgttggatgccaaggtgggggctcagtcctgtagctgacgactcctgatgtccaggggtgtccctgggcttgggaacagctgtccgagcctttgctgcttcagggccttagatcagcaggcctgggtgggaggactcacctctgtcactgggcaggggctcaacctggccagacacacttgtgagcagccccaggccacaggtcagttttctgagcagtctgggagcgggcaggctggtgggagtgaggagagacctccaggctgtggtccataggccagtgcccgctcttgatcctgacagctcaggttctctccttcacgtcaggccatgggaggcaccgagaacacaggaagcccactgactcccctcttcccagcgcgtgcccggccccacactcactccccctcccagcatgtgcccggcttcacactcactcccctcttcccagtgcatgcccggccccacactcactccccccacagcatgtgcccggcctgacactcactcccctcctcccagtgtgtgcccagccccactcccttccgccccgtgtgcccagccccacgctcactccccccgccagcatgtgcccggccccacactcaactcccctcctcccagtgtgtgcccggccctgctgccctcctccccatgtgccctgcttttgtgccccacactttttacttagtgcaggtgggatcacacgccacgggtcaatggtttgtgtgttcacgtgacgatggcgtggtgacgtttccagatcccgtcgttggttcgctcattctcggggtgtatatttattgagagctcatcatgctgggtgctattccaggcatagcaagactggcttcactcacatggagctttgattctagtggtggggacaggtggacagcaaaagagtaagcacgtgagctgatgatactgaagggaaatagagcagagggaggaggcggagaccgagccaagcgggcccaagtgcgatgtcggcgggaggtggggaatgctggtgggtctgaggggagcctcagcaggtgcagcagagcaagggaagaggtgagtgggggcggctggggggccgactcctgggaagctgtagcagaaccccacagagagctggtgaggtttgccgtggttgtgggtgactcggtgctttgagccctggctgcccctgggaaccatctggagagcttctaacccaaccaggcccctccctgggacagttatatcacagctggtaagccgagtctaacactttcacggaaacgcagaagatctaaaacagcaagatgaccgtgaagaagaacagagctggaggactcacctcgctggtttcaagactcctctaaagctgcaggagtggaggtggagatggcccagctcaggcacaggcctgcaggccatggagaaggcagcaagctcaagctgacccacacgcatgtggtcattgttttttttttcagttggaatctcactctgtcacccaggttggagtgcagtggcaccatctcggctcactgcagcccccgcccctaggttctagcgattctcccacatcagcctcccgagtagctgggattacaggcgtgcgccaccatgcctggcccttggtgattgttttttgacaaacatgccaatttaattgagagaggaaatgaaggttgatttctggttttctgaaaaaatggtgctaagaacagctggatatctgttcggaaaacagtgaatcttaactcttgttttaccctgtataaacctaaatgtaaaagctaaactaaaagttatagaaaggaacatgggggaggtctttgcaactttggggtaggcagagatttcttagtatggatacacaaggcactagccatgaagaaaaacattaaaatttagacttcaccaaaatttaaagcttcaactctgtggaagagttgagaaaatgaaaaagcagttaaagaaagggagaaaatacttctttcaaaggacttaaaaaattttttcagccctcctctgatttgaaaggacctttgaccagagtatgtaaaattctcccataactaagcaaacaacccacttaaccactgggaagggatctggacagacgtttcaccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcaccaaggtggatggaatgaccagttgagcacatggaaagtcgcccagcatctccagtcataggagaaggcagattaaagccacggggagccgacactgtggtcccactggcatggctgaaattcagaagccctgagtgtggcatgaggatgtggaacagctggatctcatccatcgctgtgaagttgtgtagccactccacaaacgtgtggcaaacagccgagccgggagaagggaagacgtgttcaaagattcatatgtggccaggctcagtggctcacgcctgtaatcccagaactttaggggccaaggctgggggatcgcttaagcccaggagtttgagaccagcctaggcaacatagggagaccccatctcaaaaaaaaaaaaaaagaaaaaagaaaagacttcagtgtgcaggtttaccagagttttgtttgcagttgccaaaactgggaagcagcccgcgtgagcccatccacaggtgaatggacagaccgtggtacccgaacactaacagcagccacgggcgtggactgtggtcacacagcagcagggagccgatgagtctcggacatgctaacccagagaggcccattgaggaggacctactgttttttgtgtttttgttttttgttttgaaatggagtctcgctctgtggtgcaggctggagtgcagtggtgtggtcttggctcactgcagcttccgcctcttgggttcaaacagttctcctgcctcagccttccgagtagctgggactacaggcacccgccaccacacccggctaatttttgtattttcagtagagacggcagttcgccatgttggccaggctggtcccaaactcctgaccttgtcatccactcactttggcctcccaaagtgctgaggttgcaggcatgaaccaccgcacccggctggacctactgttttattccatttatgtgacactctattaatagaaaaggcaggggtggggctggtggttatatggtgcacataactgccagaactcagtacacttaaaatgaacatcttaatgtgtgaaatttttttttttgagacggggtcttgctctgtcacccaggctagagtgcagtggtgcgatctccactcactgcaagctctgcctcctgggttcacgccattctcctgcctcagcctcccgagtagctgggactacaggcgcccgccaccacgcctggctaattttttttttttttttgtatttttagtagagacggggtttcacagtgttcgccaggctggtctcgatctcctgacctcgtgatccgcctgcctcggcctccgaaagtgctgggcttgcaggcgtgagccaccatgcccggccaatgtgtgaaaatttaaaagtaccaaagctggaccccaccccagattgctcccatgacactctgtgggtgggacctgggagttgggttttgttttgttttgttttgtttttgagatgaagtctcactctgtcgcctaggctggagtgcagtgacacaatctcggctcacattaacctctgcctcccagatgaaagcgattctcctgcctcagccttctgagtagctgggattacaggcacacaccaccaccccctgctaatttttgtatttttagtagagacggggttttaccatgttggccaggctggtcttgaactcctgacctcgtgatccgcccgcctcggcctcccaaagtgctgggattacaggcgtgagccaccgcgcctggctgggagttgggtttgtaaatctccctgagtggggctggggcagggaactgctgggtctgggtcttcctggctcctctggtctgtggcttcctgactgcggtggccgggggctcccagggcatcgtggccgtctgtcttgctgagcgtggcacgtgcctttccatgctgtggaggagcgtctcccggtatggcgaactgctggttagggtggggcggtgttgccaggtcatccaggtctggcctctgctctcgacatcgccggcgctgttgctcatctgcgcttgtgatgttcgatgcctgctgcacatgtcttggcttccctctttcccggcctctgtgagctccagcgctgcgtcccttctcttcctcctgtagagccgcagagcacacaacattgacctgaaggggacagtcgtgatctttgacgaagctcacaacgtggtgagtctccgctggcctcctaaacacctcctattgcttctggcctttttgtcaagagccacgcaaacctttctggaggggctctggccaaactcctgaagccctaggtgcccaggactggggactgagcacaccaggagcttctgccaccccctcccgccctgatccgatgcctctgctggggctggagactggccagctgggccagggacctgcccgtcaggcgcagggcccccacaggccgctcaccagaccctttccctccagccagctcggggtcagcctgggccagggctgtctcctctgccctcggcagcagcaggcttgtggtcttgcctgcagtgtctctgcccttccggccacatggcttgagactgaggcaggagaatcgcttgaaccttggaggcagaggctgcagtgagccaggatcacaccactgcattccagcctgggtgacaaagcgggattctgtgtcaaaaaaaaaaatgttgactgggcgcgctagctcatgcctataatcccagcactttgggaggctgaggtgggcggatcacgaggtcaagagatcaagaccatcctggccaacatagtgaaacaccgtctctactaaaaatacaaaaaaattagctgggcgtggtggcgtgtgcctatagtcccagctactcaggaggctgaggcaggagaatcactcgaacccaggaggtagaggttgcaatgagccaagatcacaccactgtactccagcctggtgacagagcaagactccgtctcaaaaaaaataaaatcaaaaagaataattggcaattccagtgaaataattgtttgtttgtttgttgagacagggtctccttctgtcgtccaggctggagttcagtggtatgatcttggcccactgcaacctccacctcctgggctcaagccatcctcccacctcagcctcccgagtagccgggactacaggtgcacaccaccacgcccggctaatttttgtattttttgtagaggcggggtttcccagcgttgcccaggctggtcttgaacccctgagctcaagtgatctgcccaccttggcctcccaaagtgctgggattacaggtgtgagccaccgcgcccggcctgaaacaatcgtttctaaatattggtgtgggccacacagtcatgtttggacctacttgtggccttttacagaccccaggccaaggctttgggaacttggctgtcagcctcctgtgccttctgcacccccaccccatttctgctttctggaacccccgatcctgtcctgttctgtggtgattcgggtgtgcttgggctctaggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccaggtgcgttcatagccagactgcttggtcctgaggcctgcgctgctgcagggtgagccccacccggagttcagcacggactcccccagcccaggtgcgttcatagccaggctgcttggtcctgaggcccgtgctactgcagtgggcagcctgccctgtggctgtgtgtggtcggcctgggcaccatctattcaggctggcactgcagggcatccgcttctctcagaggcttcttgggtgtgaattcttcagggtcctgtagcctgtggaagggctggtattgttcagtagttctggtattttccaaagacctatgtcttctcccagccagtatcaacttggcctctactgtgtaaaactggaaaactctactttgtgaagctgagttgggagcatcgcttgaggccaggagtttgagaccagcctgggcaacatggcggaacctcgcccctgccaaaaaattagccaggtgtggtggtgtgctcctgtggtccaagcttttccggaggccgaagtgggaggcgtgcttgagcctgggaggcagagcttccggtgccccagatgactccactgcactccagcctgggcggcagagtgaggccatctcaaaaaaaaaaaaaaggaaaactaaatatattcactgtaagggcattttgcatctttaaatgacccacaaatctggcatgcatcagctgctctgcctgtaggttccttcccagtgtttgtccagaggtgtatttccacacagcgctagtcacggcatacgtggaaaacgtggaaacccttcatggatgttgtcagttggtctatattttctttcttttttttttttttgagatggagtttcacttttgttgcccaggctggagtgcaatggcgcgatcttggctcactgcaacctccgcctcctgggttcaagcaattctcctgcctcagcctcccaagtagctgggatcacaggcgtgcaccaccacgcccagctaattttgtatttttagtagagatggtttctccgtgttggccaggctggtctcgaactcctgacctcacgtgatccacccgcttcggcctcccaaagtgctgggattacaggcgtgagccgccacgcccggcctttgtccatattttctacatggcttctgtaaacagctgactaggagtctgtgtgaatatcttcataggttctgctgtgacactacttgctcgtgagcatctccaggtgtaaacagcatcagcttcccccattttcctttaaaatcgcacatgtggacggacaccacggggaccctggaccctggggagccccgtcctcacccttctcaccaggatggctgcttggtagagagtgagtttgcaaagttggcatttgtttagtacagaagttatcaggtgttctggctttagaatccctttatatatatatatatatacatatatttaagtgacagggtctcactctgttgcccaggctggaatgtggtggtacaatcaaagttccctgtagcctcggcctcctgggctcatgggatcttcccgtctcagcgtcttaaagcgccgggaccacaggtgtgcaccactgccaccggctctcaagattgccacgcagggagttgcagtgggggaaggggttcctgggactttgaacgctccacctccctcctctccacagtcccccaaccccacctctctaacggggtggacggccgcctctttccatccttcgcttggcgcagggtggggagagtgacaggtctccttccctcatctcggcagctgccatttcatcgcttacataacgtgggagaaacatccacccacccccaggcctgtgtgaacatcaccacggggccttctccactcttcagttttgttagttacttgatgtgcagggctttttgttgtaactagtgggggacgtgtggtggggtgggcttctgccatctcattcaggaccagaacttcagttttcatccctatctgttcccccacccctttggagatggggtctcactctgtcacccaggctggagagcggtggtgccatcacggctcactgcagcctccacctcctgcagcctccacctcttgggctcaagtgatcctcctgcctcggcctcccaagctcctgggactacaggcgtgtgccactgtgcttggcagggtccattcttttcctcacactttatttattgaagagcccaggccgtttaccctgcagagtcggaatctgtacaggaggggcagccacacgagttccccggtttactctgaacttaggtggcttgagggccccagttagactgcggccaccgtttgccgggctccagatgggacgtcctttctatcagaaggctcacagtatctcctttcccgtttcttcccatgtgaacattgttgctgctgaacacctgaatatgttaatcactgggggcttgcaagatggcagtgtgctaattccatcatctagtcagttagcaggaataacttaggaccacgccctgcaccatatcagctatgtggtgatcccattcacacaggaaaggtgggacaaatgctgggggtgggccgggtgtgctgtctcacacctgtcatcccagcactttgggaggcccaggcaggcggatcacgaggtcagagattgagaccatcctggccaacacggtgaaaccccgtctctactaaaaatacaaaaaaattagccaggtgtggtggtgcatgcttgtaatcccagctacttgggaggctgaggcaggagaatcacttgaacccaggaggcggaggttgcagtgagccgagatcgcaccattgcactccagcctggcgacagagcgagactccgtctcaaaaatcaatcagtcaatcaagtgtcatcactgaatgtttgtgtgtgaacgtggggattggtcctgccccatgctccctcctgaatctcactcctgacctcagttgctgcaccttgaggtgttttcatgtgggctcttgtgtcctgaccccggcggttgtggcctctttgctgtctgggagtcaggatttttcacactcatgtcctgctccagacctggaatcagccaagtctccaagaagccctgctttcttttcctgcaagacggtatttcaagacccgccatgcggcagcgggttggtcatggttactgggttggtcgttgttactgggtgttttcgtggagatacagccatacgcacaggtgtgttcacaaatgttaattctaaaggtcaaacacccggccaggcataagggctcagcggtaatcccagcactttgggagaccaagactggtggatcacctgaggtcaggagtttaagaccagcctgagcaacagggtgaaaccccatctctactaaaaatgcgaaaattagccgggcatggtggcgcacacctatagtcccagctagtcgggagacagacacgagaattgcttgaacctgggacatggaggttgcagtgagcagagatggcgctgctgcacccctgcctgggtgacagagtgacaccctgtctcaaaaatgaatagataaataaagataaaacacctgctcctcttggtgtctccagtttggatttggcctgtgtagcctcttccttcgcctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccatgttggtggatttggcctgcatggattctgtgtggcctcttcctttccatgttggtgtccttttttccatgccaggaatcctggttctcaagggcggggttgttggcacgagcgtgatgcagactgcctttgctgcctttctcttgcccagggctgaacatggagctggaagacattgcaaagctgaagagtaagtgttgccctccccgcctccttgcagctgggtggggcctcctccttgcgaggaggtgggtgacacctcctcgacccacagtgatcctgctgcgcctggagggggccatcgatgctgttgagctgcctggagacgacagcggtgtcaccaagccagggaggtgagaggcggggagccagccccttcactgcaggcccagcctagagctagaaacgggccatggtgcagtcctgggctgtcacatcacgagtgaggcctgttttcaggcctgttttccctttttgagacctgggaggagcacctgctttgcatgatctggttgctgagatgttgagaggagcagcacacactcccacgggacagcacacagccccccacggaacggcacacacacccatggaacagcacacacactcccacgaacagcacacacactcccacgaacagcacacacactcccacggaacagcacacacacccacggaacggcacacacacccacggaacagcacacacactcccacggaacagcacacacacccacggaacggcacacactcccacggaacggcacactctcccacggaacagcacactctcccacggaacagcacacacactcccacggaacagcacacacacccacggaacggcacacactcccacggaacagcagactctcccacggaacagcacacacactcccacagacagcacacacacacccacggaacagcacactctcccacgcggggccgctgggtttcctgcagtttctcctcctccaggcctttccctggaccctggtccagtccgtcatttgagcacaggtgcctgttagaacgagaccttcttgttaggacgatgagtgtcccagccaccacctcttttggactccgggaggcctggaacgttctgaacgctccgtggggctccagtcttctccgcagccagggcagcagggtttgctgtctgtcctgcaggcagatgaggagtcagggctggggcctgtgtgggggctctcctgagcgcacagccgccgaggtggagcgtgttctgcctgagcgccgacctggtcgggggaatcccagttgcttccaggtggagccactgtcctcagcgtaatgctcaaggctctggcctggctcctcggccaccctgcaccctcagggtcccctcctgtagcttctgctgccccatcactgtcactctccaaagctttggggactctgcccagagccaccgcctcccagaagcccctgacaacctcttgacgaccccctagtgaccccatccctcccctctgacggcggcccctgctctgaggcggcttcttttcctcggtgctgttctcgtgctggccaggcctcctctccccacctggaggctcctgagggcggaggcctctcacctccaatgctggcgtcccctggagggctgaatttgtttccgagggaaggaaacttccacagttgttgccttcagttccaaagctgcagcctgatttccccctccaggctcgagcctgttttcttctcggcagctacatctttgaccagtgtcgtcccccctcaggcccgagcctgccttcttctcctcagttcccaaagctgcagtctggtccccccgccaggctcgagcctgccttcttctcctcggcagctacatctttgagctgtttgctgaagcccagatcacgtttcagaccaagggctgcatcctggactcgctggaccagatcatccagcacctggcaggacgtgagtgctggcacggggtctttggtgcgggcaaatgtggcgtagggggtgcagcaggcctccatcttggcagtcagggctcccctggccgtcacctggccgtcagcaggaacaggcccacagaacctcatcttctgatcggggcgtggaggcgttagtgccacttgccagctgccgtagagcctgtcccagttctgcagctggcggcttcgtcctacagcctcatcccattattctgcttttgagaaagagcagcccaaggccctagctggcttgtggggcctctggcttctccacaccaccccgagttctgcttctcagagttgtggggtccagaggctttgcccagaggcggtgtccccatgggctgctctggtttgagacgccgggcccagcggggtctctcctctgctgcgctcccgggtgctggggagggtggcttttgctgcttcaacccttaggcgaccatagagcctcttttcaagtcccactgacccccttggagactctgtccctgcctggcttctctcctggctgctgggaagagcaggcgaactgcccgccctgaatggatgctgcgctccaccctgggccccccattgggcaggagatggagcttggcagtcgggctgagcgggctcatgctggaagggccggggctggggtcggggcctcccctgcctgcagtgtgggtgtcagcgccctgctgccctccaggtgctggagtgttcaccaacacggccggactgcagaagctggcggacattatccaggtggggcctgctcctctgtggcatctccttccctgatggaagccgggcgggtgccttctcctgctgtattagttaactgattctagacttggggatgggagaaaggcccctacaccacctgtttctgattggcaaactctcggctcctttccagtgccctaaacccacactgggcctcctgcagggatgggggaggacgaggtctggtggcacatgcccagggtgatgctggtgagggaggacgcaaaggacagtgggggccggggagccgctcctgccctgtccgggccctcaggccaggggggacccactgctggcagccccagcagccccagctgcacgcagatgaagagctctggacacacgcggcttcctgaacagcttctccagggacagacaaatggggaccctgcaggttcccggcaggggtgtccctgggagcccatgattgggggtgcgaccctggcccccttctcattggccccgtcctgtcctgcaatgcccgtcccatgtgaggtctgcttctggctccatgcctatggcagcacctgctttccctggcgtagaggtgcttgtccggtttgtggagggcacgccccattttgggtgctctgggcacgttgcctctccggggcctcggtggcttttttagaagcagactcagaagtccctgactggggaagccaaggcacaggtggctgtgtggagccctgtgaggcctcctctgtgctgcccacgctgtacctgctggccacacgagatcatggcagggttaggcagggctgcccagcgctatgacagcttcatgagtgtccatctggcctgtggggtgcttgagctgggggaggccgcagaagaaccctgggatgcatggctggcctgtgcatgctgctgggcatggagctgcagatcccggaacaagcaggcactgccttctccttcacagacgcagctctgagcgggggcgagacctgggcagggaccaggtggggtgggcacagggtggtggggcccaggctcagccctccctccactgtggccgtctctgtggccagtgacgccacagcctgtgtcttctctgtgcggtagctggggctggaaggacagcactgccttgtcctcccaactcctccccaaaggcacggtgggcatcccaggcccagacccctctgtctgtggctcctgcctgccaagggctgctgtgctgtcccgcatggagtgtggttggctcttcaagcaggaggccgtgcacctatcaggcggacctgcttccatgtccctgatgggtcactgcaaagcacctccagcacatggccaggcgaggtagccctgcagcccagggcctggagggcaggtgtgagctggcccgggcctgtccctccctggaatacagcttcccaggctcccacttatggagaagtctcctccacactatggaactgaatcctagaatgtggcttctgaggttcctacactcgaactgaatcctggaatgcggcttccaaggcttccagctatggagaagactccacactctggaaccgaatcctggaacgcggcctcccaggcccccagctatggagaagactccacactctggaaccgaatcctggaacgcggcctcccaggcccccagctatggagaagactccacactctggaaccggatcctggaacgcggcctcccagcctcccacttaaggagaagtctccacactctggaaccggatcctggaacgtggcctcccaggcccccacttaaggagaagactccacactctggaaccgaatcctgcacactccatcggtttggaatttcctttggctgctgctctaagtagccgctggtggatgactcagcttctgccagccctcgggtgcctggaggatgagggactgcacacagtgctcacccgcgttggctcctgagcccctgcaggtgtgggcggtgcccatagggctggtgctgggttgggcctgcagccctgagtcacaggtgaccctgggggcagagtggggccagtggccccaggaagaggatgtgggatgcacagctcagctggaggcgaactccaggcagggtcaggccgtgtgctcggaagtcagggcttagctggaggcaaactctgggcagtgctggcccgtgttggggaaccagttgcccctgggcccccgtgagactgctgggtcctcatccctctctgcctgaggccggagctgccctgggctgaggcacagggggatttgtggtggtgtttttttgagaaagggtctcgctttgtcaccccggctggagtgcaggggcttgatcacagctcactgcagcctcaacctcctgggcccaagtgatcctcttgcctcagccacccgaggagctgtgaacacaggtgtgcaccaccgcactcagctaatttttaaaatttttttgtagagatgaggtcttgccatgtttcccaggctggtctcaaactcctgggctcaggcagtctgcccgccttggcctcccaaagtgctgggattacaggcaagagcttccatgcctgcccagcagaaggcttttcgaaggaagctgtttcctgaggcagactcagccctgctcatggcagccaccagcgtgggggtgaacttgttctgttacttccatccccgtgggccaaatgctttggtaaaacacaaggccctgtgtttagctgtcttgacagtgaaaatggctgggaaggaaggaaggaacggaaggaaatttctctctccttctgtgcgtacccaggcacgtgcacatgcatgcagagtacgcacacacgcacgcacgcctgcacaaatccacgcatgttgccaagtctctgtgttccagccgtggtgtctgccccccggtgttctctagttcggcttctccgcatttctgtgaatgattccggcttcttggtgttcccagcagaactccctcaagtctgcggcggggctctgacggcggtggcttggctgacatggccacattgctgagcctgttgggggctttgcgttcctgttctggccgtttttggctcgttttccaggaacggtcgtcacgcgctcctctcctagtgcaggcatcattcctttcccattgatttgcagggttctctgtaagttctgaggatcccatatacatatactctctgtaagttctgaggatcccatatacatattctctctctaagttctgaggatcccatatacatattctctctctaagttctgaggatcccatgccgacatacatattctttccttgtctcatgctggtcattttttccattttcatgacaggtttggtgaacacatgtttccttgtcagatttttgttctgagcttgtgcctcccgaccaagatgctaaaccgggtcttgtgtattctccaaactgcactgtagagtgacggagctttgtgtctgggcctccatgccttctgacgtcacctgtgggggtgtgaaaggcagactctaccttgatttttcccagcacgccacaccggtggttctgtgcgctgaccgagcggctcggcttcccccaactccactgggcacctgccacacttttcctcatgtttttgttcactgtggttttgtcgtaagtcctggtgttggcctgaaccaatttctttttgtttgtttttgagacagagttttgctcttgttgcccaggctggagtgcagtggcgcgatctcggctcactgcaagctccgcctcccgggttcacgccattctcctgcctcagcctcccaaatacctgggattataggcacctgccaccacgcctggctaattttttgtatttttagtagagacgaggtttcaccgtgttagccaggatggtctcgatctcctgacctcgtgatccgcctcccaaagtgctgggattacaggcatgagccaccgtgcccagcctgatatttttagtagaaatggggttttgccatgttggccaggctggtctcgaactcctgacctcaggtgatcctctcaccttggcctcccagagtgctgggattacgggtgtgagccaccacgcccggcctcttgttcttttgaaacctgccctgacgttttttccatagtgcatcttggagtcagcgtgtctacttcctgtaaaaatcttactgtgattttgactagaatgtgttgaattcctgttttttttttgagtcagggtctctctgttgcccaggctggagtgcagtgggaccatcacagctcactgcagcctcaacctcctgggctcaggggatcctctcagctcaacctcccaagtagctgggaccacaggcacatgccaccatgcccggctaggtttttttttttttttttttggtgaacaccctggggttgcaccatgttgcccaggctggtctcgaactcctgggttcgggcagtttgctcctctcagcctcccggagtgctgggattacaggcctgagccactgcactaggccatgttgaatttctagattaatttggggccctcaggggcacagagaggagggctgggccagttggcgggaggagaggcccctcgggctgccgcattttcagtgcatggagatggcctatgttgggggaacacagagctcaccgggggtccctgcagggaggagaaagggtcaggcaggtgccagctcctgtccattggcctggggctgcatgatggcaggggccggtgaaccgatgacccctgggtgtcctgtgaccttctgtgtatgcggctgatgctgcagaaagtcgggtggcctcaggctcctgacggggctgcacttcctctgcctttcagattgtgttcagtgtggacccctccgagggcagccctggttccccagcagggctgggggccttacagtcctataaggtaggggccacctccaggaggcaggtggagggcagcccttgttccccggcagggctgggggccttacagtcctataaggtgggggccacctccaggaggcaggtggggctgggggtcttctggtcctaaaaggtaaggggctgcccccaggacatgggcggggcctccacactcctggtcctgtcccctccaggtgcacatccatcctgatgctggtcaccggaggacggctcagcggtctgatgcctggagcaccactgcagccagaaagcgaggtacagacctgggcccacacgctccccgcccgcccgggtgcagtgcccggcaccaccatgccacaggctaggcacatgcccagccgtggatctcctgcccccatgggcctggccaccttctccatatccaggccaatccagagcattctcctcactgtccctctgaagattggagttactgagagacgtaggagatggcctgatggcaccgtgacctgcccagagtcacctggttggtggtggcagagccacagcccagccaggcctccctgctgggacacgctcgtttatgccgaggccgtcagcacagagcctccacagtgaggcacggctctgcctgctgcctccacgcagcgcctggccgggccaagcctcagggtcacatctgaagggggcccggctggccctgttgtccgaagcccctggtgcgctcagccccgaggccccacgtgccttcttggcttcctgtgctccgtggcgtcttcgagtcggtgctgccggggacgctgtgtggatggggtctgtgagtgtgccctcggctccgtgtccggagccctgtggttcttggggtgtatctggccccacccccactgcgtggtgtccagggtggggcttcacggctgcagctgcgggagctgctgcccctgccttgtgctccagtggggccttgcctctgggcttggttcgtccctctctggaacattctttctcagctgctgtccgacccatggtggcatgacgtggccctggctgaagcagcccttgtgcggttgctgtggttgggtctgcctggccgagccggaagggaagggctgggagggcgtcagggtggcgtggcttgacccccgctcggtgatggtcctgcagcaaggcctctcccagcaggaagcgtccatcccggggggaggccggcgcccctcacgcagttggggttgcgggaggcagtgcgtgcctgaggcagccggtgcacagattccaagggcctggaatctgtttgttccattgacctctgatgtcacttgacttctcagaagcagccactccctgcactgggcgtttgtaggaaatgagctcctggaggagggggtggggaagttcccccattgcagggcacactcagccccaggaaggaaacgtgcctcgtccctgctgactccgaatcgcagtcagagtcgttctgcttgtgccgtgttgaattcccggcatccggcatccagactcagcctcctccccaggccacggccgccgtggccagtcggtcaagcccttctaggaacttcctttgagctggcgcccttgttcactgctgacgccactcagaggcttgtgcacgtgtcctgcttccaggcagagctgggaactcgcaccccgtcttctgcacgcggccgtggaatgtcgggatgccggcgcttccttcccgtgtgctcttggcggggtgggcttcttgccctgagccgcatgtcacagtttctgcagaagtttagggttggagtgggctgacctctctgcaggtgtccccagcctctgcctggggtctgcctcctactcccaggaccccctgtcccccagaggggccccaagctggcaggctcacactcagggcagcctcctttgttctgacttctgcacagtgggcctgggtggctgcccgcggctcgcttgcttgatgccagtgggtggagagggtgatgggcagagaggcaggtggtcaggcccccagtcccgtcctcacactctgtgccctctgccgccccccgccccacagggaaggtgctgagctactggtgcttcagtcccggccacagcatgcacgagctggtccgccagggcgtccgctccctcatccttaccagcggcacgctggccccggtgtcctcctttgctctggagatgcagatgtacgggccacccctgccagggcctgagcaccggtgacacctctgacatcagcggggtggaagtggtgggggtccccatgagccgggtgctgggggtctcgggcctcgagggctaaaggggtgctggtgcacttccccactgtctgctccctctggccacgctcagccctttcccagtctgcctggagaacccacacatcatcgacaagcaccagatctgggtgggggtcgtccccagaggccccgatggagcccagttgagctccgcgtttgacagacggtgagggcctgtccctgggccctgctggggtgggaggtgggggagcactgaggcctgaggtcctgagcagtggcctctccggctctaggttttccgaggagtgcttatcctccctggggaaggctctgggtgagtgccctgaatgccccagctgtgcccatcctggatcctggacccctgctcccaagagctggtagggaaccctgcagacatcctgcccctgccttgaccccggcccctgcacttccaggcaacatcgcccgcgtggtgccctatgggctcctgatcttcttcccttcctatcctgtcatggagaagagcctggagttctggcgggtgcgtctcccctgtgttctgggcggggtgggtgagggcagggctggagcatgaagcaggcagtggtcacagctcctgcttgccctcatcggatcggcggcgtgaccagggctgccgtgtccctgcctcttcctcccacaggcccgcgacttggccaggaagatggaggcgctgaagccgctgtttgtggagcccaggagcaaaggcagcttctccgaggtcggcacttggccggggctctgggcctgctgccccctcgtgcctcccctgcctctcacagcttccccaaggctgaccactggccctgaccatgggctccggcggctcccgctgcctcttcagggctcctgcgtttccttcctggccctgagtgttgcctcttatcttacaaagcccccagcaccgggtgggtgtggtaacagtggccctcctgtctgagtagccctagtcggccaccctggccctggggttccccgtgttttctgggaagcactgagcaggcgtggggtcagcctgggatccgtgccaggaagaagcttccagaacccgattggccttcctggctaggacgatccttcatcttggagcatgagacctgggtctccctcatgggggaggaaggggctgggggggggctccaggctcagcctcaccaactttccttccagaccatcagtgcttactatgcaagggttgccgcccctgggtccaccggcgccaccttcctggcggtctgccggggcaaggtgagctctccagggccctctgccctgacctggttgcctgttccctggtgggtgcttatggctccccagcagactctgggccctgggggctgcccggtcccctccttgggtcccacgagagcgactgctggccctgctgggagcgtgtcctgctctgggcctgggcaggcaggatgggagtttcctggccacaagagttggaggtggcgtctgggagctgtggaccccaagtggggtcctgacccacagatggagcttcctcccacccctggttggggacggagcctcggggaaggtggctgggctgggtgtgggcaccagggagaggagcccccacggccccaggcagctccctggtgtgtcccctaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatggttctgcagatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcaggtgcggacgggcagcgctgggtgggcggtgtgggggtggcggagcgggcggcgtggggcgggcagcaccaggcgcccagggcggaggcgactcacctggctttgtgcgcttcccctcccacctccaaaggctgcctctccctcctagggcagggcccccacgggctgcaaccctcccctacaggcagagaacgccccaggcaaggatgccccccgaggctgagactccccccaatagcagggaggacacccacaggcaggaccccaagtgctgggactctcccccaagaggggctttgccacaggcagggaccccagctggggccccccgtgggcttcactgcgcactcgggtgcccctgcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggtacagttccagggccttgggatggacacagaccctctgtctcctgaggccaacccgaccccgcccatctggcctcaggcacctccccacacacccctgtaaatcccctgcctggcaggcaggcgggcaagcgggcgggggatcccagctgcctggctgtctgtgggtcctccaccccacctcacccacaggctgctggctcccaggtggtgcatgccctggccctccgcgggtgccccccacatcactttggttctctggcgggtcagcttggctcagtgcactcaaggtcgggtgcccctgccactggctgcgcttgaggctggcctttctccaggaatgtgctgcgggtggaacccaggttccttcttccttggggccttttgccccagaagcccataattcctcaggccaacccgaaattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggaccaagttgtggcactgtcaccggggtgtgctgtgcccccctcccccgacctccatcttggctcagggctccttgggaccatcttccctgtgcgtccaggtgctttgggaccccagagtgtgtggttggggtctgtgtgtggttgtgagctgtgtcctcctcaggcccacagctgctccaccctgtccctcctgtctgagaagaggccggcagaagaaccgcgaggagggaggaagaagatccggctggtcagccacccggtgcgtgagctgtccctgcacctgtgccgaccaccatagacacgcatgggaacgcagccgtgggtgcccccagccacggctggtcccgatgggaccagggaatccacccccaggagctgatgtccagggcagctgtgatgctgacggccaggggctcaagtgtgtggtttcttctgcagggggctcatgagtcccagctggaatcaggccccacccttgggcaggtttggcatggggcctgcagcactgggcttggccctggcatttccctcaagtgtggatgcacacctgcctcatgtgagggacacagcccattcctagccttggatcaaagaacggagttatagccggagccaggaagccccctgcctgctggaaaaccccaagtgtggcggcctttgtccatgtcccttggcttctgggaagaactgggtggtgcccaggcagggctggtgccatcaggaagtgggtggctgctgaggggcctgggctggcgagggcctgggtggggagtgcctgggccgcccctgccttggtttccacgtttccgtgttggtctggggtgtgtagagagatgggcactgctcatccggaagcccctccttgtgcgctgccatcctgggagcctcagccgcatccgctgtggggcagggggcttgagggaggaggagagagacgggccatgcaggacccctggcttgaggcagagccaatctaccctttgcccattcactgctctcagttccctgccagcctctcactgtgtgacctcagacgggcccagccccacagctttcttcccgcagcccctccctatgtccatccagccagccagtttctcaggcagcagccccacctcggcagtcactgtcccagggaacgctcaatgttccaaggaaggctctgcagccccagggaccagatgatgaggctggccctgatggagcctcgggcctgtgtcctgcaggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggtgccctggcttgcagaggccacccaccctgagggcagtgctgccgccgcgtgtggggtgggggccatctgggtccaaggtggtctctgttctctagagaaaaaggggcagatggggacagacgccccttcctctacaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggtaaatggggccccaggtgggaccctcagactcctgcgtggaaggcagtgtgggccagagtcctgggctgcttggggtgggcatcctcgggccctgcttggccccgcctctctgttcccctatgggagtgatgggggcctccacctccaccaccagcaccagcagcaccacctccacctccacctccacctccacctccaccaccacctccacctccaccaccacctcctccaccaccaccacctccaccaccaccaccaccaccaccacctccacctccaccacctccacctccaccaccaccacctccacctccaccaccaccacctccacctccaccaccacctccaccaccaccacctccacctccaccaccacctccaccaccaccaccaccaccaccaccaccaccaccaccacctccaccaccaccacctgcaccaccacctccacctccaccaccaccaccacctccacctccaccagcagcagcatcacttgttggggagaccctgtgcaactccatgcacagccctgtccctgccatagccccgacccctaagcacagccctgtccaactgccacacgtcccctgcctcccatgcatggtcctggggggtcaactgcacacgccagggtcctagggtcctagacccctgtcctccctgtttctgcctctgtttggggtggagtccaagtctccagaggcggaagcatctgtgttcgtgtgttaatgaacagcccctacagagttcccctagttcacccaggggggaacctagcctgttgggacgaccccagatcccttctgggcttggtactcactgggatatcctcatgcctgcacccagcctacggctctgagctcctgagtggggctttggcctgcccgccactgttccagcccccatccagcaggctggtgtctcctctgatgcccccagcacccaggcgtgtacctgcctgggttttcccgccctggtctgaggtgggtgaggcctggcctccctagccagccctgcccccccaccccagggaactttccagatgctctcgaccagctttgtggctctacatctcttcatcaggaagaacggcgccggatcccaagctgaccgtgtccacggctgcagcccagcagctggacccccaagagcacctgaaccagggcaggccccacctgtcgcccaggccacccccaacaggtagctgactcctgaaccgtgtgcagcctacgacttggtgggtccctcagtggcttcacgaggctaactcttgagtgtggccggggctgcccctgtggggagccatctcatggtggggactgctcccggttctgcaccccgcagttgtcctgagcagctctccaggagttcctggaggaagggcgggcagggcggtgggactctcagtcctccaccccagcgccactctgagccatgctactcccacaccaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacagcaagtggccctggcgtggggaacagccggtggggtggggggcaggggacaaaatgggggctgtgccgggtctgattgaagctccccgcagggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggtagggcacctgcctggctgctcctggcagcgccccaaccgcacgcagccctgggagtgagcagcaaagccccaggcccccctcagactcaagtctctgtctccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggttggtgcctggccactacagttcctgctgggtgtagccccaggtgatgggctgagggggaaagggcaggcccttgtcctggtggcaacgcctggcagacgtgtgcagtgggccggttgtctcacaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtg

SEQ ID NO: 1964 - DNA, 38444 bp, Homo sapiens; identical to SEQ ID NO: 1963
  source 1..38444: mol_type = genomic DNA

SEQ ID NO: 1965 - DNA, 40889 bp, Homo sapiens
  source 1..40889: mol_type = genomic DNA
agtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtgagtcgcagtgaccctacaagtggttcttttacccgagcggctcgtaggcgcgttgcggtttttcgaaactacagctcccggcaggccccaagccgccctcggggccgcgggtcggcggattggccgcgctgcattttgggacctgtagtttcctgcgctcgtggcgctggcgccgcggcgttggctgagcccttgaccggggctggagggaagggccgacattcagtgtgtccgcgtctgttctgttagtcccagttcccgggcgggattgaggcttagagaagttgagtgatttgctgagggctgcacgggttggcatcccggcatgctctttcgctactttggctgcatctggttgcccacccgggcggatggggaatggactccagccagccaggagggcagagggctggagaggcagggccggaggttcagaccctccgctctgacgttgcgcctggtgaggccgggaggggtgccgcttgcctcttcagccctcacgctcttgtggaagtcgcggaattactgcaggcggaacttgcagcactgtgggcgtcttttccagagaaggacggagttgtggggcgggaggataaggcaaggcccagccacttcgcatcttcgccccgccagctcctcgagatgggatataccagggttgctctccaaccctctccgcaggagggactgatggaaacgcctgggaaagtagcccggtacccacaaaggctgtctacaaacagagtcttactgtctttcccaggtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcaggtagagcacaggccccgaggaaaggactgcgggtgggtggagcttcagccaggacggggtgtgcttccctctcccggcccattccagccaggcccctccgggccagaggcagcgtctgtcataaaaagggctggtgttccaggtggggtcagagagaggattgacaagtaaaaacgatcgtcctttgaagggggccggcccctccacacctgtgggtatttctcatcaggcgggacgagagactgagaaaatgaataagacacagagacaaagtatagagagaaaagtgggcccaggggaccggcgctcagcatacagaggacctgcaccggcaccagtctctgagtttcctcagtattcattaattactattttcactatctcagcaagaggaatgcggcaggacagcaaggtgatagtggggagaaggtcagcaagaaaacgtgagcaaaggaatctgggtcacaaataagttcaagggaaggtactatgcctggatgtgcacgtaggctagttttatgcttttctccacccaaacatctcggtggagtaaagagtaacagagcagcattgctgccaatatgtctcgcctcctgccacagggcggcttttctcctatctcagaattgaacaaatgtacaatcgggttttataccgaaacattcagttcccaggggcaggcaggagacagtggccttcctctatctcgactgcaagaggctttcctcttttactaatcctcagcacagacccttcacgggtgttgggctgggggactgtcaggtctttcccatcccacgaggccatatttcagactatcacatggagagaaaccttgggcaatacccggctttccagggcagaggtccctgcggctttccgcagtgcatcgtgcccctggtttatcgagactggagaatggcgatgacttttaccaagcatactgcctgtaaacatattgttaacaaggcacgttctgcacagctctagatcccttaaaccttgattccatacaacacatgtttctgtgagctcaaggctggggcaaagttacagattaacagcatcttagggcaaagcaattgttcagggtacaggtcaaaatggagtgtgttatgtcttccctttctacatagacacagtaacagtctgatctctcttttccctacagtccttgagggtgacagacttaggagtgccttgggggcctctctgaggagcagctgatattcacgggtcaggaggaagcatttccattagaggggcagccggtggccagcctcacttggaaggtctttgaacctcgggggtgcagggaggtggcagtggtgcaggttgccttctcctgggttccttgaggtgccctcttgtacccggctcacacccttcccctccccgagtttcctgctcaggttcccgtctgagagcttgtatgtaggacgtcagataggacagcataaatgtttggatccagaaacgcagaacagtttcctattttgagacttgacacctaattagtcatcttactatttaagctgaaaaatagtgtcgtgttttgggtaacgttctgcaaatcgtttgctaatggcggctgagttgcttcacgccctttagggcaagagtgggacttgcctgtggacttctccgcggtcccacagggctctcgccacctggcagtggcctctgcatctgcaaagagctgcccgctggctgccgaagcttgtctcagggcagcttgtgtggcctcgcctcttcctggcttccccgtaacccttgctccgaactccgttcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccataggtgaccctagttcccaggcctctcctggcctcctgtggggatggttggcaagggatggcgctgagggtggggtgggcccatggggactcctgccgtctctcaagcagaactcaaggagaattttttagctgctgtataatttctcgccatcgtgggtgtaaacctagggttgggcttttttgctgaattagggcacggcagatgcccacttcacccatttttgataaaccagtatctggggtgtcagattcttggctgtctgcagggccgagttagccgaatgccacctgcctttgatacgtgagaacgttgtctgagaaccgtgacttctgtgcttgcttgtgtctggtcagcttgctacacggacatcccaaagattatttacgcctccaggacccactcgcaactcacacaggtcatcaacgagcttcggaacacctcctaccggtgggtcagacgagtttacacctgtctcggggtcctcaagagaaccagcttggcatggtgctgagtccacagccccatgctgtgctgtggtggagggtggtggtctttctagacgctcccccgaagtgtgcagagcgctggtgcccaggggtggggtgcggcctgggctgcctccaatgcccattacttgtgaggaagcagctttgcatctgtgtgctgaccttgggcgggcgtcctgagctcctcgcaggtgctgttgtagcagctgtgcagtaggtcagggctggcccccagtgcagctttgcacatgaagtaggaggaggccctgctgcttgtcagagcccagcagagtcttggtgttctgtcgggttcctgtggccggaccagtggcagggtgctgtggaagctgtcgaatctcctccctctgtccagtacccccgctcgtcttctagctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacaggtaggctcctgggctcccgctccggctcagtgtccgacaggcgagtgctgctgggtgtccagagccccaggctgcgctcccgctgggctagggtttgaagttcactgggggactgcaggggaggacctggtgggggtggggactggcttcggtcctttcttggccgtgcttcagctgcgcactctgcccttcctcccacagatccacttgtgccgtaagaaggtggcaagtcgctcctgtcatttctacaacaacgtagaaggtacaagcagctgggtgggaccagggtcgggttggagtgtgtgcagcctctcagggtggagctcagtggtgtcacagcctggttgtgcttgcccggtggggcggccagtgcggccatgtacctgggccctgtcttctgactcggggccacccatgttagacttctgtgtggaagagctcacacagtggtctgagacagccagccggcaagactgcctctggctggtgcctggggccttggattttgggaaggctccctccatttcctgatgagagggtctccctgcacctaacctgctggtgcaaacagtaggggttttgctgaacaccggctttctcttcggggactttgttgcttgcccagcagcaggtgctccagtgaccggccctcataccatcttgggagggtgtcctggaagccgtgtctggcctcccgcgaccctgccccgtgtgtctttttcctgtgctgaccttgctgcggaaaattatggccctgagtgtgactccaggctgagtcctgtgggtccaacacgggatgccttggggcctcttctggagacgggatgtgagtgacaggagccggccggggcagcttgccctgtgactgcacgtggccacagcctgtgagggccgggggtgcttctccacccacgtggctgcccctcgggtatgtcaagggcttctggggctcatcacggggtcctagagacagtggcagggtgcacccccgttggctgcccttacagtttctgtgacctgagggtggcatctgtgcagtcggcgcggtctgtgcttctgtgggatcagggttccctctgtttcctgcctcagttggggctcaagcctcaggtgaggtggccccggagcactcagaaggcatcggcggtcctgtgggctgctttctgcactcacgtttgctgagtgctcagtgtgccaggactgaggaccctgaagctgctcttgtatttagggcggcgctcccctggcagagactgagccaggtggtcccgcatgacccactaccaggcgtttctgggccctggcccttggagggacagggtgggcggaacatgggcctgcagggaggctcccgcttactggaggcatgtgctgtgttgctggagacatcctctgtgttgcttcttgttcgctgtggtttttggtctggtggcaccaaggaccctcagtcatcttgatgtgtggttgtccaggcctttttgttggtcctaagaaggggctctgcctttgtgcccccaggttccctgacaggagctgccggctcgtcccggtgatgcctgcaggacgtgactctgggacggggggttgggcagatgtgctgatggaaattctcaagcaggcgtcatttccgaggtcctcacctggatttccaggacaggagtgcctgctgggtgtccccagtcccatgcagcgggggtccttgggatagcatggaacgctgagcatgggcctggccggccgtggtcctggacaagggcagtgccccggtggctgctgggcctgggacctggtggggacgctgggcctggtacctggtggggatgctgggcctgggacctggtggggaggcctctgactgcctcctggtgctgcttccgtctgtgttaggcctctgggtattggggcccccatctgtctcctcctccaggcctgtggactcagaccaggaagacacaggccagcccctgcctgtcccccttggcttgggctctcactgcccgacctggcgggaggttgcctagccgtgaaccttcgcaccctgtctgccaccggacaggctgtgagggggtgtctgcagcacctgcaccggcctgagcatcttcagagtgggctgcagctcctggaggggtctgagaggaagggaggcaggtattttgggcgaatgaggagacagctggagagctggcacccttcctggcctgcgtcctgtgaggactctggttggggacagcaagcttggggtcagcctggggcagagcctctgggacggccccgcccctcgtgccccttcccctcgcagctcctgtcctcgccccgccctcagctctccgccaggcaaggtttggcaagtgccgctgtgcggcagtgcctgctgattggctggtctgttgctatggtgctgcccaggggtgtgcttttcctcccctgccttccctgctatccctgggagtatctggggttgggtcatcgctggtgtgtgtgagtgtgtgtgtgtgtgtatgtgcacgtgtgcatatgtgtgcgcttctggcctctgcagctgagtcctggccctcggggggcctggcacctcctggggacaggcacaaagcagccatgatggagtcgggagctgggggaggccccattgccccacgtggctgccctgtgactctggggtgcttgttagaagaggtatctggttctgtctgtgtttaagcaactccctaaggaattcttgtggttccagtttggggggcctgtactgtagaggcaagggaggggcaggacatcccccagactctgacttctgaagccttttctgcccggggcctctccgccagtacaggcagtgtcctttgccagggctgccatgctgcagaggggagtgggccactgtttagcccaggaaaacctggctctcccttagctggaagttctgggcctgttgtggttggcagggaagctgagtgacggtgctaatcacaggggcacctgcaggggtttgtgggagatgcctctgtgggttggggcgataggctgaggggctgttcttccctgccctgaggagggctgagtgtagccgccactcctgtcctgtcttgggctgtctcggagaggatgcgtagaaccctcgggatcctgctggcctccgtctggtccaccctgaacctcaggccttctgggggcagaggaggattccctcaggatcactcgggtgggggcctctcttgggcacctgagaccctcagtgggtgctttgtggcgcgttcacggttggtgggggacgcccagccctgcccgccgtgtaggagccgttctgtcctgggcatccccctgtggtctgggacttagtggaccctgagggtgtgtgtttacccctgcctcacacctgcagaaaaaagcctggagcaggagctggccagccccatcctggacattgaggacttggtcaagagcggaagcaagcacaggtgagacccctcagtgaggccacgaccactgtccttccatggcccagctctcctgtgacctgtggaggcccggatatatttcttcacttttctttgttcctttttaaattatgaaactaaccaccattcagtacgaaaaagtttaagcagctctgaggaagatagagtaaaaaattgtctccctcttccctggccctcagccatccccggtggccaccgtggagtgtggacggagccctgcaggcctgtgtctgtgcggaagcacgcgcagttttgtctgcacagactgtcctgcagttggctgttttcactcagcgttgtgggtatagcttcccatgctggtgctggcagctcggccttgttcttttgaggacagcagatgtctcctatgtctacctcttacagcttcagagattcaagttataataaagctcttcttatattgagggggaaacctccctcccccttttttttgaaacagggtctcgctctgctacccaggctgcagtgcagtgtcacagtcttggctcactgcagcctcagcctcccaggctcaagcgattttcccacctcagcctcccaagtagccgggactgcaggcacacaccaccatgcctggttaatttttgtattttttgtacagacagggtctcactctgttgctcaggccagtctcctgagctcgagagttccacctgccttggcctcccaaagtgctgggattacaggcgtgagaccccatgcctggccagctctttttttttttttttttttttttgagacggagtctcgctctgtcgcccaggctggagtgcagtggtgcgatctcggctcactgcaagctccgcctcccgagttcacgccattctcctgcctcagcctcccgagtagctgggactacaggtgcccgccaccacgtctggctaattttctgtatttttagtagagacggggtttcaccgtgttagccaggatggtctcgatcttctgaccttgtgatccgcccacctcggcctcccaaagtgctgggattacaggagtgagccaccgcgcccggcccagctctgctttttcttagtggttctgcgttgtgtttgtttctatccaggaatagggttggttttacttttccatcgagtttttaaagagacgacgatttacatggtcggaaactcacgaggactccccatcccttggtcggaaactcacatggactccccatcccttggtcagaaactcacgtggactcccatccatcccaggcagcagcttcccacctgggccctacgtgcaggatgagggctccttccgggtcagaagacatggcggcctcggggcaccgtcccctgcatggggtgctcacaggatcttctcctctctccttcccagggtgtgcccttactacctgtcccggaacctgaagcagcaagccgacatcatattcatgccgtacaattacttgttggatgccaaggtgggggctcagtcctgtagctgacgactcctgatgtccaggggtgtccctgggcttgggaacagctgtccgagcctttgctgcttcagggccttagatcagcaggcctgggtgggaggactcacctctgtcactgggcaggggctcaacctggccagacacacttgtgagcagccccaggccacaggtcagttttctgagcagtctgggagcgggcaggctggtgggagtgaggagagacctccaggctgtggtccataggccagtgcccgctcttgatcctgacagctcaggttctctccttcacgtcaggccatgggaggcaccgagaacacaggaagcccactgactcccctcttcccagcgcgtgcccggccccacactcactccccctcccagcatgtgcccggcttcacactcactcccctcttcccagtgcatgcccggccccacactcactccccccacagcatgtgcccggcctgacactcactcccctcctcccagtgtgtgcccagccccactcccttccgccccgtgtgcccagccccacgctcactccccccgccagcatgtgcccggccccacactcaactcccctcctcccagtgtgtgcccggccctgctgccctcctccccatgtgccctgcttttgtgccccacactttttacttagtgcaggtgggatcacacgccacgggtcaatggtttgtgtgttcacgtgacgatggcgtggtgacgtttccagatcccgtcgttggttcgctcattctcggggtgtatatttattgagagctcatcatgctgggtgctattccaggcatagcaagactggcttcactcacatggagctttgattctagtggtggggacaggtggacagcaaaagagtaagcacgtgagctgatgatactgaagggaaatagagcagagggaggaggcggagaccgagccaagcgggcccaagtgcgatgtcggcgggaggtggggaatgctggtgggtctgaggggagcctcagcaggtgcagcagagcaagggaagaggtgagtgggggcggctggggggccgactcctgggaagctgtagcagaaccccacagagagctggtgaggtttgccgtggttgtgggtgactcggtgctttgagccctggctgcccctgggaaccatctggagagcttctaacccaaccaggcccctccctgggacagttatatcacagctggtaagccgagtctaacactttcacggaaacgcagaagatctaaaacagcaagatgaccgtgaagaagaacagagctggaggactcacctcgctggtttcaagactcctctaaagctgcaggagtggaggtggagatggcccagctcaggcacaggcctgcaggccatggagaaggcagcaagctcaagctgacccacacgcatgtggtcattgttttttttttcagttggaatctcactctgtcacccaggttggagtgcagtggcaccatctcggctcactgcagcccccgcccctaggttctagcgattctcccacatcagcctcccgagtagctgggattacaggcgtgcgccaccatgcctggcccttggtgattgttttttgacaaacatgccaatttaattgagagaggaaatgaaggttgatttctggttttctgaaaaaatggtgctaagaacagctggatatctgttcggaaaacagtgaatcttaactcttgttttaccctgtataaacctaaatgtaaaagctaaactaaaagttatagaaaggaacatgggggaggtctttgcaactttggggtaggcagagatttcttagtatggatacacaaggcactagccatgaagaaaaacattaaaatttagacttcaccaaaatttaaagcttcaactctgtggaagagttgagaaaatgaaaaagcagttaaagaaagggagaaaatacttctttcaaaggacttaaaaaattttttcagccctcctctgatttgaaaggacctttgaccagagtatgtaaaattctcccataactaagcaaacaacccacttaaccactgggaagggatctggacagacgtttcaccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcaccaaggtggatggaatgaccagttgagcacatggaaagtcgcccagcatctccagtcataggagaaggcagattaaagccacggggagccgacactgtggtcccactggcatggctgaaattcagaagccctgagtgtggcatgaggatgtggaacagctggatctcatccatcgctgtgaagttgtgtagccactccacaaacgtgtggcaaacagccgagccgggagaagggaagacgtgttcaaagattcatatgtggccaggctcagtggctcacgcctgtaatcccagaactttaggggccaaggctgggggatcgcttaagcccaggagtttgagaccagcctaggcaacatagggagaccccatctcaaaaaaaaaaaaaaagaaaaaagaaaagacttcagtgtgcaggtttaccagagttttgtttgcagttgccaaaactgggaagcagcccgcgtgagcccatccacaggtgaatggacagaccgtggtacccgaacactaacagcagccacgggcgtggactgtggtcacacagcagcagggagccgatgagtctcggacatgctaacccagagaggcccattgaggaggacctactgttttttgtgtttttgttttttgttttgaaatggagtctcgctctgtggtgcaggctggagtgcagtggtgtggtcttggctcactgcagcttccgcctcttgggttcaaacagttctcctgcctcagccttccgagtagctgggactacaggcacccgccaccacacccggctaatttttgtattttcagtagagacggcagttcgccatgttggccaggctggtcccaaactcctgaccttgtcatccactcactttggcctcccaaagtgctgaggttgcaggcatgaaccaccgcacccggctggacctactgttttattccatttatgtgacactctattaatagaaaaggcaggggtggggctggtggttatatggtgcacataactgccagaactcagtacacttaaaatgaacatcttaatgtgtgaaatttttttttttgagacggggtcttgctctgtcacccaggctagagtgcagtggtgcgatctccactcactgcaagctctgcctcctgggttcacgccattctcctgcctcagcctcccgagtagctgggactacaggcgcccgccaccacgcctggctaattttttttttttttttgtatttttagtagagacggggtttcacagtgttcgccaggctggtctcgatctcctgacctcgtgatccgcctgcctcggcctccgaaagtgctgggcttgcaggcgtgagccaccatgcccggccaatgtgtgaaaatttaaaagtaccaaagctggaccccaccccagattgctcccatgacactctgtgggtgggacctgggagttgggttttgttttgttttgttttgtttttgagatgaagtctcactctgtcgcctaggctggagtgcagtgacacaatctcggctcacattaacctctgcctcccagatgaaagcgattctcctgcctcagccttctgagtagctgggattacaggcacacaccaccaccccctgctaatttttgtatttttagtagagacggggttttaccatgttggccaggctggtcttgaactcctgacctcgtgatccgcccgcctcggcctcccaaagtgctgggattacaggcgtgagccaccgcgcctggctgggagttgggtttgtaaatctccctgagtggggctggggcagggaactgctgggtctgggtcttcctggctcctctggtctgtggcttcctgactgcggtggccgggggctcccagggcatcgtggccgtctgtcttgctgagcgtggcacgtgcctttccatgctgtggaggagcgtctcccggtatggcgaactgctggttagggtggggcggtgttgccaggtcatccaggtctggcctctgctctcgacatcgccggcgctgttgctcatctgcgcttgtgatgttcgatgcctgctgcacatgtcttggcttccctctttcccggcctctgtgagctccagcgctgcgtcccttctcttcctcctgtagagccgcagagcacacaacattgacctgaaggggacagtcgtgatctttgacgaagctcacaacgtggtgagtctccgctggcctcctaaacacctcctattgcttctggcctttttgtcaagagccacgcaaacctttctggaggggctctggccaaactcctgaagccctaggtgcccaggactggggactgagcacaccaggagcttctgccaccccctcccgccctgatccgatgcctctgctggggctggagactggccagctgggccagggacctgcccgtcaggcgcagggcccccacaggccgctcaccagaccctttccctccagccagctcggggtcagcctgggccagggctgtctcctctgccctcggcagcagcaggcttgtggtcttgcctgcagtgtctctgcccttccggccacatggcttgagactgaggcaggagaatcgcttgaaccttggaggcagaggctgcagtgagccaggatcacaccactgcattccagcctgggtgacaaagcgggattctgtgtcaaaaaaaaaaatgttgactgggcgcgctagctcatgcctataatcccagcactttgggaggctgaggtgggcggatcacgaggtcaagagatcaagaccatcctggccaacatagtgaaacaccgtctctactaaaaatacaaaaaaattagctgggcgtggtggcgtgtgcctatagtcccagctactcaggaggctgaggcaggagaatcactcgaacccaggaggtagaggttgcaatgagccaagatcacaccactgtactccagcctggtgacagagcaagactccgtctcaaaaaaaataaaatcaaaaagaataattggcaattccagtgaaataattgtttgtttgtttgttgagacagggtctccttctgtcgtccaggctggagttcagtggtatgatcttggcccactgcaacctccacctcctgggctcaagccatcctcccacctcagcctcccgagtagccgggactacaggtgcacaccaccacgcccggctaatttttgtattttttgtagaggcggggtttcccagcgttgcccaggctggtcttgaacccctgagctcaagtgatctgcccaccttggcctcccaaagtgctgggattacaggtgtgagccaccgcgcccggcctgaaacaatcgtttctaaatattggtgtgggccacacagtcatgtttggacctacttgtggccttttacagaccccaggccaaggctttgggaacttggctgtcagcctcctgtgccttctgcacccccaccccatttctgctttctggaacccccgatcctgtcctgttctgtggtgattcgggtgtgcttgggctctaggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccaggtgcgttcatagccagactgcttggtcctgaggcctgcgctgctgcagggtgagccccacccggagttcagcacggactcccccagcccaggtgcgttcatagccaggctgcttggtcctgaggcccgtgctactgcagtgggcagcctgccctgtggctgtgtgtggtcggcctgggcaccatctattcaggctggcactgcagggcatccgcttctctcagaggcttcttgggtgtgaattcttcagggtcctgtagcctgtggaagggctggtattgttcagtagttctggtattttccaaagacctatgtcttctcccagccagtatcaacttggcctctactgtgtaaaactggaaaactctactttgtgaagctgagttgggagcatcgcttgaggccaggagtttgagaccagcctgggcaacatggcggaacctcgcccctgccaaaaaattagccaggtgtggtggtgtgctcctgtggtccaagcttttccggaggccgaagtgggaggcgtgcttgagcctgggaggcagagcttccggtgccccagatgactccactgcactccagcctgggcggcagagtgaggccatctcaaaaaaaaaaaaaaggaaaactaaatatattcactgtaagggcattttgcatctttaaatgacccacaaatctggcatgcatcagctgctctgcctgtaggttccttcccagtgtttgtccagaggtgtatttccacacagcgctagtcacggcatacgtggaaaacgtggaaacccttcatggatgttgtcagttggtctatattttctttcttttttttttttttgagatggagtttcacttttgttgcccaggctggagtgcaatggcgcgatcttggctcactgcaacctccgcctcctgggttcaagcaattctcctgcctcagcctcccaagtagctgggatcacaggcgtgcaccaccacgcccagctaattttgtatttttagtagagatggtttctccgtgttggccaggctggtctcgaactcctgacctcacgtgatccacccgcttcggcctcccaaagtgctgggattacaggcgtgagccgccacgcccggcctttgtccatattttctacatggcttctgtaaacagctgactaggagtctgtgtgaatatcttcataggttctgctgtgacactacttgctcgtgagcatctccaggtgtaaacagcatcagcttcccccattttcctttaaaatcgcacatgtggacggacaccacggggaccctggaccctggggagccccgtcctcacccttctcaccaggatggctgcttggtagagagtgagtttgcaaagttggcatttgtttagtacagaagttatcaggtgttctggctttagaatccctttatatatatatatatatacatatatttaagtgacagggtctcactctgttgcccaggctggaatgtggtggtacaatcaaagttccctgtagcctcggcctcctgggctcatgggatcttcccgtctcagcgtcttaaagcgccgggaccacaggtgtgcaccactgccaccggctctcaagattgccacgcagggagttgcagtgggggaaggggttcctgggactttgaacgctccacctccctcctctccacagtcccccaaccccacctctctaacggggtggacggccgcctctttccatccttcgcttggcgcagggtggggagagtgacaggtctccttccctcatctcggcagctgccatttcatcgcttacataacgtgggagaaacatccacccacccccaggcctgtgtgaacatcaccacggggccttctccactcttcagttttgttagttacttgatgtgcagggctttttgttgtaactagtgggggacgtgtggtggggtgggcttctgccatctcattcaggaccagaacttcagttttcatccctatctgttcccccacccctttggagatggggtctcactctgtcacccaggctggagagcggtggtgccatcacggctcactgcagcctccacctcctgcagcctccacctcttgggctcaagtgatcctcctgcctcggcctcccaagctcctgggactacaggcgtgtgccactgtgcttggcagggtccattcttttcctcacactttatttattgaagagcccaggccgtttaccctgcagagtcggaatctgtacaggaggggcagccacacgagttccccggtttactctgaacttaggtggcttgagggccccagttagactgcggccaccgtttgccgggctccagatgggacgtcctttctatcagaaggctcacagtatctcctttcccgtttcttcccatgtgaacattgttgctgctgaacacctgaatatgttaatcactgggggcttgcaagatggcagtgtgctaattccatcatctagtcagttagcaggaataacttaggaccacgccctgcaccatatcagctatgtggtgatcccattcacacaggaaaggtgggacaaatgctgggggtgggccgggtgtgctgtctcacacctgtcatcccagcactttgggaggcccaggcaggcggatcacgaggtcagagattgagaccatcctggccaacacggtgaaaccccgtctctactaaaaatacaaaaaaattagccaggtgtggtggtgcatgcttgtaatcccagctacttgggaggctgaggcaggagaatcacttgaacccaggaggcggaggttgcagtgagccgagatcgcaccattgcactccagcctggcgacagagcgagactccgtctcaaaaatcaatcagtcaatcaagtgtcatcactgaatgtttgtgtgtgaacgtggggattggtcctgccccatgctccctcctgaatctcactcctgacctcagttgctgcaccttgaggtgttttcatgtgggctcttgtgtcctgaccccggcggttgtggcctctttgctgtctgggagtcaggatttttcacactcatgtcctgctccagacctggaatcagccaagtctccaagaagccctgctttcttttcctgcaagacggtatttcaagacccgccatgcggcagcgggttggtcatggttactgggttggtcgttgttactgggtgttttcgtggagatacagccatacgcacaggtgtgttcacaaatgttaattctaaaggtcaaacacccggccaggcataagggctcagcggtaatcccagcactttgggagaccaagactggtggatcacctgaggtcaggagtttaagaccagcctgagcaacagggtgaaaccccatctctactaaaaatgcgaaaattagccgggcatggtggcgcacacctatagtcccagctagtcgggagacagacacgagaattgcttgaacctgggacatggaggttgcagtgagcagagatggcgctgctgcacccctgcctgggtgacagagtgacaccctgtctcaaaaatgaatagataaataaagataaaacacctgctcctcttggtgtctccagtttggatttggcctgtgtagcctcttccttcgcctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccatgttggtggatttggcctgcatggattctgtgtggcctcttcctttccatgttggtgtccttttttccatgccaggaatcctggttctcaagggcggggttgttggcacgagcgtgatgcagactgcctttgctgcctttctcttgcccagggctgaacatggagctggaagacattgcaaagctgaagagtaagtgttgccctccccgcctccttgcagctgggtggggcctcctccttgcgaggaggtgggtgacacctcctcgacccacagtgatcctgctgcgcctggagggggccatcgatgctgttgagctgcctggagacgacagcggtgtcaccaagccagggaggtgagaggcggggagccagccccttcactgcaggcccagcctagagctagaaacgggccatggtgcagtcctgggctgtcacatcacgagtgaggcctgttttcaggcctgttttccctttttgagacctgggaggagcacctgctttgcatgatctggttgctgagatgttgagaggagcagcacacactcccacgggacagcacacagccccccacggaacggcacacacacccatggaacagcacacacactcccacgaacagcacacacactcccacgaacagcacacacactcccacggaacagcacacacacccacggaacggcacacacacccacggaacagcacacacactcccacggaacagcacacacacccacggaacggcacacactcccacggaacggcacactctcccacggaacagcacactctcccacggaacagcacacacactcccacggaacagcacacacacccacggaacggcacacactcccacggaacagcagactctcccacggaacagcacacacactcccacagacagcacacacacacccacggaacagcacactctcccacgcggggccgctgggtttcctgcagtttctcctcctccaggcctttccctggaccctggtccagtccgtcatttgagcacaggtgcctgttagaacgagaccttcttgttaggacgatgagtgtcccagccaccacctcttttggactccgggaggcctggaacgttctgaacgctccgtggggctccagtcttctccgcagccagggcagcagggtttgctgtctgtcctgcaggcagatgaggagtcagggctggggcctgtgtgggggctctcctgagcgcacagccgccgaggtggagcgtgttctgcctgagcgccgacctggtcgggggaatcccagttgcttccaggtggagccactgtcctcagcgtaatgctcaaggctctggcctggctcctcggccaccctgcaccctcagggtcccctcctgtagcttctgctgccccatcactgtcactctccaaagctttggggactctgcccagagccaccgcctcccagaagcccctgacaacctcttgacgaccccctagtgaccccatccctcccctctgacggcggcccctgctctgaggcggcttcttttcctcggtgctgttctcgtgctggccaggcctcctctccccacctggaggctcctgagggcggaggcctctcacctccaatgctggcgtcccctggagggctgaatttgtttccgagggaaggaaacttccacagttgttgccttcagttccaaagctgcagcctgatttccccctccaggctcgagcctgttttcttctcggcagctacatctttgaccagtgtcgtcccccctcaggcccgagcctgccttcttctcctcagttcccaaagctgcagtctggtccccccgccaggctcgagcctgccttcttctcctcggcagctacatctttgagctgtttgctgaagcccagatcacgtttcagaccaagggctgcatcctggactcgctggaccagatcatccagcacctggcaggacgtgagtgctggcacggggtctttggtgcgggcaaatgtggcgtagggggtgcagcaggcctccatcttggcagtcagggctcccctggccgtcacctggccgtcagcaggaacaggcccacagaacctcatcttctgatcggggcgtggaggcgttagtgccacttgccagctgccgtagagcctgtcccagttctgcagctggcggcttcgtcctacagcctcatcccattattctgcttttgagaaagagcagcccaaggccctagctggcttgtggggcctctggcttctccacaccaccccgagttctgcttctcagagttgtggggtccagaggctttgcccagaggcggtgtccccatgggctgctctggtttgagacgccgggcccagcggggtctctcctctgctgcgctcccgggtgctggggagggtggcttttgctgcttcaacccttaggcgaccatagagcctcttttcaagtcccactgacccccttggagactctgtccctgcctggcttctctcctggctgctgggaagagcaggcgaactgcccgccctgaatggatgctgcgctccaccctgggccccccattgggcaggagatggagcttggcagtcgggctgagcgggctcatgctggaagggccggggctggggtcggggcctcccctgcctgcagtgtgggtgtcagcgccctgctgccctccaggtgctggagtgttcaccaacacggccggactgcagaagctggcggacattatccaggtggggcctgctcctctgtggcatctccttccctgatggaagccgggcgggtgccttctcctgctgtattagttaactgattctagacttggggatgggagaaaggcccctacaccacctgtttctgattggcaaactctcggctcctttccagtgccctaaacccacactgggcctcctgcagggatgggggaggacgaggtctggtggcacatgcccagggtgatgctggtgagggaggacgcaaaggacagtgggggccggggagccgctcctgccctgtccgggccctcaggccaggggggacccactgctggcagccccagcagccccagctgcacgcagatgaagagctctggacacacgcggcttcctgaacagcttctccagggacagacaaatggggaccctgcaggttcccggcaggggtgtccctgggagcccatgattgggggtgcgaccctggcccccttctcattggccccgtcctgtcctgcaatgcccgtcccatgtgaggtctgcttctggctccatgcctatggcagcacctgctttccctggcgtagaggtgcttgtccggtttgtggagggcacgccccattttgggtgctctgggcacgttgcctctccggggcctcggtggcttttttagaagcagactcagaagtccctgactggggaagccaaggcacaggtggctgtgtggagccctgtgaggcctcctctgtgctgcccacgctgtacctgctggccacacgagatcatggcagggttaggcagggctgcccagcgctatgacagcttcatgagtgtccatctggcctgtggggtgcttgagctgggggaggccgcagaagaaccctgggatgcatggctggcctgtgcatgctgctgggcatggagctgcagatcccggaacaagcaggcactgccttctccttcacagacgcagctctgagcgggggcgagacctgggcagggaccaggtggggtgggcacagggtggtggggcccaggctcagccctccctccactgtggccgtctctgtggccagtgacgccacagcctgtgtcttctctgtgcggtagctggggctggaaggacagcactgccttgtcctcccaactcctccccaaaggcacggtgggcatcccaggcccagacccctctgtctgtggctcctgcctgccaagggctgctgtgctgtcccgcatggagtgtggttggctcttcaagcaggaggccgtgcacctatcaggcggacctgcttccatgtccctgatgggtcactgcaaagcacctccagcacatggccaggcgaggtagccctgcagcccagggcctggagggcaggtgtgagctggcccgggcctgtccctccctggaatacagcttcccaggctcccacttatggagaagtctcctccacactatggaactgaatcctagaatgtggcttctgaggttcctacactcgaactgaatcctggaatgcggcttccaaggcttccagctatggagaagactccacactctggaaccgaatcctggaacgcggcctcccaggcccccagctatggagaagactccacactctggaaccgaatcctggaacgcggcctcccaggcccccagctatggagaagactccacactctggaaccggatcctggaacgcggcctcccagcctcccacttaaggagaagtctccacactctggaaccggatcctggaacgtggcctcccaggcccccacttaaggagaagactccacactctggaaccgaatcctgcacactccatcggtttggaatttcctttggctgctgctctaagtagccgctggtggatgactcagcttctgccagccctcgggtgcctggaggatgagggactgcacacagtgctcacccgcgttggctcctgagcccctgcaggtgtgggcggtgcccatagggctggtgctgggttgggcctgcagccctgagtcacaggtgaccctgggggcagagtggggccagtggccccaggaagaggatgtgggatgcacagctcagctggaggcgaactccaggcagggtcaggccgtgtgctcggaagtcagggcttagctggaggcaaactctgggcagtgctggcccgtgttggggaaccagttgcccctgggcccccgtgagactgctgggtcctcatccctctctgcctgaggccggagctgccctgggctgaggcacagggggatttgtggtggtgtttttttgagaaagggtctcgctttgtcaccccggctggagtgcaggggcttgatcacagctcactgcagcctcaacctcctgggcccaagtgatcctcttgcctcagccacccgaggagctgtgaacacaggtgtgcaccaccgcactcagctaatttttaaaatttttttgtagagatgaggtcttgccatgtttcccaggctggtctcaaactcctgggctcaggcagtctgcccgccttggcctcccaaagtgctgggattacaggcaagagcttccatgcctgcccagcagaaggcttttcgaaggaagctgtttcctgaggcagactcagccctgctcatggcagccaccagcgtgggggtgaacttgttctgttacttccatccccgtgggccaaatgctttggtaaaacacaaggccctgtgtttagctgtcttgacagtgaaaatggctgggaaggaaggaaggaacggaaggaaatttctctctccttctgtgcgtacccaggcacgtgcacatgcatgcagagtacgcacacacgcacgcacgcctgcacaaatccacgcatgttgccaagtctctgtgttccagccgtggtgtctgccccccggtgttctctagttcggcttctccgcatttctgtgaatgattccggcttcttggtgttcccagcagaactccctcaagtctgcggcggggctctgacggcggtggcttggctgacatggccacattgctgagcctgttgggggctttgcgttcctgttctggccgtttttggctcgttttccaggaacggtcgtcacgcgctcctctcctagtgcaggcatcattcctttcccattgatttgcagggttctctgtaagttctgaggatcccatatacatatactctctgtaagttctgaggatcccatatacatattctctctctaagttctgaggatcccatatacatattctctctctaagttctgaggatcccatgccgacatacatattctttccttgtctcatgctggtcattttttccattttcatgacaggtttggtgaacacatgtttccttgtcagatttttgttctgagcttgtgcctcccgaccaagatgctaaaccgggtcttgtgtattctccaaactgcactgtagagtgacggagctttgtgtctgggcctccatgccttctgacgtcacctgtgggggtgtgaaaggcagactctaccttgatttttcccagcacgccacaccggtggttctgtgcgctgaccgagcggctcggcttcccccaactccactgggcacctgccacacttttcctcatgtttttgttcactgtggttttgtcgtaagtcctggtgttggcctgaaccaatttctttttgtttgtttttgagacagagttttgctcttgttgcccaggctggagtgcagtggcgcgatctcggctcactgcaagctccgcctcccgggttcacgccattctcctgcctcagcctcccaaatacctgggattataggcacctgccaccacgcctggctaattttttgtatttttagtagagacgaggtttcaccgtgttagccaggatggtctcgatctcctgacctcgtgatccgcctcccaaagtgctgggattacaggcatgagccaccgtgcccagcctgatatttttagtagaaatggggttttgccatgttggccaggctggtctcgaactcctgacctcaggtgatcctctcaccttggcctcccagagtgctgggattacgggtgtgagccaccacgcccggcctcttgttcttttgaaacctgccctgacgttttttccatagtgcatcttggagtcagcgtgtctacttcctgtaaaaatcttactgtgattttgactagaatgtgttgaattcctgttttttttttgagtcagggtctctctgttgcccaggctggagtgcagtgggaccatcacagctcactgcagcctcaacctcctgggctcaggggatcctctcagctcaacctcccaagtagctgggaccacaggcacatgccaccatgcccggctaggtttttttttttttttttttggtgaacaccctggggttgcaccatgttgcccaggctggtctcgaactcctgggttcgggcagtttgctcctctcagcctcccggagtgctgggattacaggcctgagccactgcactaggccatgttgaatttctagattaatttggggccctcaggggcacagagaggagggctgggccagttggcgggaggagaggcccctcgggctgccgcattttcagtgcatggagatggcctatgttgggggaacacagagctcaccgggggtccctgcagggaggagaaagggtcaggcaggtgccagctcctgtccattggcctggggctgcatgatggcaggggccggtgaaccgatgacccctgggtgtcctgtgaccttctgtgtatgcggctgatgctgcagaaagtcgggtggcctcaggctcctgacggggctgcacttcctctgcctttcagattgtgttcagtgtggacccctccgagggcagccctggttccccagcagggctgggggccttacagtcctataaggtaggggccacctccaggaggcaggtggagggcagcccttgttccccggcagggctgggggccttacagtcctataaggtgggggccacctccaggaggcaggtggggctgggggtcttctggtcctaaaaggtaaggggctgcccccaggacatgggcggggcctccacactcctggtcctgtcccctccaggtgcacatccatcctgatgctggtcaccggaggacggctcagcggtctgatgcctggagcaccactgcagccagaaagcgaggtacagacctgggcccacacgctccccgcccgcccgggtgcagtgcccggcaccaccatgccacaggctaggcacatgcccagccgtggatctcctgcccccatgggcctggccaccttctccatatccaggccaatccagagcattctcctcactgtccctctgaagattggagttactgagagacgtaggagatggcctgatggcaccgtgacctgcccagagtcacctggttggtggtggcagagccacagcccagccaggcctccctgctgggacacgctcgtttatgccgaggccgtcagcacagagcctccacagtgaggcacggctctgcctgctgcctccacgcagcgcctggccgggccaagcctcagggtcacatctgaagggggcccggctggccctgttgtccgaagcccctggtgcgctcagccccgaggccccacgtgccttcttggcttcctgtgctccgtggcgtcttcgagtcggtgctgccggggacgctgtgtggatggggtctgtgagtgtgccctcggctccgtgtccggagccctgtggttcttggggtgtatctggccccacccccactgcgtggtgtccagggtggggcttcacggctgcagctgcgggagctgctgcccctgccttgtgctccagtggggccttgcctctgggcttggttcgtccctctctggaacattctttctcagctgctgtccgacccatggtggcatgacgtggccctggctgaagcagcccttgtgcggttgctgtggttgggtctgcctggccgagccggaagggaagggctgggagggcgtcagggtggcgtggcttgacccccgctcggtgatggtcctgcagcaaggcctctcccagcaggaagcgtccatcccggggggaggccggcgcccctcacgcagttggggttgcgggaggcagtgcgtgcctgaggcagccggtgcacagattccaagggcctggaatctgtttgttccattgacctctgatgtcacttgacttctcagaagcagccactccctgcactgggcgtttgtaggaaatgagctcctggaggagggggtggggaagttcccccattgcagggcacactcagccccaggaaggaaacgtgcctcgtccctgctgactccgaatcgcagtcagagtcgttctgcttgtgccgtgttgaattcccggcatccggcatccagactcagcctcctccccaggccacggccgccgtggccagtcggtcaagcccttctaggaacttcctttgagctggcgcccttgttcactgctgacgccactcagaggcttgtgcacgtgtcctgcttccaggcagagctgggaactcgcaccccgtcttctgcacgcggccgtggaatgtcgggatgccggcgcttccttcccgtgtgctcttggcggggtgggcttcttgccctgagccgcatgtcacagtttctgcagaagtttagggttggagtgggctgacctctctgcaggtgtccccagcctctgcctggggtctgcctcctactcccaggaccccctgtcccccagaggggccccaagctggcaggctcacactcagggcagcctcctttgttctgacttctgcacagtgggcctgggtggctgcccgcggctcgcttgcttgatgccagtgggtggagagggtgatgggcagagaggcaggtggtcaggcccccagtcccgtcctcacactctgtgccctctgccgccccccgccccacagggaaggtgctgagctactggtgcttcagtcccggccacagcatgcacgagctggtccgccagggcgtccgctccctcatccttaccagcggcacgctggccccggtgtcctcctttgctctggagatgcagatgtacgggccacccctgccagggcctgagcaccggtgacacctctgacatcagcggggtggaagtggtgggggtccccatgagccgggtgctgggggtctcgggcctcgagggctaaaggggtgctggtgcacttccccactgtctgctccctctggccacgctcagccctttcccagtctgcctggagaacccacacatcatcgacaagcaccagatctgggtgggggtcgtccccagaggccccgatggagcccagttgagctccgcgtttgacagacggtgagggcctgtccctgggccctgctggggtgggaggtgggggagcactgaggcctgaggtcctgagcagtggcctctccggctctaggttttccgaggagtgcttatcctccctggggaaggctctgggtgagtgccctgaatgccccagctgtgcccatcctggatcctggacccctgctcccaagagctggtagggaaccctgcagacatcctgcccctgccttgaccccggcccctgcacttccaggcaacatcgcccgcgtggtgccctatgggctcctgatcttcttcccttcctatcctgtcatggagaagagcctggagttctggcgggtgcgtctcccctgtgttctgggcggggtgggtgagggcagggctggagcatgaagcaggcagtggtcacagctcctgcttgccctcatcggatcggcggcgtgaccagggctgccgtgtccctgcctcttcctcccacaggcccgcgacttggccaggaagatggaggcgctgaagccgctgtttgtggagcccaggagcaaaggcagcttctccgaggtcggcacttggccggggctctgggcctgctgccccctcgtgcctcccctgcctctcacagcttccccaaggctgaccactggccctgaccatgggctccggcggctcccgctgcctcttcagggctcctgcgtttccttcctggccctgagtgttgcctcttatcttacaaagcccccagcaccgggtgggtgtggtaacagtggccctcctgtctgagtagccctagtcggccaccctggccctggggttccccgtgttttctgggaagcactgagcaggcgtggggtcagcctgggatccgtgccaggaagaagcttccagaacccgattggccttcctggctaggacgatccttcatcttggagcatgagacctgggtctccctcatgggggaggaaggggctgggggggggctccaggctcagcctcaccaactttccttccagaccatcagtgcttactatgcaagggttgccgcccctgggtccaccggcgccaccttcctggcggtctgccggggcaaggtgagctctccagggccctctgccctgacctggttgcctgttccctggtgggtgcttatggctccccagcagactctgggccctgggggctgcccggtcccctccttgggtcccacgagagcgactgctggccctgctgggagcgtgtcctgctctgggcctgggcaggcaggatgggagtttcctggccacaagagttggaggtggcgtctgggagctgtggaccccaagtggggtcctgacccacagatggagcttcctcccacccctggttggggacggagcctcggggaaggtggctgggctgggtgtgggcaccagggagaggagcccccacggccccaggcagctccctggtgtgtcccctaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatggttctgcagatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcaggtgcggacgggcagcgctgggtgggcggtgtgggggtggcggagcgggcggcgtggggcgggcagcaccaggcgcccagggcggaggcgactcacctggctttgtgcgcttcccctcccacctccaaaggctgcctctccctcctagggcagggcccccacgggctgcaaccctcccctacaggcagagaacgccccaggcaaggatgccccccgaggctgagactccccccaatagcagggaggacacccacaggcaggaccccaagtgctgggactctcccccaagaggggctttgccacaggcagggaccccagctggggccccccgtgggcttcactgcgcactcgggtgcccctgcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggtacagttccagggccttgggatggacacagaccctctgtctcctgaggccaacccgaccccgcccatctggcctcaggcacctccccacacacccctgtaaatcccctgcctggcaggcaggcgggcaagcgggcgggggatcccagctgcctggctgtctgtgggtcctccaccccacctcacccacaggctgctggctcccaggtggtgcatgccctggccctccgcgggtgccccccacatcactttggttctctggcgggtcagcttggctcagtgcactcaaggtcgggtgcccctgccactggctgcgcttgaggctggcctttctccaggaatgtgctgcgggtggaacccaggttccttcttccttggggccttttgccccagaagcccataattcctcaggccaacccgaaattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggaccaagttgtggcactgtcaccggggtgtgctgtgcccccctcccccgacctccatcttggctcagggctccttgggaccatcttccctgtgcgtccaggtgctttgggaccccagagtgtgtggttggggtctgtgtgtggttgtgagctgtgtcctcctcaggcccacagctgctccaccctgtccctcctgtctgagaagaggccggcagaagaaccgcgaggagggaggaagaagatccggctggtcagccacccggtgcgtgagctgtccctgcacctgtgccgaccaccatagacacgcatgggaacgcagccgtgggtgcccccagccacggctggtcccgatgggaccagggaatccacccccaggagctgatgtccagggcagctgtgatgctgacggccaggggctcaagtgtgtggtttcttctgcagggggctcatgagtcccagctggaatcaggccccacccttgggcaggtttggcatggggcctgcagcactgggcttggccctggcatttccctcaagtgtggatgcacacctgcctcatgtgagggacacagcccattcctagccttggatcaaagaacggagttatagccggagccaggaagccccctgcctgctggaaaaccccaagtgtggcggcctttgtccatgtcccttggcttctgggaagaactgggtggtgcccaggcagggctggtgccatcaggaagtgggtggctgctgaggggcctgggctggcgagggcctgggtggggagtgcctgggccgcccctgccttggtttccacgtttccgtgttggtctggggtgtgtagagagatgggcactgctcatccggaagcccctccttgtgcgctgccatcctgggagcctcagccgcatccgctgtggggcagggggcttgagggaggaggagagagacgggccatgcaggacccctggcttgaggcagagccaatctaccctttgcccattcactgctctcagttccctgccagcctctcactgtgtgacctcagacgggcccagccccacagctttcttcccgcagcccctccctatgtccatccagccagccagtttctcaggcagcagccccacctcggcagtcactgtcccagggaacgctcaatgttccaaggaaggctctgcagccccagggaccagatgatgaggctggccctgatggagcctcgggcctgtgtcctgcaggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggtgccctggcttgcagaggccacccaccctgagggcagtgctgccgccgcgtgtggggtgggggccatctgggtccaaggtggtctctgttctctagagaaaaaggggcagatggggacagacgccccttcctctacaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggtaaatggggccccaggtgggaccctcagactcctgcgtggaaggcagtgtgggccagagtcctgggctgcttggggtgggcatcctcgggccctgcttggccccgcctctctgttcccctatgggagtgatgggggcctccacctccaccaccagcaccagcagcaccacctccacctccacctccacctccacctccaccaccacctccacctccaccaccacctcctccaccaccaccacctccaccaccaccaccaccaccaccacctccacctccaccacctccacctccaccaccaccacctccacctccaccaccaccacctccacctccaccaccacctccaccaccaccacctccacctccaccaccacctccaccaccaccaccaccaccaccaccaccaccaccaccacctccaccaccaccacctgcaccaccacctccacctccaccaccaccaccacctccacctccaccagcagcagcatcacttgttggggagaccctgtgcaactccatgcacagccctgtccctgccatagccccgacccctaagcacagccctgtccaactgccacacgtcccctgcctcccatgcatggtcctggggggtcaactgcacacgccagggtcctagggtcctagacccctgtcctccctgtttctgcctctgtttggggtggagtccaagtctccagaggcggaagcatctgtgttcgtgtgttaatgaacagcccctacagagttcccctagttcacccaggggggaacctagcctgttgggacgaccccagatcccttctgggcttggtactcactgggatatcctcatgcctgcacccagcctacggctctgagctcctgagtggggctttggcctgcccgccactgttccagcccccatccagcaggctggtgtctcctctgatgcccccagcacccaggcgtgtacctgcctgggttttcccgccctggtctgaggtgggtgaggcctggcctccctagccagccctgcccccccaccccagggaactttccagatgctctcgaccagctttgtggctctacatctcttcatcaggaagaacggcgccggatcccaagctgaccgtgtccacggctgcagcccagcagctggacccccaagagcacctgaaccagggcaggccccacctgtcgcccaggccacccccaacaggtagctgactcctgaaccgtgtgcagcctacgacttggtgggtccctcagtggcttcacgaggctaactcttgagtgtggccggggctgcccctgtggggagccatctcatggtggggactgctcccggttctgcaccccgcagttgtcctgagcagctctccaggagttcctggaggaagggcgggcagggcggtgggactctcagtcctccaccccagcgccactctgagccatgctactcccacaccaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacagcaagtggccctggcgtggggaacagccggtggggtggggggcaggggacaaaatgggggctgtgccgggtctgattgaagctccccgcagggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggtagggcacctgcctggctgctcctggcagcgccccaaccgcacgcagccctgggagtgagcagcaaagccccaggcccccctcagactcaagtctctgtctccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggttggtgcctggccactacagttcctgctgggtgtagccccaggtgatgggctgagggggaaagggcaggcccttgtcctggtggcaacgcctggcagacgtgtgcagtgggccggttgtctcacaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggtgagagctgggcgaggggaggggcccccaggagtggtggccggaggtgtggcaggggtcaggttgctggtcccagccttgcaccctgagctaggacaccagttcccctgaccctgttcttccctcctggctgcaggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggtgagccagaggcctgagggggcagcacactgcaggccaggcccacttgtgccctcactcctgcccctgcacgtgcatctagcctgaggcatgccagctggctctgggaaggggccacagtggatttgaggggtcaggggtccctccactagatccccaccaagtctgccctctcaggggtggctgagaatttggatctgagccagggcacagcctcccctggggagctctgggaaagtgggcagcaatctcctaactgcccgaggggaaggtggctggctcctctgacacggggaaaccgaggcctgatggtaactctcctaactgcctgagaggaaggtggctgcctcctctgacatggggaaaccgaggcccaatgttaaccactgttgagaagtcacagggggaagtgacccccttaacatcaagtcaggtccggtccatctgcaggtcccaactcgccccttccgatggcccaggagccccaagcccttgcctgggcccccttgcctcttgcagccaaggtccgagtggccgctcctgccccctaggcctttgctccagctctctgaccgaaggctcctgccccttctccagtccccatcgttgcactgccctctccagcacggctcactgcacagggatttctctctcctgcaaaccccccgagtggggcccagaaagcagggtacctggcagcccccgccagtgtgtgtgggtgaaatgatcggaccgctgcctccccaccccactgcaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgc

SEQ ID NO: 1966 - DNA, 16106 bp, Homo sapiens
  source 1..16106: mol_type = genomic DNA
ttggttaaaacacctttaatgatagagggaaagacactaatatctcccgtctgttcttgacattttactaggttaggaagctctggagcctacagcttgaggagaagccatcgttcaagtcagtcaatagcaaaaccctcactctctcctcctcagaactcctgttccaaatgatcctatgttaagagtaaatactacaactcattacaagacggagaggcagggaggacgccacctggagctgggactcttaagaaccagacaatgacaaagacacaagccccagcctacggataggcaaaatgggtaggggtcttgaaagaggaagataaggaaaatacaaggggccagggaataaaggagggagttatctaaaactagaagcatactagtgctaggaaatcccccatgatccctggtacacctctgcacactatgtcactattagcccaaaagaatattaacgagaatgtccacattcacaagaatttgaggccttttcccttacatcatgtccctttcttagtcacataggtaccagcaagccctatgttctagcaacattccttaactctctcatcattagttcatcaaccatgctgaccaaaaatgctccttaaagatacgaacttcacatttcccaaatatctcctgggagacctcttggcaagaaatcagcttgtttcccaactttgagaggtcatcatgaatgagaagctggagaggtcttggcacactgaccagccaaaacctttaccttaatgtgaccatcaggggatttactgggaaaattttcctatgcccttccttcatttctccctacttcctagggttgggtcaccaattactggagcatcttcagtaccggcaccttctggagcagggggaggaagaaggaatgtacagtttgctacttcttgtctatgatgggcttctcaggcactgccttgggtgcaggaggctgaaataggaggggggctgtcttctccttggcttccctggatcccattgttggaggcaccttcccagccacagttcctaggccaaacagcactggtggggccaggcttggagtggtagtggaggtggagctggaattccagggcttcatgggcaggccatttgacaggaatgccacatactggttctagaaagataggggacccatacccaccagctgagcagaaaggtcaccccagaggagtggcactgggccctccagagacagctgccagccctttttggctaggctgcaatgccaaatgtaggtgctcaggtgcacctaccaaagggaaagggagaggagagaggagggggaagaagggtcacaccagggaagctggagagggttccccttgagaaagctgcagagaatctatgttcctcaggtacaaagaatgaggagggaagaaaaattccttagggggccatccccttgtaagcacagtaatttccaagctcagggactacagaaaagccactagggacataacatgttaagaacttagagaaaaagacaaaatcagggctcataactctgggaggtccttttgtgaagctgtttctgctctgtgggacaaagagcagcaggtacagaaaaacaggctcatgggatcgtggggtcatcttttcggggaaagggggagagccctgtggaggtgatggaaggcgaacagccagggactagagaaagagcagcaatattctgagggccatggggggcaaagggctgtacctggtggtgtgccaggagcatatgcttcttgagggtagcccgctcaagaaagccctgcctgcagaaaacacaagtgaagagcggcccctccttggggtgggtcttctgatgctcctccagagctgcctgggagggaaaggcctggccacacacttcgcaggcctttctgctgctgctctctcctggctcctttctcattgcctcctgcaggctcagctcctctaccaaggtcacgctggtggcttccccttctggggtgagtgctgatgccggacttgagcttctctccggtttgcccccctcttccttgcctcctaaaacaccactgcttccctgctccattggctgaggctgatccaggctgtcaggtggtggtggtggtggcaaagaagactgttgagtagttttctcattactgtccatctccttcccagctgtggctgctgccgccactgtccccacctcctcctctgccccagatgcctcttctgaatcacctctcactgatattgccttctcacctccactctctgagcctctccctgccagggaatcttcatcagtcacatcttcctcttcttcctcatcctcctcttcctcctcctcagacaactcctcttccggtgatggctgctgggactgctgctgggggaaactccctgccccggagactgtagattgctcggagccattctcctgagcagctcctccaccttcagggagtgcagtaccaccgttggggatctggccccccaggtgcatccggacatgctgctgcagagtgacagcattggtgaacttcttctggcagatggggcaggaattctgtgcccgggcagctggactggccttgtggcccacgaaatgtgcacgcagattacccctggtggagaaggctctgccacacactttgcatttgaagggcctctcacctccatgttggccataatgaaggcgtagggcccgaggacagctaagcactcggagacagatgacacactggttaggtccagaagaggctgaggatgaaggtgcaggggcagaggtggtgggggctcctgaggcagctgaggtcaccgccacagctccttgccggtcaatcttttctaccagttgctgcagctttgatgtctcagagggtgaggcccccaagggctctagcacataggggaaggggaagctgccagtggacttgaagtggttggtaagcagtgcccagcttggtagtgaagtcaccaacttacttagttgcatgcgagttgccgtgctactttctgccactccactgatggctgagccctcactccctgggggggtgttttcatcagctttattcttgggttccactgctttcatgagcacaaacttattgaaagcagggagtcctggagccgtggctgtgcctgcactggtggagagcagagtcaggctctctgtggcactgagtgctgttgtggaggccaccagaggcttgcgctcaacccctccacctggagtggctgcctcctcctcggccttctctggtggcacggacataccataaggcaagccactgctggtaatgacatagtctaggtgctctggtactgggtgtgggttcatctgcacatgtgggtacttctcacgatgccggtggaaatgcactttgaggttgccacgggtggtaaaacggtttccacagacattgcacttatagggcctctcacccgtgtgggaacgaaggtggatctgcagggcactgtcactgccaaatactttggcacagaagcggcatttgtgccttccaccaggcttctccaagggacccatcacttctccgtagctcagctcaccacttccattctttggcttcaggagccctggggaggcagtggcctcaaggcctcgggctgccccaagacactgtgctgccagtagtcccgtggtgcttgggaatgccagatgaggcgaggcaatcagctgatctgtgctgcctggcaaggctggggaaggggcaggggtgggtttgtggcttcgcccaacccctccagcagagaaaggatgctgtgaccccagtgggtggtaaaggtggaagaaggcctgcttgggcgtttctgcccctgaagaggaagaggaggaggaggaggaagatgccagtgtcttgctggtttggacaggcttgatggggctgaagaggggtagtaggggcttggtggaagaggcagtccctgtcccaggtagctctgagggactggcaggggcacccaccgtctggcctaaggagccaagcaacagcacctgcctgcagatttgctcagtcatctgcatctgatggatctgccgctgctgcagcacccgtagctcttccaagatcagggggatattcaagtggccactgcctacccctgggggcggagggggtggtggaggaggagggggtgcaggggtcgattctggaggtaatggggttgctcccagcttgggactggccaagatcaggcccccgcctcccccagccgctgtacctgtggcagcgaccaggaaatgccctggagactcctctcctctcctctctgggccccaggtgggatccgtgggcacggaggacccagaatctggggggttgctatgctctgtgtccatgacctgaggattattgtgaccctcaggccggggttcagaggaggccgaagagttgttggggttctcctggcccccaattatcaccattacaggagggtcagtagaacatgcgttctggtgggcgaggaattcagttgggtcagtgaattgtgcgcagcacttggcacagacttgggggtgatcctcctcgctagcatcacctggggagaagacaaggagagagagcgtgggtggcgcagttgggttgggtataccgaggctctaattaacaaggaggccagtaaccgctagttgggggtggggagatgagctcaccatcagggccatgcagaagtctagagctcaggcctgatccgtgtggacaggagacaacccggcatggggcaggggggtggggagggaggaggggaggggggcaagagcatgctactcccctcctcagccaccctcccttccccaggccacaagcgagttcacggaataggtgtggggacaggggcctacgcagagaatcatgcattttctcccacccaccgaaagtcttcgccgcccctgcgcatccccctccgcccccacccctgcccagcccgaccgaccctaccgcacctccgagctctgccggctccccgcagggcaccccgagacgagagctcctctcggattcgtgcgccatggttgtgggggaagtggagggccaggtggggtgggagacaatggatattgggattgagggaggcgatggccgctgggtctgcggcagcctctgcacccagcggcccagactgcggagatggagatcggcagcggcgggggcagggagcagcggcggagggggaggggagcgaggaggcggggagaagctggagtgagaaagcggggagaggggagatctgggaggagctgatgaggaggggagtttatggggaggagctgctggggagggaggcgggagctagaggaggcgggagaagggagcgctagcgggggcgtgggggcgggagctcagagctcgggagagtttccggaggcgcagtgacaggtgctgtgaagcactgcgggggtccacctttcccggtccctggccagctccccccatctgcagatgcctttgcccaggcctaccctcctccccccgccctcccctcctaagctctaggggcacagtgggaaacgtagccctgctcagtggagcaaggcgataggcttctcttatttttctttggataaaggatccgctgagcttggaaaaagtggattccagagagggtcgtctgatctcctcagaggtctgagggccagaagaagagggggagatcagaacatccactcctcaccagcacacacaccccaaaatattcgaagttttgtctcgtctttctcacttccattcccaccctacccccatccctctccacaaaagaagtttctcagggtgggcggctgcaaggtagaatttcccaggaagtcatttcaggactctctgcggaacactaagccccttcactccccgcccctcctccccctgaataatagctgaatgcaggttactccgcagatcgcccagcctacacaacacctaattcatagagtccatgcttatttaataagccatctcctatttagtaccctcttcctcctctattctcctcttgcaacattcctcacaccgtcactattaaagacagtgggtttggggagacgctagcctgcagaggcctacggaggcccacccagctctaacctgggggggaggggagccctcttgaaacaatgcggtaggaactaccaggcagccctcagtgtctaaagccctttcagccccagcctgatttgaatgcttagaaatagctaacacctgctcaccatcacagaggcagcctcctattcagacaggataagtaagaataaaatgcctcctggaccaggtattctggcattctcttttttaccttgaaatgagtcttaaagtgcttcccacttcctaaaatactttctcttacatgcaggaagtgaccacaagtccttggttttgtggtttccctgggcatcagtaaacctaaattgttttaatcccagttctattcttgcctcactgataaaactgagacatggtggtcagtcacaccatgttataccaccgtttccctcttcataaagtggtaatattgtagctgcagtattttactcagaaaaatattgtggggacaaaaaattgaaaaattggacaatattaatgtgtaaaccaggtatggtggtgcacacttgtagccccagctacttgggaggctgaggcaggagaattgctttagtccaggagtttgaggctgcagtgagctgtgatcacacctgtgaataaccactgccctccagcttcggcaacatagtgaggccccattactttaaaaaaaaaaaaaagccgggcgcggtggctcactgtaatcccagcactttgggaggtgggcagatcacgaggtcagaagttccagaccagcatggccaacatgttgaaaccccgtctctactaaaaatacaaaaattagctgggcatgatggtacacctttaatcccagctactggggcagctgagccaggagaatggcttgaacccaggaggtggaggttgcagggggctgagatcgtggcattgcactccagcctgggcaacaagagtgaaactgcgtctcaaaaaaaaaaaaaagtctaaaaaaattaatatgtacatgtgagatttttaaagtttggggagtcctgaatttaatcaatgagataatttacattgtcagtagcaaaataatcgaagtaaccttaaatacacatatactaaaattagatctgttttccatgttgtttgttaatcttattaatttctgaggtaagatattggctaatatcagcagcatatttcaaaggtaggaagtcttttattgcagtgggtgggggagctgaaacaacctatttaaaatattagtaacatccactttacttctcaacataaattttgcctgtgtttttaaacttaaaacagtttactgaattatgttttgaaacttcagataataaggctcttagcattgtgagtcataattctgaaatggacgggttctgtgcttccaggcctggacttacaaatgagggaggggggttctatttcagtttatggcaagtcacagttttgtgcaatgtggtttatttttacagataaggaaactgaagcttggagaggttaagtgacttttccaagttcacacagtaattcagtgaagcaagcattcagaattttgactcctgtccaatgctttctcaagcacatcaactttgtatggcttccctaatgctagagaaagggccctgtgtggcttctacctgccatttgctccctggccttagtcagggagagggaatcagatggaggctttctactgagcatttgttaattagcattgaacatttgatatccagttgctgttttgtcaagtcttctgacaagaaaagaaatccttttcttttcatcttctcctgggaaacactgtcccctttcttgctctttaatgaaatgtgctttctgatgcgtaatttgatctaagctcttctttaaggtaaatttagtccctggtgaaaggtgactggatcaacagccacctgtaagaggaaccctccatttctcagtactttgcactcactgcacatcctgaaaaggggggcaggattcttacacaaacatgaatgaagtcacaaatgcaggaataaactaaactggtaatggtgtccctagatagcagataaggtgaggtaagctatctccggtcaaatgcaaagtccggggtgggactaagacctggacaagcttgtttaaacttatagagagctgaaatgacaaagaaaagggaaaccaggtggcttcccttctaaatctagtgtcccatcagattgcttctttaggcttcagagagaactgttcgggagaacaaagagaaaaataggtgagttgtatgtagcagggtgatacatttgaacagcggttttcaaattttgctgcccattaggattaccagaagagagttttaaaatttttatgtttaggtgcagtggtctgttccttgtagtcccagctactctggaggctgaggcgggaggatcacttgagctcaagggtttgagactccatctcaaaatctcaaaaaaaagaagaaaaaaaaaagaaaagaaagtttaagcacagtgggtacctcatgcctataatcctagcacttttggaggccaaggcaggaggattgcttgaggccaggaatttgagaccagcctgcataacatagtgagacccccatctctgcaaaagcaaccaaccaaccaaacttaaaaaaaatccctgtgtccaggccacatcccaggctaattaattcataatccctgaggataggatccaggcattagtttgataaagctcctcaggtgattccaatgagaatacaaagatggtgacacaatgatgagacccacatggaggactgccctttccatcataccttccaccctgctcctcacagatcttacctgagctaaacttggccacaattgggacacagacaaaatgaactctcaatgctaaatcttcccatcaggtcccctccctacagtgcccacaaccacacattaacttccttgtatcctttcccagtgaaaaatctgcttccatgaatagaatttgatataatttacaccttactgtaagtttaagtgattgcatttctttcccaggtatgggtatcttgaagcatatttttttcttttttaattgatatttgagccatatttctttttttttctttctttttttttttttttttttttttgagacggagttttgctctcattgcccaggctggagtgcaatggcatgatctcggctcaccgcaacctccacctcccaggttcaagcgattctcctgcctcagccttcccaagtagctgggattacaggcatgtgccaccaagcccggctaattttgtatttttagtagagatggggtttctccatgtgggtcaggctggtctcaaactcccgacctcaggtgatctgccaacctcggcctcccaaagtgttgggattacaggcgtgagccatcgcgcccggccaccatatttctaattgtaaggtgaaaggctttgttctacagagttcaagcatcatccacccattaaggctggagtgaagtggcacaatcatagctcactgcagactctacctcccaggcttaggtgatcctcccacctcagcttcctgaatagctgggactacaggcatgcacaatcatgcccagctaattaaaatatttttttctgtagagatgaggtttcactatgttgcccaggctgtctggaatacctgggctcaagggatcctcctgccttgtccccacaaagtgctgagagtacagatgtaagccactgcctctggcccacttacttattattgacactgaacaatgctaattggtagcttccataattatgaattgattctgtaactattgctactgactacttcttagggaaatatctcatcttctcctccttactcctctttcctaaatgtagacacataataatcctttgcaacccagacctactaatgtaactatggcctatgtaacacagtagactaacaggcacaatgattggtacacctggtgctaagtgagaaaaagatatttgtttccagaacaggaatatcttagatcaaacataagaatgttcttttaatgaaaatttctttgacttcaaaggactcaacacttaacatggaattcataccattttggagctgggacttcagagatctgacactctcattgtcattgtgcacagtgattcagacctgagttaaagtcccagctctagaacattctaatatttgtgatcttgggaaaatttcttaatctctcccagagtttgttttcttatttttttttgggacagagtttcactcttgttgcccaggctggagtgcaatggcacgatcttagctcaccgcaacctccgcctcccaggttcaagcgattctcctgcctcaccctccctagtagctgggattacaggcatgtgccaccacgcccggctaattttgtatttttttagtagagacggggtttcttcatattgctcaggctggtctcaaactcccagcctcaggtgatctgcccacctcggcctcccaaagtgctggattacaggcatgagccaccgcgcctggccagccttttttttttttttgagacggagtctcgctctgtcgcccaggctggagtgcaatggtcgcccaggctggagtgcaatggtgtgatctcggctcactgcaatctccgcctcctgggttcaaacgattttcctgcctcagcctcccaagtagctgggattacaggtgtgcgccatcacacccagctaatttttgtatttttagtagagatgaggtttcaccttgttggccaggctggtcttgaactcctgacctcaagtgatttgcccacctcagcctcccaaagtgctgagattacaggcatgagctgctgtgcccggctgatttctcttctttaaaatgagggtactgccatacaaaggaaggaaattctgatacatgctacaacatgaatgaactttgtaaacattatgctttcagacaaatttgactttaattgagaaaaaaagagaaaacatactaagtgcaataaagcagacacaaaaggacaaatattgtatgattccattagtatgaggtacccaaacattatatgagtccattaatatgaaatttggcaaggtcacacatacagaaagcagagtagaggctaacagggctaagggaatgggagaatggggatttattgtttaacggttacagtttctgtttgatgatgaaaaagatattgaaacagcagtaatggttacataacatagtgaatgtacttaatgccactgaattgtacacttaaaaatggttaaaatggtaaattttattacacatattttacaataaaaaaattttagccaggtgtggtggcatgcacctgtaatcccagctgttcaggaggctgaggcaggagaatctcttgaaccctggaggtggaggtttcagtgagccgagacgtgccactgcactccagcctgggcaacagagtaggacttggtctcaaaaaaagaaaaaaattttttttgtaataataagggagttggggctgggcgtggtggctcacgcctgtaatcccagcactttgggaggccaaagtgggcggatcatgaagtcaggagatcgagaccatcctggctaacacagtgaaaccctgtctctactgaaaatataaaaaattagccaggtgtggtggcgggcgcctgtagtcccagctacttgggaggctgaggcaggagaatggtgtgaacccgggaggcggagctcgcagtgagccaagatcgcgccactgcaccccagcctgggcgacagagcgagactccgtctcaaaataataaaaataaataaataaataaataaaataataataataacggagttgggaggaaaaagaggaaatgcaaaaagggcctagcacagtacctgaatgctccacaaatattagccatgggtgttagttattatttgaatgtcaaaagctgaatgaagccctggggtaagaaaggtcacatgtgcccaaggtcacatagcttcaaggtccacactagattgaaaaccaagttttctgttttcttatctagtactctgtaacaccaggactgagatactctctattccaaaatgtgttttttctgatctgggaatacctaggttgagtggcccagggatcaataacctgagagatgaggctctttacttccaaatgtaaacagagcccccaaaactctacctttgccttctttcctctcttgctgttcttgctatctgccaacttccatctaaagtactcccctctctccctctagatctgtttggctgctgtcctggtttcttcttctcactaaatatctgggtttctgattgtttcctttatttcccagatgtactggtttgcatttttcccccagtcacatcctttgtgttctctaatccagatttctagactctgtaggggagagagaaggtttttttttttcctctctagagtttttaagtgaatagagtatttcctgcccatcacttatatgcaataactgttctgttaggttttgatgctctggttagggaagctgagcaaaaacggctggaaaacagatttttcagactgtttcttggtgatgtcttaggtcactgcagaattttggcttttaaaatatgtaacaaaggctcagcatttgcatgttgtatatggcacatattgcttacaagaaggcaaaagactcctggaaacattactggcaccctagactactgactaaatgtcttctgatactcatgatgatatccataatttcacaggtacaccaaaggatacatgtgcccctaaataagagcccttcctccctaactgtggagcatgctctggggtagaaggaagtcagatgcctgaagatcacataagtgaatagaaaccctgtctataaaaaattagggaaaaggagagctctcattctgttttgcagaatggatgctgccccattcatgattaagaaaatttattaatttaaaagaaaaccagaaaatgtgaaatttatatattataagcttataagatccaggaggaattttagatacgatcaaatagagccacctcattttgcagatgaggcccaatgacatccagatcataagtagcctaggatctttcactccaggggaattctgatgagaaaatccttaggctttcttacggtagatcttaacagagggtgctactgcttccttgctccttacatttgttcctgcctttcatagctcaaaggcaaattttcatcaaaaatttgttgatgccattgggtttaaacctttactgtttctatggggatggctttgtaacagcattaccatgcccccaggtggaagctatatcttaaagggcttgaaaatccattcaagacagccgctaaagatagcttttgactccctcacagaagatttttcctcagctatgatatggggaatgggtgagcagatgggagaagtaggaagaagaggagagaatgcttcttgggggtttggaggggtgttcagcatagttccacaatcaaaccagcaggagagcagaactgtgaggcaactctggggaggagttgaggctctaggggaagtctcctgtagagcacaagcaggaaacatccggcctatagcagcattaagaagggctaatgtgtctcaggagggaaggatgccatcaccatagaacctctaaatatgggcacagtaggatcccagaaaagcagtgtttcggggaggatgcgttctgcccaaaacatgtctgttaaggttattttgtagcacatggagcgctgatttgacctcaagtttttgttttttaacaggtggaaaggcaagtttaatctacaattttagtcgccaccaatacactctcttagagcttttcatgacacgtctcataaagaaatgctgatggccgggagcggtggctcacgcctgtaatcccagcactttgggaggccaaggcgggcagattacgagatcaggagatccagagcatcctggctaacacggtgaaaccccgtctctactaaaaatacaaaaaattagcccggcgtggtggcaggcgcctatagttccagctactcgggaggctgaggcaggagaatggcgtgaacctgggaggtggagcgggcagtgagccaagattgcaccactgcactccaacctgggcgacagagcgagactctctctcaaaaaaaaaaaaagaaaaaaagaaaaagaaaagaaaagaaaaaaaaagaaatgctgacgtttgccaagaggttcctgagttttggtcatactacagcacttgcaggcagtgtcactgcattcacatataatgataataacgatattcacacatattaagcacttatttatgctaggtatttttccaagggatttacacatattaactcatttagattttcacaacaacctaatgaggtagctagtatacacatctttatttcacagatgaggaaactgaagcatagagaggcaaaataaaccagccaaggtcacatagctaaccaagtggtggagctgggatttgtctaaaagtctggtttcagaacccttgtgcttaatcctatactatactgttgggtgtatcaactgtatgctaaacagttgcctgtctggagccaggacttccagactttcagtctgcacatatggagccataccactgacaagtatgtccaaaacttctttgatcctaagaattacctggacaattgcaaaatatatagattcccacaccctggctcagatgtactcacaatcaggcaagtttttaaaacccaggtttagtgggtttagtgagcactaccagccagccctgagcattaggaaattgaagtttttgtcctgattttgcttctgtctctcagactctgagcaatttcactcttcaattccctgcttgctctactgtctgcctgtcacttaacggaatgttacaagaatacatacaatttttccccctcataagggacacctgttgcttcaaaaacacggtatcctcataaaatgatatgcatgtagtaacaggtgtattttcttgcacttcttttgttttgttttgttttttgctttgctttccttgaagcacaaacctaagcccctcatccagacctagccttcagctgtcctccaggtgacacgcatacacaccccaaaccaggctgcattctgaccgaccttagctctctccctctgggagctctgatcggctctcagttcagcccaacaatgagaaacttttttctcgtctccctcaggggagccttcacgtttatccaattcattctcttgcaacccaactctccagaaagaaaaggggggaaaatcccaccccgaagagacggtcttcaggtctgaggacgttacttagcaacggcacaaagaccagtgagcaaagggagacctgaggagaaaactcttgggtggggagacagagccagtttgaaaactccatttcatccagagaaaaacaaggaaaacacaaacagaatcaatcccaagtaacaagcggggcttctccccagcgcaggtcatctcttactccctgcatctcaactccttcaaacccccagtgaccaagtccgcccccgcctggtttcgcccatggcccgagtgccctccccttgccctggcctgacccacacaggcttggacttaggggcccccacccctccccaggcacccaccgttctcagacgcgctgggaccttcgcagtccgagattaactgttggggtttccgctgctttcgccgagacattcccgggtagagagttgggagagggaggggcaacgctcacttggtcttaaccggggtgacctggtctcgtctcccccttgggtccgaagccaattgatgcctctcccccagcgcaaatcactgtgaagcagagatgttcttctttcccagagacacagactctctctctctctctgattctctgttcttgactctctctctttctctctcaatctttgcaagtctttaaaggggagacgccccctttttttcttcagcttcttccctacgcttctgcagctc

SEQ ID NO: 1967 - DNA, 60020 bp, Homo sapiens
  source 1..60020: mol_type = genomic DNA
actacaggcacacgccgccacgcctggctagtgtttgctcttaaatacacaaaatgcactgaaccagcaaaaacaaagtcccaggtctgaggagctctgaggatgatgcctgtgatggcctctggccagctctccaggatactgagagagcaggtcaggggaggccttctccaggctgggcagtgggaaggccctctggaccgggggagtgagtattcaggggacaaaggcactacccgggtctggagccgccacggagccagggcacagcctagtttgggggattcctctgtcactggggtaggatctcccaacaagaggcggctttatgttccactcacgaagaggccagagctctcagatcttccccaaaacctaatcaggcctctcaccagcgtgttggaggccactcctggccatcatctccaactctttaccccaacctggcaccttgtagggggctagaagggtgaggggaggtgtctttcacttatgcttaggtcactcttagaggactatcctcaaacttgaggtgacagggaactcttcacgggggcaggatttgatgttttgtttttagccatgtttgtcaatgacaatgtcaatttctagttccaatttgtacccttgtctcatttctacattaaaaacaaaaaacaatcatctgtcataaaagttcagagtaagctgggtgtggtggcacatgactttagtcccagctacttggggggctgaggcaggagggtcgcttgagcccaggaaagttcgagtccaagctgggcaacagagcaaaaccttgtctcttaaaaaagaaaaaaaatagagttcagaatagataaaagagttgttattctaagaaaatagactactgaaggagaaaggctttaataatattaaaaataggcaaggtaatgcttttcatagtatagtaagatttgcctaataccatcttatttctttgattaaaagttacttagcttcagcatgcgtgtacattcaaaatacaaaattaaagcatgagttgtcattaatttgcagaattctatgattgaagcctctaaatgaattgtgcaggagagggagtttgtaaacaactgactacagacattcacattgggtcatctttaaaaagctggactctgcttttggatgcttctcggaggcgagttggattttggactgaagtactgtcgttccattcctttttttgaggtgttatgagtggggctataacatcgccatcctattaggaagagagagaaaaacaggcaatagagaaaagccagtttccatcatcttatttctgagtgaaagtctcaagtgcgcacatcctcatcttgcatatagattgcttctagctgtcctcaatccagggaaactccaaattacatatgccctgtgcttggggcaaattagaaacactacagtcttacgcaggaagagccttcatgaaaacagccactggcctctgcagagatgactgggagcagcataccactgcccacctctatggcctccttcacacaccttcacggagcacaaactctgtcctgttttcccaggagaaagacgggatgcactgaacccctagcttctctctcgcctggtcccctctgcaataaaaggcccaggtctacaagatggcaaagaaggggaggaagaacagtatgtacctgcagaatttaaatttttctctgcatcaaagctctaacgttggtcccatcagcataggctccagccaaagaagctcctccacccaaaataagggagagatccaaagggaggcgatacaatgacgtgaaaccatagaggtaagaagcaaggcctcctaatacttgactctatgctaaactgttctgaacttgtgggtagatcttctttggttacaagatgatgcacgatcttggagagcctctgttgtaccaggaatacaatgctggtgggaggattcgtgctcctcatctgcttatttgctctcagatccattcttcactcttcctctccctactctgtctcacaggagctactccggtaaattacatttctcagctcccatgcctgttggtttccagttagatttggtcagtgggaggctctggtgggagactggaggtgagaagagggcagagaagtcaggttttttctctccctacctcctctggcacgagcggcagtggcagtgactattctgtggttctagcttttgcaggtggccccagctcctggactcccacctgctcccttggtctctcctatcctagaggtggtagcagcttcctgctgttgaatcactgtcctctatgctcatttagctctgccaaaacttttgtatctcacccccatgttaaattttttctgttgaactacactggatctgacttgatagaactattaaaaatagtttttaaaaaatgtgttattatttttttttgagatggaattttgctctgtcacccatgctggagtgcagtggcacaattttagctcactgcaacctccacctccagggttcaagcgattctcccgcctcagcctcccaagtagctgggattataggtgtgcatcaccatggctaatttttgtatttttagtagagatggggtttcactatgttggccaggatggtctcgaactcctgacctcagtaaaggcaatcatttaggccaggcgtggtggttcatgcctgtaatcccaacactttgggaggccaaagcaggtggatcacttgaggtcgggagttcaagaccagcctgggcaacatggtgagaccccgtctttactaaaaatacaaaaattagccgggcatggtggcacgtgcctgtagtcccagctactcaggaggcggaggcaggagaatcacttcaacccgggaggtggaggttgcagtgagctgaaactgtgccactgcactccagcctgggcaacagagcaagactctgtctcaaaaaaaagtcatcctattgtcatgatacttgtacttaaaggcctatctcaaaatcaacagtatttatttgtctttaaactcatctctatttctacccagcttgctttctttctttctttttttgagacagcatcttgctctatcaaccaggctggagtgtagtggtgtgatcatagctcattgcagcctcagactcctaggctcaagcaatcctcccacctcaacctcccaaagtgctaggattacagatatgagccaccatgcctagcatatagccaactttttaatttctactcattctactttcagttctagtgaattttataaatgtaaacaaatacgtcactttcctgcttaaaacccttcagtgtcaatgctccctactgctcttggctgacaggactttgataaagccccagacacctccacactctatgctccttcctgaaatgcatcatgttctttctcatcttccgacctaaccctgtggtgtctatgcctcaacccctcccctaccaccacctcctgctgccagcccttaacccagacaactcctcactcaaccttcaggtctcagtttataagcccttctttaaataagcttttcctgaccaaccaagaccagctaaatcctccttgtttttcctcttctaagactgtgtactcaccctatacccaaagtacttaccatgctcctataattattaacttatggagaaaaattaataataattattattatccccaactagattattatccccaacctgaatgggatccatgggttattaggaactgtctatcttaggtactgttccaggtacctaacacagggcatggcaaaatactcactccgtgagtgaatgtaccaaatttatagtagttatcacgacacagccaaactttaatagcctctcttgactctctatttccagactctccaagttccagtctatctgcagctagagttttcagtgatttagtttcagtgatttagtttcacagtacctaggacagacatacagttggccctctgcatccatgggcagattcaaccaactgtagatagaaaatatgaagggggaaaaatggatggctgtgtctatactaagcatgtacagaatttcttcttgtcatgattccctaaacaatacagtattaacaactatttacatagatttacattgtagtaggttttataagtaatctagagatatttaaagtataaaggaggatatgtataggtcatatgcaaacactataccattttatataagggacttgagcatctgtggatttttcttttcttttcttttctttttgagacagagtctcgctctgtcacccaggctggagtgcagtcgccggctaattttttgtatttttagtagagacggggtttcacagtattagccaggatagtcttgatctcctgacctcgtgatccgcccacctcggcctcccaaaagtgctgggattacaggcatgagccaccgcgcccagcctatccatggatttttctatctgtggggtctgtgggggtcctggaactagttccccacagacaccaagggacaattctactcttattcccacgggtgtcactctagttggagatgacacacattcaggtagatcatacagtgcatggtaattcttgaatatgctcaatgattccctccccactgtacagagaaaaaaatctcttagccaattatccaaggttctcaataatctagtccactcttcccatttaacctctccacacttaacagtaagaactttctggctgggcatggtggctcacacctgtaatcccagcactttggggggccgaggtgggcggatcacgaggtcaggagatagagaccatcctggccaacataatgaaaccccatctctactaaaatacaaaaatttagccaggcattgtggcacatgcctgtaatcccagctactcaggaggctgaggcaggggaatcgcttgaacctgggaggcagaggttgcagtgagccaagatcgtgccactgcactctaacctgggtgacaaagcaagactccatctcaaaaaaatgaatgaattaattaattaaaaaaaaaaagaattttctaccctgacaggtctcctcatggtcccctaaacagtctcagctcattccagcttcatgcctttgtgctcctcccactgccaaatataccctgcattctccctgctactcatccaaacacaaccctgccttctagatctagcagatcctgccccttcaccaggcttctcccagagatctcccaactctctgaatcctcagagatcttacctggatcatgccttgtggcacttgataaagcaccgacatcctgagctacgctttcatgtctcaccctatcctttgttccctttagcacctgacacacagggaggtgtgagggagagttctagactaggcagtaaagcactgttgccctgcatgccaatcatattcattcattcattcattcaataaatgccaactggccacattctctgtgcagacacctaccatgtgtaggtcagtaagagacaattttaacaaccttctctacagggttggcaactgtggcttggctcctcttccctctactcacattctagataatttaaatagctaactaatatactgaagtaacgaggtttagaaacatgaagtctattatcaattttatgttaaacaagttaactactcagctttggtaacctctgaaagatggagacactatgaataaccttccagggccactggtgaacaacattagaaagcattatttacatgttcacatttttattattaggacaataatgctaaacagtatccattcccaactcctgtaggaagaaatcactggctgacacagattcagacattttaaaaggaaagaaagtgaaagaccttattttcaaaaccataaccaaatgactataacttaaatgggaacttttcagcagatagacttacttttggtttttacttaaaaataaaaaattgtgcaaagtttgtgagtaacaggccacctacctgcggcttggtgaaatttctgtctgcacaccactgaacaaaatattgtcttgcggcatacaaactctttctgtccaccttcttacaatatactcgaatcagctgctctgcaaatttctctggcagaagttgtgaaacctttttaaaatgaagagatttcactatcaccttgaagtcacacattggagatatcagctggtccctaggctcctaactattcctttttttttgagacaagatctccctgtcacccaggctggagtgcagtggcacaatcacagctcactgaagccttgacctcccaggcacaagtgatcctcccacctcagcctcctaagtagttggaactacaggcatgagctaccatgcctaagttttttattttttgtagagatggggtctcgctttgttggccaggctgatcttaagctcttcgtctcaagtgatcgtcctgcttcagcctcccaaaacactgggattacaggtatgagctactgtgccaggcccactttaattgtaaagatatgccttaaaacctaatttgcatataaaatgctaatttactataaagatttgctacatgccactatagtatatttgttttgcctaagtagttacctggtttttagtaatcctgattgctctgttgggggcagtcttacaatagaagctaacatgatcaattggattcttttcttgcattccataatccatgttgataacctaaataaaagcaattcacaagtaatcatatagcaagcaggagaactgaactcagggctgtaggagcataacaagaaatggaacagaggccgggcgcagtagctcatgcctataatcccagcactttgggaggccaaggtgggtgaatcacgaggtcaggagttcgagaccagcctggccaacatagtgaaaccccacctctactaaaagtacaaaaattagctgggcgtggtggcatgcgcctgtaaccccagttactcgggagactgaggcaggagaattgtttgaacctgggagatggaggttgcagtgagccgagatcgcaccactgcactccagcctggcgacagagtgagactctgactcaaaaaaaaaaaaaaaaaaaaagaaagaaagaaatggaacagagccttctggggatttggaaataagaatgttgatgtgactcatggtggaataaaaataactggttcgtgaccactcttagggatttggtattgaaatctgggaagaatgggaaatgcacttgtgtgtttgatctaagtgtggtgtaaactcaatccctgctatgtgacagacacagatagacactagaggtacaacaaggacactttaaaataaaatcccaggccggacacagtggctcacttgagaccaggagttcgagaccaccctggtcaacatggtgaaaccctgtctctaccaaaaatactaaaaaaaaaaaaaaaaaaaaattagccagacgtggtgttgtgcacctgtggttcaagctactcgggaggctgaggcacaagaattggttgaacctggcaggcggaggttgcagtgagttgagattgcgccactgcactccagcctaggcaacagagcaagactctgcctccaaaaataaataagtaaagaaaatcctagcccccacaaaccaggcagccctagattgaaattcaacaaataattataaaagtattcaaccacagttgaaaagcaaagggtgctttgaaatgttctaacaggttacctgatgtagcctagggtgcccggagaatgaccggaaacattttcctgggaaagtgactttactaagtgagcaagaaacaaacaggcttaggtgggaagaaaaagaattgcaggcagaggaaacagctcagaggcagagaggactgaaactgtctcctggatttagcaactctgaagtcaccggtgattctggagagagtacagtgatggcaacagaaaaaaaggttcaggagaaaatgagaaacaaaaatgtaagaggcgcaatggctcacgcctgtaatcccagcactttgggaggccgaagccagcggatcacgaggtcaggagatcaagaccagcctgtccaatatggtgaaaccccatctcaactaaaaatacaaaaattagccagatgtggtggcaggcgcctgtagtcccggctactcaggaggctgaggcaggagaatcgcttgaacccaggagctggaggttgcagtgagccgagatcgtgccaccgtactccaacctgggtgacacagtgagactccgtctcaaaaaaaaaaaaaaaatgtaagagaaggcaactcttagaactttggctgttcagaggaggcaagatgttaaagaaaagaaaattacagctagataggaggagtaagttctagggttctatagtactgtaggatgactacgactatagttaacagtaatttccttttttttgacacagagccttgctctgttgcccaggctggactgcagtggcacaatctcggcacactgcaacctctgcctcccaggttcaagtgattctcctgcctcagcctcctaagtagctgggattacaggtatgcaccaccacacccagctaatttttgtatttttagtagagacggggtttcaccatgttgaccaggctggtctcaaacttctggcctcaagtgatccacctgcctcagcctcccaaagtgctgggattacaggcatgagccaccggggccggcctagttaacagtaatctattacatagtttttttgtttttttttgatatggagtttctgtgtcgccaggctggaatgcagtggctcgctctcggctcactgcaacctctgcctcctgggttcaagcgattttcctgcctcagcctcccaagtagctaggatgacaggtgtgtgccatcatgcctggctcactttttttttttttaattttagtagagacagggtttcaccatgttggccaggatggtctcgatctcctgaccttgtgatctgcccgccttggcctcccaaagtgctgggattacaggcatgagccaccgtgcccggcctattacatagttttaaatagcttgaaggagaatattgaatgttcccaacacagagaaatgataaatgtttgagatgatgggtatgctaactaccctgatctgacatttatatacactatgtaccccatgaaaatagacagttatcatttatcaatttaaaaaatacataaaataaaaacataaaggaaaaaaaagacagcaagaaagaagtatctggagaggaatctggtgccttagaaaggtaagggaagatgagtctgaccctgaaaaagaggagaggggaagagcagtgtggtgttcatgattttcttgagacaggctcttgctctgttgcctaggctggagtgcagtggtgcgatctcagctcactgcaacctccacctcctgggctcaagcgatcttcccacctcagcctcccgagtagctgggactacaggcatgcaccaccacacctggataatttttgtgtttttggtacggatggggttttgctgcagcaaggcatgatcatgccactgcacttcagcctggggcacagagagagaccctgtctcaagataaacaaaagtttaaactaacattggctgggtgcagtggctcatgcctataatcccagcacttcaggaggctaaggcagcaagattgcttgaggccaggagtttgagaccagcctgggcagcatggtgagaccctatctatacaaaaaacttaaaaattagctgggcatggtggcacatgtctgtagtcctagctactcaggaggctgaggtgggaggatcacttgagcccaggagtttgaggttataatgagctgtgattacatcactgcactccagcctgggcaacagagtgagaccttgtctctaaaaaataaataaataattaacactaaatacaataaaaaatgaagttattcagttacagcaaccacatgttaagtgctcaacagctgcatgcagctagtgactatggaaagggacatcactgaccaagaatatctctgtcactgcagaaagttctatgggacaacacttctctagaacacaagtagaattaccctaagcctttgacaagaacaaagctgtttccccactataagaatgggaatactgaatacagtgacagatggaggaaggcttgtttctttggtgagaaaggtctaaggagttgctacctaatggcctatagtttatcttggaaataggagccaaaggttgggttactcatgaggatgaatacagctggaggtgggaagcatggttggagttctgagaggagggaggacagtttgaaatgatgatgatgattattagtagtagtattttttgagatgagggtcttgctctgttgcccaggctggagagcagtggcatgatcttggctcactgcaacctccgcctcccaggttcaagtgattctcctgcctcagcctccttgagtagctgagattatcagcacccaccaccatccctggctaatttttgtatttttagtagagatggggttttgccatgttggccaggctggtcccgaactcctgacctcaggtgatcgtccgcctcggcctcccaaagtgctgggattgcaggcgtgagccactgtgcctggactgaaatgattattagagactgggagaatcacactaagcctgccagaaggcccagcttagtttcgtgaccggaaatttatagatatgcctgtatagtgatggtatccaggagcatttatgtgtccaggtatgggtgtggagatgtttagatttgattcatctaggttgtttggccttctgctaggtagatgcaaagaaggaaaagagagttgagggtaactgcagaaaatgagtgaattactgtatcacgttatctaagatacttttttttttttgagatggagtctcactctgtcgcccaggctggaatgcagtggtgtgatctcggctcactgcaacctctgccttctgggttcaagcaattctcctgcctcagcttcccaagtaactgggattataggcgcgcaccaccacacctggctgattttttgtatttttagtagagatggggtttcgccgtgttgggcaggatggtctcaacctcctgacttcaagtgattcactcgccttggcctcccaaagtactgggattataggcgtgagccacctcactcggcctacacgtggagagaaatgaagatagaaggccactgacaagctcgaagaaagtgaggacacaataaactagagggcctgatgagctaggaaaacatggatgaggaagaaaggggtttgtggacagagaaaagtatgttaaactagtgattttacagggagggcagttttgaatgttgataaggtccagggtgtaatctgctgagactattggcctgaggtgcagtgctgtctcgctctgttgcccaggctggagtgcagtggcgtgatctcggctcactgcaacctccgcctcccaggttcaagcgattctcctgccacagcctcctgagtagctgggactacaggcacacaccaccatacccagctaatttttgtatttttagtagtgatgggggtttcaccatgttggccaggatggtctcaatctcctgactttgtgatcgacccgcctcggcttcccaaagtgctaggattacaggcatgagccaccgtgcccagcaattttttttttctttttcttttttttttttggagacagtcttactctgctgcccaggctggagtgcagtggcatggtctcggctcactgcaacctctgcctcctgggttcaagcaatcctcctgcctcagcctcccgagtagctgggactacaggcgcaaaccaccaagcccggctaatttttttgtatttttactagaaatggggttttgccttgttggccaggctggttttgaactcctgactcaggtgatccacccacctctgcctcccaaagttctgggattacaggcgtgagccaccgtgcctggccccacaactttttcctctgtgcttgtatgcaggcaataaaaaaaattaaaatgtattacttgtgtaattaaaaatttttaattaatatagacaatgtaatcacatgaccacaattatattaaaaataatggcaaaacatcatgaacaaaatgtttttgtggttaataatattggttctctttgtgagggcacatcatctttctgtatttttctaatttgctaaaatgaacatgtactacttttataatggtgggtgctttatctttaaaacgtattcactcagtttattactgggctaattacttacatccactataaaatcttcagccttcagtttcacgtctagcaatactttgggtttagcactggcaacctcttttggaagagattcatagtcctcctggaaaacacaagactccccatgttagaatccatttttcatcaagtctttgagccacaaacaggttctctttatgaaaatggcacctaactaagaaaaacgattagagatatccttaacaaatatagctcctaccaatgtcactcgttaaacaaagagagcatttttgtaaaaaattgtaaaaagtggccaggcgcagtggctcacgtctataatcccagcactttgggaggcccaggtgggcggatcatgaggtcgggagttcgagaccagcctgaccgacatggtgaaaccccgtctctactaaaaatacaaaaattagctgggcgtggtggcgggtgcctgtaatcccaactactcgggaggcttaggctggagaattgcttgaatccgggaggtggaggttgcagtgagctgagatcgcgccactgcactctaacctgggtgacagagcgagactctgtctaaaaacaaacaaacaaacaaacaaaattcacattttgaaaaaaaaaaagtgacattaacctattagtacaacaagaggaagtaaagtataacccaagaaattattgaggtaggatgtggttataagtatgacttgtgttacggctttctggcaaacagaaaactcttcaacaagtaggaggtgaaaatagatatttgagctaaagaagacaggtatgtgccatctgggagactgatatcctgtgaaggaaccaagtcattacaacaggtcaccacagcctcaatgaagctcatgcaggcactttcttttgaggttcctttcccttatattcattttctcatgtctgaatctagccaaaattggagacccactctcacttcctggatgagatcaaagatttggagttaagttagacctggcttttgaatcctggctaaatatgctttcatgagcaagttatttaatctcagtgaagcctcagtttctctatctgtaaaacaggcctaagacccctgcactactgtgaagattaaatgagaataaacgtaaagcacttagtacagagtcatagtatcacgataggttagtggtctcctcttggaggacagagataacctttcactaatggaaagatgcctgataactcacccttttaatctttatttgtcctgttggctgcgtctcacccacatacttgaatagattacggtattcaatttgttttaaaatctctcgtgcgtctttcaatttgggatcagtagagtataaaatctccagaaaaatgttatctgccaatttaatgacatttcagttatattaaaataaaaacacagagttaaagaattatatagtgctattctattgaaatgatcttaacaggcagttcgcaaatgtaggtacattattattttagcaatgtgagaaaaatttttaaaagatttaagtgaaaaaaccttttaaaactgttccagtcggccagtcatagtggctcatgcctgcaatcccagcactctgagaggccgaggcgggcggatcacttgaggtaaggagttcaagaccagcctgtccaacatggtgaaatcctgtctctactaacaatacaaaaaaattagctgggtgtagtggcgggcgcctgtaatcccagctactcaggaggctgaggcaggagaattgcttgaccccggaaagtggaggttacggtgagccaagattgtgccattgcactcaagcctgggcaacaagagcgagagactgtctcaaaaaaaaaaaaaagttcctgtcaatgtcttggatttacttccaggtaatccagagagtggggaaggatagagagaaataagactgcattggagttgatgactgctgagctgggtgatgggcacataaaggtgtatggatttattgttgacatgttttattttgtctttaagaaagaatggtggctaggcgctgtggctcacacctgtgatcccagcaatttgggaggccaaggcaggtggatcacctgaggtcaggagcttgagaccagcctggccaacatggcaaaaccctgcctctaccaaaaatacaaaaattagccgggcatggcggtgcatgcctgtggtcccaactactcaggaggttgaggcaggagaatcgcttgaaccctggaggtggaggttgcagtgagccgagatggcgccactgcactcccacctgggtgacagagtgacactatctaaaaaataaaaataataaaaagagaacggtcctgaagtatttacaagcaaaattatgtctaggatctgcttctaaattgtccagtgtttgacaagagtgggtagatgaagcaaaactgccatgtgttgataactgttgaagctaagtgacaggtacatggctttgtaaatttctataataataaaacaatgattttttaatgtcccattcgatgatgagagtagaagaaatgtttttcctttctttcattttctcccaatttttattttgaaaaatttcaaaataaaatatccttcacttaaattcaacaattgttaatgtttttctgcatgcgctttctccatatatatatatctgtgcaatttttttttttttgagacagagtcttgctttgtcacccaagttggagtgcggtggcgtgatcttggctcactgcaacctctacctcctaggttcaagtgattctcgtgcctcagcctcctgagtagctggaactacaggtacatgccaccacacccagctaatttttgtattttcagtagagattgggtttccccatgttggccaggctggtctcgaactcctggcctcaagtgatccacccgcctcagcctcccaaagtgctgggattccaggtatgagccactgcacctggcctttttttttttttttaaggagacaaggtcaggttctgtggcctaggctgaagtgcagtggcgcgatcatagttcactgcagcatcaaagtcctgtgctcaagcaatcctcctgcctcagcccttgagcagctgtgactacagacgtacaccaccatgcctggctaaatttttttttgtttgtttttgagacagggtctcgctctgttgtcaggctggagtgaagtggcacgtgatcatggctcactgcatcctcgacctcctggactcaggcaatcctcacgcctcagcctcctgagtaactgggactataggcacatgccaccatgcccagctaaaccaaaagctagtttaaatgtaaatataatttgaaaaaattaatcttcctgccttagtctcttgaacagctgggactaaaggcacatgccgccacacctggataaagatgactttttttttttttttttttttagacagactcaccctgttacccaggctggagtgcaatggtgcgatctcagctcactgcaacctccgcctcctgggtgcaaatgattctcctgcctcagcctccagagtagctgggattacaggcgccaggctggtctcgaactcctgacctcgtatctgcccacttcggcctcccaaagtgctgggattacaggcgtaagccaccatgcctggctgactttttaaaatatggcatcacttgcattattatgaatgaaaattaaaagtaaatatcttcagcttgttcaattttttttttaacttttattttacttatttatttattttatttttgagaaggagtcttgctctgtcatccaggctggaatacagtgatgccatctcagctaattgcagcctccgcctcctgggttcaattgattctcgtgcctcagtctccgagtagctgggactacaggcacccgccagcacgcccagctaatactttgtatttttagtagagacagggtttcaccatgttggtcaggctggtcttgaactcctgaactcaagtgatccacctgcctcagcctcccaaggtgttgggattataggcgtgagccaccctgcctagccttacatgtatatttttaaagaacaatgtatatagttcttgtaatttaatttttaaattttttctctatcattattattattatttgatacagggtctcgctctgttacccaggctggacttcagtggtgcaatcttggctcactgcaaccccggcctcctgggctccagtgatccccccaacctcagcatcctgagtagctgggactacaggcacgcaccaccagggctaatttttaaattttttagaaacagggtttcaccatgttgcccaggctggtctcaaactcctgggctcaagcgatccaactgccttggtttcccagagtgctgggattataggcacgagccaccttgtctggcctattatttatcttttgattgaatttactgaaaggtgtaatgtgaagtctgtcaagttgaataataaaaatttgggcttgtattttacatgccttttccccccatttcatttttctagtaattcatttttatcatactttacagaaatatcaatctgcaaggggttggtaattttaaaaactggttcttcaaacacagtttaggaggagctagtttaggtttcattctgtcagtgtgcagcaaatagaatccagctgtggtagaacggcagcactctcggcaggaagctacggtagagtgattaggctgtgtcttaggtcacttggcttctgttgtttttctccattttcagagcctccagcctttccacggattctgtaagctatgtgattgctttccaattttatttttatttatttatttatttttatttattcatttttgagacagaatcttgctctgttgcctaggctggagcgcagtggtgcgatctctgctcaccgcaacctctgcctcctgggttcaagcgattctcctgcctcagcctcctgagtagctgagattacaggtgcgtgccaccacgcctggctcatttttgtatttttagtagagacggggttttacaattttggacaggatggtctcgaactcctgacctcaggtaatctgcctgccttggcctcccaaagtgctgggattacaggcgtaagccaccgtgcccggcccaattttatttttagttaaacagtttcataatttgtaactaagaactctgactggtgtacactttttgttctacttcttttgctttatctcagtcaatactttcccacattaaagaaccagctgtggctgggcgcggtggctcacacctgtaatgccagcgctttgggaggccgaggcagatggatcatctgagatcaggagttccagaccagcctggctgacatggtgaaaccccgtctctagtaaaaatacaaaaaaattagctgggcatggtggtgggcgcctgtaatcccagctactcaggaggctgaggcaggagaatcgcttgaactcaggaggcggaggttgcagtgagccgagatcgtgccattgcattacagcctgggctacaagagcaaaactctgtccacccccctccaaaaaaaaaaaaaaaaaaaaaaaagaaccacctttaccctttacctctctttcctcctttccacactaagctgcagattttgtttctgcagaagtgtggacagatgttcctggcatcttgtgtttttataatgaaaataatgttaaatggccaagtcagttttttggtgttcaatattagtccaggtatgagttaaataatgacaagtctgggcaacataatgggaccctgtctctacaaaaattaaaaaaattactcaggtgtggccgggcggtgtctcacgcctgtaatcccagcactttcggaggctgaggcaggcggatcatgaggtcaggagatcgagaccatcctggctaacaaggtgaaaccccatctctactaaaaatacaaaaattagccaggtgtggtggcgggcgcctgtagtcccagctactcgggaggctgaggcaggagaatggtgtgaacccgggaggcagagcttgtagtgagccgagattgtgccactgcactccagcctgggcgacagagcaagactccgtatcaaaaaaaaaaaaaaaaattcccaggtgtggtggcacatgcctatagtcccaagtagccaaatcagctacttggctgaggctgaggcaagaggatcacttgagctccggaggttgaggctgcaataagctgtgatggcaccactgcactccagcctggatgacagaataaaatcttgtctgaaaataaataaataaaaaaaaattaaatttaaaagttaaataatgggccgggcgtagtggctcacgtctgtaatcctagcactctgggagatggaggcgggtggatcacatgaggtcaggagttcgagaagaccctggccaatatggtaaaaccctgtctctactaaaaatacaaaaattagctgggcatggtggggcatgcctataatctcagctacccaggagactgaggcaggagaattgctgaaacccaagaggtggaggttgcagtgagccaagattgtgccagtgcactccagcctaggtgacagagcgagactccatctccaaaaaaaaaaaaaaagttaaataatgtatattgagtacttacgtatcaagtctatactaggtgctatgcctcatttaaacatcacaacaaaactatatgctaggtatcattaccctcattttatagatgaaagattcagataggtcaaatccctttatcaaagtcactttattggtacaagacagaaataaaactcaaattcaaaaggagataattacttgggaagctaaaatcgttccatcggctgtgtacagtgggtcacacctgtaatcctagcactttgggagtcaaggcaggaagatcgcttgagcccaggaatttgagagaagcctgggcaatatagtgagaccctttctttatttttttaaaattaaataattatctttaaaaatgaaaaataaaagaaagaaaaataactcattggcaattcagggacttcttacagtttatctgagatggaccatctatgttacctgttacttcttacctgtcagcttagtataggcttccatgtcgtcaattgctgtagaaatgcgatacttttttcctccagcacctgtaatctctatgtagtcatctgctttgaggaaagcatctgtaatcctaaaaatcattttgcaaaaatttatgtttatgagaaattttgaatatttgccttatgtcttacttaaggaaatctttctactttagggaaacaaaataatgaggcacagtgttctaaagacaactgcttctccaccgtactaaatttgtgcttggtaagctgtgagctgccatgcttactgtgttccaggcactgtcgcagggctttgcattcaccatcttatttattcctcccaacaataaggtaggtgtattcagccctcattttatagatgcagaaatgaagtaaattttgatttaaccaagttaggaagaaacagtgccaggctttgaaactagatatctctgaattacaaaacaacaacaataacaacaacaaaaactcttaccgaagaattaacatacaaataggagaaggtattccaagtaatctgctcatgacaaaggataggtaaaaaataggaatgaagatatacttcctcaacacaaatgtgaaaacgaacatgaaaagttaatcaatttaaggctattttagagacatggaagaagtaacttgactcacacccagtgtttgataactccttatggatctttgagtcacggagagacctggctgtacagttttctgctatggttctgactgggtcaggaagaggtaaaattcctgttggttttaccatttggtactaattttgataaatatttgaaaggatacaaatagacattaatcttaatccttaaagttaacttttgtcattaatctcagaatttaaatattcatgtcctacctcccattctcctgatgagaatggtgtgtaagtgactacctgtgccgaggtcctgagtgatctcagcactgccgcttcacgtctggcctaagccagctcttcttcccttcatctgcccctttatccacttccctccatctgcccctttatccacttccctccttttcctccaactaaattaactttatgctagattttttttctttaaggaaaccattttcaatttaatcacttaatattcacttgaactcatctagaaatgtctagttgagcctagtatgatactctagccaagtatcaaggaaaattttatagggaaatgacaatcaagtttcttacattgtatcaataatgttgccaactttgtgttgataagctctacggtgtaaagagttgcgagtgtggaacatgtcatacagatttccaacttcctgcaggaaaacatgaagtaaatattaataggatcagattatgttaacgttattagagacaagtatataggacaaggaaggaaaagggatagtggcagacaagagggctatgcaccggggcttcttcattaacacctttgaccccactaaaaaatgaggaggcagattagtaaagccatttattggcttgcaactttcattttttttttttttttttttttttttaaaagatgaggtcttgctatgttgctcaggctggtcttaagtgatcttcctacctcagccttgctgggataacatgcatcagccactgtacccagctaactttcattctttgttttttttttttttttttttttttttgagatggagtctcgatctgttgcccaggctggagtacaagtccttcattgcaagaactttcattctttttcttttctttcttcctttttttttttttttgagatggagtctcgctctgttgcccaggctggagtgcagtggcgccatctcggctcactgcaagctttgcctcctgggttcatgccattctcccgcctcagtctcccgagtggctgggactacaggcgcctgccaccaagcccggctaatttttttgtatttttagtagagatggagtttcactgtgttagccaggatggtctcaatctcctgacctcatgatctgcccgcctcggcctcccatagtgctgggattacaggcgtgagccactgtgcccggccaagaactttcattcttaataaactaggccaggtgcgatggctcatgcctgtaaccccagcactttgggaggccgaggtgggcagatcacctgaggtcaggagttcaagaccagcctggccaacatggtgaaaccctgtctctacaaaaatacaaaaattagccgggcatgatggcgggtgcctgtaatcccagctactagggaggctgaggtgggagaatcacttgaacccaggaggcggaggttgcagtgagcggagatcacgccattgcactccagtctgggtgacagagcaagactccaactcaaagaaaaaaaaaaaaaaccctaaaatctatcacatgctcaaactctgtgacagtttccgttttaggcatcttaaattaaatatatatatattttaatcctcccaataactctaggaaataggtattactattcttatgttcttcattcttgacttttttttttttttttagacagtctcgctctgtcacccaggttggaatgcagtggcacacaatcttggctcactgcaacctccacctcccaggttcaaccgattctcgtacctcatcctcctgagtagctgggattacaggtgtatgctaccacgcctggctaatttttgtattttcagtagagacagggtttcactatgttggccaggatggtctcaaactcggtagcccaagagatttgcccacctcagccttgcgaagtagtgggattacagatatgtaccaccacgcctagcccttcttgactttctatagtatagtactatactactttttgattacatgactgccatctaacagggacctagtgatttcagctgtttaactacagttgacctttaacaacacatgtttgaactgtgagagttcacttatacagatttccttgccccgctgccacccctgagacagtaagaccaatccctcctgttcctgagcctacttaatgtgaagacgatgaggatgaagacctttatgatgatctacttccacttaatgaatagtaaatatactttctctgccttatgaatttctttctttctttttttttttgaggtggagccttgctctgccgcccaggctggagtgcagtggcgcaatctcggcttaccacagcctccgcctcccgggttcaagttatttttctgcctcagcctcccaagtagctgggattacaggcactcgccactgcgcccagctaatttttgtattttgagtagagacggagtttcaccatgttgcccaggttggccaggctggtctcgaacttctaacctcaggtgatctgcccaccttggcctcccaaagtgctgggaatacaggtgtgagccaccacgcctggccttgccttatgattttcttaataacattttcttttctctagcttactttattgtaagaatacagtagatggggcgtggcggctcacacatgtaataccagcactttgggaggccaaggaggacaagttgcttgaggtcagaagttcgagaccagcctggggaacatagcgaaaccctgtctctacaaaaaaaaaaatagaaaaattagcccggtatagtggcatgcgcctgtggtcccagctattcgggaagctgaagtgggagatttgcttgagctgggaaggtggaggttgcagtgatctgagatcgcaccactacactccaatctgggtgacagagtaagatcctgtatccaaaaagaaaaaaaagaatatggtatatgatacacgtaacattcaaaataggctggatgcagtggctcacacctataatcatagcactttaggagactgaggtggatgggttgcttgagcccaggagtttgagaccagcctgggcaacacagtgaaactccacctctgtaaaataaatttcagaattagccaagcataggcctgtagtcccagctactcgggaggcagaggaggaaggatcagttgagcccaggaagtcaaggctacaatgcactatgatagtgccactgtactccagcctgagtaacacagcaagaccctgtctggaaagaaaacaaaaaacatacaaaatgtgtgtaactgaccattaaggttatcaataaggcttctggtcaacagaaggctatttagttaagtttttgggaagtcaaaagttatatgcaggccaggtacagtggcttacacctataatgccagcactttgggaggctgaagcgggtggatcacttgaggtgaggagttcgagaccagcctggccaacatggtgaaaccctgtttccactaaaaagacaaaaattagctgggcgtggtagcatgcatctgtaaacctagctagtcacaaggctgaggcagaaaaatcacttgaagccaggaggcagagcttgcagtgagccgagatcatgccactgtaccccagcctaggcaacagtgggagactccatctccaaaaaaaaaaaaaggtaaagaaaagttttatacagattttcaactaggagaggggacagcacccctaaacaccattttgttcaggtgtcaactgtataaaatttttcaacactaatacagtgattaaaaatgagactctgggccaggcaccttggctcatgcctgtaatcccagcactttgggaggccgaggcgggcagatcacgaggtcaagagattgagaccatcctggctaacacggtgaaaccctgtctctactaaaaatacaaaaaaaattagccgggcatagtggcgagtgcctgtagtcccagctactagggaggctgaggcaggagaatggcgtgaacccgggaggcggagcttgcagtgagccgagatcgtgccactgcactccagcctgggtgactgagcgagactccgtctcaaaaaaaaaaagagagagactctggaaccaaactttttgggttgaaattccaactctaccacttgttaattatatgccttctctgtgccttaatttgcttgcctgttgaatggaataatagtatctatctcacagggttatacggaatgagttgatccgtccaaagcacttaaaatgatgcctcatacaagccaggcatgatagtgtgcacctgtagtcccagctacttgggaggctgaggagggaggatcacttgagctcaggagttcaagactagcctgggcaacacagtgagatcctatttcaaaaaaaaaaaatgcaaccaaccaaacaaaaaaaccccaaaaccagtgtctaactcaaaacttaataaatgtccatgttaattttattattatttaataatgcagtagaagggaagagactaaagatatttacaaatcctaggaattaagtaaagagactgacgatttaccaattattccaaattgttaaatggttatttccaaatttcagaccaggaacaacattcttcttattgcctcctctggcacagcttaccttatctctagcacaaatacgcaactcattgtctacttcacagacacgggcaaacttaataaagcgcttgtaatcaaaattattttggattccaagatgatggcagtccctagaaggattccaaaacagagagatgaaatttttcaacaaggaagctgtaccttaaatagtaatactaaatttatataaatattttagccaacttttcagaagtgttcagtgcatacctggcaaaataatcccatttgtccacatcaatgccatttcttttattagatactatctcataaaggaagcttttgttttcaggacgccctttatatggccactggaaggcaagaaaacccactggaagttttaggataggcaccaaatctatttataaacaaagcaaagcaattttattaatctgtaaaatataaacagatacctgactgggaatatgagataaactagaaggttctattctttctttcttccacttcatttcaaaactagtagaaagggaaaagaaatgctaaggtatatgataccctattgttaccacattttcttgtgccactgaaaagatctgaactctattacatttcccaaaaccaacaacttttgtgttttcttggtttataagtttttgaaaaatataaaatctaggccaggcatggtggctcacgcctgtaatctcatcactttgggaggccgaggagggcggatcacgaggtctggagtttgaaaccagcttggccaagatggtgaaaccctgtctctactaaaaacacaaaattagttgggcatggtagcaagtgcctgtactcccagctactcaggaggctgaggcaggagaatcgcctgaactcaggaggcggaggttgcagtgacctgaggttgtgccactgccctctagcctgggcaacagagcaagacaccgtctcaaaaataaataaataaataatataaaatctaataataaactaacaatgcttgaattcatgcattaaaacagtactatctttcaaagtagctacatacctagtctaaataatatgcattgttgaatgtattctttgagctccacttttttggaaataggatatttgctacaaaactcatctgtttatcttatactgtaagtacacttgtatatatttgaggaaacagccctaaaaatctcagggggaaattatttcccaactttatttttaattaaaaaaatacaaaagatcaaaaaggaaacaaaacagattttccattgaactggttcaacttttttgtagatcttcctataaatatttcaaatatgatttttttttaaatttgtagacaggatctagctctgttgcccaggctggagtgcagttgcacaatcacagatcactgcagcctgcctcagcctcccaagcatctgagactacaggcatgagacagggtttcagtattacccaggctgatctcaaactcctgggctcaagtgatcctcccatcatggcctcccaaagtgctgggattacaggcatgagtcactgagcctggccaaatatgttcattttaatggttaaataaaacatacacatttacattccaaacaaagttactttaggcttctatataaaatactgcaggccaggtatggtggctcacgcctgcaatcccagtattttgggaggccaaagtgggagaatcacttgagcccaggagttcgaaaccagcttaggcaacatagtgagaccacatctccaaaaaaaaaaattttttttaatgaataaaatactgcatatatattcactaaaaaagaatttatggccgggcgcggtggcggctcacgcttgtaatcccaccactttgggaggctgaggcgggtggatcacctgaggtcaggagtttgagaccagcctgggcaacatggtgaaaccccgtctctactaaaaatacaaagatttgccgggcgtggtggcacacacctgtaatcccagctactcaggaggctgaagcagaagaattgcttgagcctgggagacagaggttgcactgcgctgagatcatgccactgtactccagcctggccaacacagtaagactctatctcaaaaaaaaaaaaaaaaaaaaaaagaaagaaagaaagaaaagaaaagaatttatgccaagcacagtggctcacacctgtaatcccagcactttcagaggcagagctgggcagatcacttgagctcaggatttcaagactaacctgggcaacgtgacaaaaccccatctctacaaaaaatacaaaaattagctgggcatggtagtgcacgtttgtggtcccagctactcaggaggctgaggtaggaggatcgcttgagcctgggaggtggaagttgcagtgagctgagattgtgccactgcactccagcctgtgtgacagagtaagaccctgtctctaaaaagaatttctgtatatatatttttgggaagtaacttctaactaattcagttgagaggtagaaaaaaatataagccttttattttttgcattaaacagtagaaacatagaactcatattttatcatttagcctctaaaatagccaaatgtataactcagaaggaatcatgaaaaggctagatgaaaagcaccagtcagttaaaattaagctgtacataaacttaccaatgaatcttcgacaggtgattcaagtggtcctacaatttgttcctttataaagcaaatatcttcttcagggatgagaccatattgttccatgacaggcttaattccattagaattaataaggtgctcaaacatcataactgagccttgttcatgctaggaaaagtaagcacaatatgatgtgttaaagattctagcccattgggagccctgactaacaaaattatcctcaattccaagtaattctgagataaaggtctattgcatattaattctctagtttctaaccacaatcttaggaacatttttaaaaacctgtcagatttttcattttactagtagtctacaaaccttttacaaaacttatttcataaacatatttaatgcatttaatgatataatcatttacagttcctaaatgaatattataagatcatgtagacagaattacattttaataaatatcatcataaaattgaattttattttttcatcagcctttgaacacgtgcagttataagctctgttaggcactaccatctagtggtgaaaaggggtaactgcaaacttgccagtaaaaacaaagatctcccttgaaatctccaattggcctgtttgctcatctctctctgctcactcattcacaatcaatgtaaaggatcaaatgaactcctgaagacatctgccctttcctagatcctaccaaaaactaactcaagatgaaaaacaaaacctgaattatcctataactatatttttttaaaaaaagagacagggaattgctctgttgccctggctagagtccagtgatgtgatcatggggtcactgtagtcttgaactcctgggctcaagtgatcctcccacttcagcctcccgagtagctgaaaccacaggtgcacaccaccctacccagctaatttttagatttttttgtagaggcagggtcttgatttgttgaccaggttggtcttgaactcctaggctcaaataatcctcctgtctcagcctcccaaagtggcaggattacaagcaacttgccctataactattctttccccgcccccgcagaaacaattcttgctccagaaactattcttaaaaacagaatcagggctgtcaggcctgggtgcggtggctcacacctgtaatcccagcgttttgggaggccgaggtgggcggatcacttgaggtcaacagtacaagtttggccaacatggcaaaacctcctgtctactaaaaaatacaaaaattagccaggcatggtagggtgcacctataatcccagctacttgggggactgaggcaggacaatcacttgaacccaggaggtggaggttgcagtgagccgagatcgccctgcactccagcctgggtgggcaacaaagtgacactctgtttcaaaagaaaaaaaaaaaaacccacaaaaacagaatcaggctgggtgcagtggctcacatttgtaatcctagcatttttttgagaggcaaaggtgggaggattgcttgagcccaggagttcgagagcagcctgggcaacaaagcaagaccctgtctctacaaaaagataaaaagattggctgggtatagtgacatgcgcctgtggtcccagctacttgggagaccaaggtgggaggattgcttgagcccaggtggttgaggctgcagttagctatgttcatgcctgtactccagcctgggcaacagagcaagaccttgtctccaaaaaacaacaacaacaacaaacaaattggccgggcacagtagctcacgcctgtaatcccagcactttaggaggcggaggcaggcagatcacgaggtcaggagatcaagatcatactggccaacatggtgacaccccatctctactaaaaatataaaaattagctgggtgtggtggcatgcacctgtagtcccagctactcaggaggctgaagcaggagaaacgcttgaactcgggaggcggaggttgcagtgagccgagatcacgccactgcactacaggctgggcgacacagcgagactctgtctcaaaaaaaaaaaaaaaaaaaacgaattgaatcaagatatacgtaattacaaagaggaaaaatagtaactttataatggagagatttgacagacaatgccttaatcaagtaagcagaattaatatcattggtattggctcaactaggatttatgtgcctcctgagatgatacactatgaaggatgcatcactgatttttttggagacagagtctagctctgtcacctcctgggctcccgggctcaagcaattctccttcctcagcctcccaagtaggcacgtgccaccacacccagctaattttttgtggttgttttttttttttttccctcttgttgcccaggctggagtgaaatggcgtgatcttggctcactgcaacctccgcctcccaggttcaggtgattctcctgcctcagcctcccgagtagctgggattacaggtgcccaccaccatgcccagataatttttatatttttagtagagacagggtttcgccatattggccaggctggtctccaacttctgacctcaggtaatccacccaccttggcctcccaaagtgctgggattacagatgtgagccactgcgtccgatctggacacatcacttttgtggcattctaccaaaaatgcatagcttgaatccatgaggaaacatcacactgaaactcaaattgaggaacattccacaaaatagctcagttgctctttaaaaaaatgacaaagtcactaacgataaagactgaagaattgctccagatcaaaagaaactagaaaaatggcaactaaatgcaatgtgtaattctggaccagggaaaaaaagtttttttcccctttttctatatggacaattggtaaaatttgaaagtctgaattagataagagtactgcatcaacattaatttactgattttgataattatactatggttatataagaaaatgttgtttttaggaaatacccactgaagtatttagaaataaagtatttcaacaatttacattctttgagagacagggctcttgctctatcacccaggctggagctcagtggcatattcatagctcagtgtatccctgaactcctggattcaagtaatcctcccgttctcagtagctaggaccacaggtgtgcaccacaatgaccagctgatgttttcataattttgtagagacagtttcactatgttgcccaggctggtgttgaactcctgggctcaaagctatcctcctgccttagcctcccaaactgttgggattacaggtgtaagccactgtgtccagtctaaaaactaactttctttttttgagacaagttctcactctgttacctacgttggagtgcagtagcacgatcacagctcattgcagcctcgacctcccaggctcaagcaatcctgccaccccaccatgcctggctaatttttaaatttttttgtagagacggggtttcaccatgttgtccaggctggtcttgaactcctgggctcaagcgatctgcccaccttggcctcccaaaatgttgatattacaaccatgagccactgtgcctggtcaaaacttactttctaatgattcagaaaaaaaatatctatatataaagagagagtattttatttattttttgacacagtgtctcactctgtcacccaggctggagtgcagtggcgtgatttcagctcactgcaagctccgcctcctgggttcacgccattctcctgcctcagcctcctgagtagctgggactacaggtgcctgccaccacacccagccaatttttttgtatttttagtagagacgggatttcaccgttagccaggatggtctcaatcttctgaccttgtgatccgcccaccttggcctcccaaagtgctcagattacaggcgcgagccaccacgcctggccaagagagagtattttaaaaaataaaaatgaggtggatcacttgaccctgggaggcagaggttgcagtgagcttagatgacatcactgagctcctgcccgggtgacagggcaagaccctctctcaaaaacaataaaataaaaataaataaataaataaataaagtaagggattttcaaaatagtagttttaaatatatcaatgccaactgtgaatatactagcaaacagaaaaaattaagtttcataaagctagcacagaccataataacaactaaaattataaggaacttaggagtaagtataacaaagatgtatgactttcatggcaagcctaggcaacatagtaagactccatctctacaaataaatacccaggtgtgacggtgcaggcctgtggccccagctacttgggaggctgagatggaaggatcgcttgagtctggaggtcaagaccagcctgggcaacatagtaagactctgttctccacagaaaggaaaaaataaaaacataaatcttattataaagtatgtcaacctaaaaggaaggagctgagaaatatttaatatagagagtttatttgggccaaggttgaggacacatttacaaattgccttggggaatgcttggggagaacaaaagaggctcaagtttttaaacaaaaaaggactggccaggtgtggtggcttaggcctgtaatctcagcactttaggaggccaagcggggcagatagcttgagctcgggagttgagaccagtctgggtaacaaagtgaggcccactccctctacaaaaaatataaaaaattagctgggcatggtagtgtgtgcctgtagtcccagctactctggaggatgaagtgggagaattgcttgagccttggaagtcgaggttgcagtaagccatgtttgcaccactgcactccaccctgggtgacaaagcaagatcctgttgaggggaggggaggggaaaggagggaagggggaaggggaaagaaaaggaagggaaagaagggaaggaagggaaagaaaggaaggaaaggaaggaaggaagggaaaaagagaaagaatgagaaagaaagaaagtgagaaagagaaaaagagagacagagacagaagggagagaaaagaaaaaaaaagaaaagagcataaatcaggaggaggaggtgatcacaaagaggaggtgataacaaaagttgttagtcaggaatgttcactggcttacagaaataacattagttagtgattggctacatattatgaagtacaggatatatggcattttatggttacctggcatcccacataacagctggcttcaagagataataattatttagctcaagggggcgtgacatgattgctgttctatttcaatgcctctctgggcctgataatgtaaaggggctcatatttctcagataaaaatttcttttcttctttttttttcttccccaagtaacaagtgtggaaacagaacagaatgcagaatgattcatcatatatgggaagttaataaatgttggggttggtattacagtcagtggggataggatgaactattaaaaaattagatttctcggccgggcacggtggctcacgtctgtaatcccagcgctttgggaggccgatgtgggtggatcatgagatcaggagttcgagaccagcctaaccaacatggtgaaagccatctctactaaaaatacaaaagtcagccaggtgtggtagcacatgcctgtaatcccagctattcaggaggctgaggcaggagactcgcttgaacccaggaggtggaggttgcagtgagccaagatcgcaccactgcactccagcctgggcaacagagtgagactccatctcaaaaaaaaaaaaaaagaaaaaaaaagatttctcccatatacttacacaaaaataaattgtacacgagctaaggatttaaatgtgaaaggcaaaatgcttaaaggaatagatttggtaatgattgagaagatcctattagatcaactgcagaagaaaacaactataagctctggacaactccctgaaggtcctggagagagaccaaaaccaagtggatgttagacctcaatacttagaagggagaggtgctgggtgacattccggttttatggttttttgcctaagggcaggccccaggacagaaaaactggtgagaaactacccattttactggcttgcagaaccagagtacttcatcaaaattgaaaacgtctgtttttcaaaaggcaccatgaaaaaatgaattggccaagccagacactggggaaaaatattcacaatacatatacctaaccatatatatacataaagaattcctacaactcagtaatcaaagagcaagcaatcaaactttttaaacgagtaaaatgttgagagttctttgcagaagaagatatatcaataacaaagtacaaagtacaggaaatagtattcaacatacattagaaaatcaaaccatgaaataccatttgacactcattagaagggctaatttgaaaggtcaaatgttgatgaggctgtaaaacaactggaactccagtatgttgctgatgggagtgtaaaatggtacaaccgcattggaaaactctggtagtttcttatagaattaaatacatatctaccatatgacccagcaattctagctcctcggtatttacctaagtgaaatgaaaatgtatttctttattttatctatttttatttttataaaataatgtatttctgctgaatgtatttcttgttttaaaaatgtaattaactttccacactacaacaacatagaaaatgtatttctaccaaaatcttgtacgataatatgcacgacaaccttatttataacaaccaaaacctgaaaacaatccaaattccaacaaaacaagaaagggtaaacaaattgtgacttatttgcataatgccacactacgtaggcgataaaaaaaaggatcaactactgaggcacataacatgaacaaatctcaaaaccattatgttgagtaaataaagcaaggcataaaataggacctcctatatgattctgcttaatcaagtctaagaacaacaaaattcatttatgtttgtaaaaatcagaaggtgatggtggggtgagggggagtgagaattgactaggaaaaagcacatgggaatttttcaggaagatgaaaatgttctatatcctgactgggtaatagtcatatggatgtatacgcctgtcaaaactcactgaacttaagatctggacaacttattgtatgtgaactatacctcaaaaaaagagagagagaaaaaaaaagtggttgacatgtaagaagttttcaatatatattaatatcctttttctattcccgttccagaaatacagtgtagtaaaaaccaacctaattttacttctcaaaaattgattccaaaatatgggacagccacctgcaaatgcctaattttaaaatgattcatttaatatatatgacttggctggtaagttagttcgtggtcataccaaatgtgtcaaaactggagttggccttttattatacagtagtacaatggagcagaaggagtattaaactggcaactggttttgtattgctgattccagtatttaacggctttgtgatttttgatgcatcaatacacatccaagagtttcaagttcctttatttgtaaaaagggagataacgataacttccttacagactactgtgagaaccaaacaaaagcatatatatatatatgtgaatgaaagcaccctggacactgtaatggggaagtattttataacacagtagtggaaccaaacagataaattaactaaataacctgcttaaatagtctttctttttattgactattgactgtatgaatacataccgtccatttcacctccgggcgagcaagtggaataaatcgtccatcaaacatgtgagaaaatggcccatgaccttaaaaacaaaagcagccttagaacaagaaaaacatctgtaaaccaacaaaaactttttccttttttttttttttttttttgagacggagtttcgctcttgttgcccaggctggagtgtagtggtacaatcttggctcaacacaatctccgccccctgggttcaagcgattctcctgcctcaggctaccgagtagctgggattacaggcgtgtgcaaccacatccagctaattttgtatttttagtagagatggagtttctctacgttggtcaggctggtctcgaactcccgacctcaggtgatccgcccgtctcagcctcccaaagtgctgggattacaggcgtgagccaccacactcagccaaactgaattctttaatctttttagtttaacttgaatagcaaaagaaattaataatctaaaaatacaatcacaaaaagggacaaaccctttcttcctatttctaaaacaggagaacaggaagcagaaacatggaaaagtaagctctccatcgagcagtctccagtcaccaggttttacataaatctgataaaagggcagtttttgttgttttttgaagagacagagtcttgctatgttgttcaggctggagtgcagtggctattcacaagcatgatcattatgcactgcagccttggactcctgacctcaagtcatcctcctgcctcagccacctgaatagctgggactacaagcatgcaccaccacacagggcttgataaatggacaattctgtgtaactaaaaagaatgttaatgccaaaaactttttgaaatcttcagattgaaaatatctggattaaaatagcagtttcaagaaaatccactagggccaggtgtggtggctcatgcctgtaatcccagcactttgggaggctgaggtgggtggatcactttgagtcaggagttcgagaccagcccggccaacatggtaaaaaccctgtctctactaaaaatacaaaaaattagccgggcttggtggcgggcacctgtagtcccagctactcgggaggctgagacaggagaatggcgtgaacctgggaagcggagcttgcagtgagccaagatcacaccactacaccccagcctgggtgacagagcaagactccatctcaaaagaaaaaaaaaggggctgggcgcggtggctcatgcctgtaatcccagcactttgggaggccgaggcgggtagatcacgaggtcaggagttcaagacaagcctggctaagatggtgaaaccctgtttctactaaaaatacaaaaattaggcgggtgtggtggcaggcgcctgtaatactacctactcaggaggctgaggcaggagaatcgcttgaacccgggaggcggaggttgcagtgagccgagattgcgccactgcactccagcctgggcaacagagcgagattctgtctcgggaaaaaaaaaaaagaaaatccactggggtgcaggaagaaaaaattagaatttctcttataactctcaagcttaaaaaaatctatctttggccgggtgtggtggctcatgcctgtaatctcagcactttgggaggctgaggcgggtggatcacctgaggtcaggagtttgagaccagcctgaccaatatggtgaaacctcatctctactaaaactataataattagctgggcatggtggcatgtgcctgtagtcccagctacttgggaggctgaggcaggagaatggcttgaacctgggaggtggaggttgtggtgagccaagatcgtaccattgcactccagcctgggcaacagagcgagactccatctgaaaaaaaaaaaaaaagaagtgagccacttaactggagagggaagtctacctagactagccttggccctgctttgcaagtcacaggctacacataaaggctcgctaatgcagtgctcaggctcctggggactggcaaaggtttcccaatgattctccctcaaaataccaagaatccatcaaatttatcatctaggggctggtattggttctttgtaagtctccgggggacataaaaagagtgcctacttgctttaagtatctggctatccaaacagtggcatgcacctcccttcccctgccctgagggtacacacaaactctcagagtccctgaataagtaggaataaactataaggatagaggtaaaaacccccatgatttaaaaggaacagtcccggcccaacgtggtgacttatgcctgtattcccaacactttgggaggccaagggaggtgaatcacttgaggtcaggagttcgagaccagtttcaacaacatgatgaaactgcatctctactaaaaatagaaaaaaattagccaggcgctactcgggaggctgaggcagaagaatcacttgaacccaggaggcggaggttgcagtgagccaagatagtgccaactgcactccaatctgtgtgacagagcaagactccatctcaaaaataaaaaaataaatgggacagtcccctttctctttgtcacaggaaaaggattatattcttttgcttggattaaagtggcctaagacctcacatggatcagaaaagacaaggagttctctaaatgtgttaatccacttgggcagattagagattataaatatgaaaaaaaatggatttcaccaaataaccgaaggaaaaatggtgattttatttgataagaaggacaaggccaggcgcggtggcttacacctgtaatcccagctctcagggaggagaggcgggaggatagcttgagcctaggagttcgagacctgcctgggcaatatagcgagatcctgttctccacaaaaaggaagaaaaaaaaagaccaaaaaaaaaaaaaaaaataagcataagaaggataaaagaaaaataaaattcacatatcatcctaaaagcagtagtaagaaaaactcactagcaaaaagccctttcatataacctgtagtaaacatgatggccgggcacggtggctcatgcctgtaatcccagcactttgggaggctgaggctggtggatcacctgaggtcaggagttcgagaccagcctggccaacatggtgaaaccccgtctctgctaaaaatacaaaaattagctggatatggtggtgcatgcctgtaatcccagctactcgggaggctgaggcacgagaattgcttgaaaccaggaagcggaggttgcagtgaaccgataatgagccactcactccagcgtgggcaacagagcaaaactctgtctcaaaaaaaaaacaacaacaaaaaaaccactttagcaaagatgtttaacatgagaaattcactgaaagttgccaagaaaataaaatagcaatgttttctacttatgaatcattctaggaagaagcaacagtacatttatactaacatcaactgaagaattaaaatacaatttccatattctcttggttgatctgattttttaacgtcaaagagaggtaacatatgttatgattttacataacaactttgtctctttgtacagcttaccgagatcatgacaaagtccagcaatctgaacacagagaacatctcgttcacttatctgcagctctggttgtttttcacccagtgcgtgaactagacatcctgctagataccccaccctgcagagcaaaaacacaaaaagtcacttttctgtttgcaagaggagtgatagttctggtcctcaagaacttcagtatgtttccttaaacattctaacatacctttagggcaactttactgaacagtatatttcagaactaggcaggaacacacacaaacggaatcccaaaagcaggacctctggctcaatatcaccaatcattagaggaatgcacatcaaaaccacagtgagataccacttcacaccccttaggatagctactattaaaaaaagaaaaccagaaaataacaagtgttggacatgatgtgaagaagttggaagcctgtgcactgttagtggggatgtattatggtgtagctgccatggaaaacagtatgggtgctccacaaaaattaaaaacggaattaccacagtgatttagcaatttcacttctgggtatacacccacaataacgaaagtaggtcttgaaaagattggctgggctcaggggctcacgcctgtaatcccagcactttgggaggctgaggcgggcagatcacttgaggtcaggggttcgagaccagcctggccaacatgttgaagccccatctctactaaaaaatacaaaaattagctcagcatggtggcaggtacctgtaatcccagctatttgggaggctgaggcaggagaattgcttgaacccaagaggtacaggttgcagtgagccgagatcttgccattgcactccagcctgggcaacagagcaagattccgtccccaccaccctccccccaaaaaaagaaagagaatatatttgtacagacatgttcatagcagcactactcaaaatagccaagaggtaaaagcaacaggtatccatcaacaaatgaatgtataaacaaaatgtggtagatacatatgataaaatattattcaaccttaaaaaggaaataaaaaataatttaaaaataaaaaataaaaaataaaaaaggaaagaaatactgacacatgctacaacatagatgaactttgaggaaattatgctaagtgaaataagccagtgacaaaaagacaaatattatatgatttcactaagatgaggtacctagagtagccaaattcataaacaaaaaaaagagggccgggtgcggtggcttatgcctgtaatcccagcactttgggaggctgaggtgggcagatcacctgaggtcgggagttcaagaacagcctggccaatgtggtgaaactccatctctactaaaaatacaaaattagctgggcgtggtggcaggtgccagctacttggaaggctgtaatcccagctacttggaaggctgaggcagctacttggaaggctgcttggaaggctgtaatcccagctacttggaaggctgaggcaggagaatcacttgaaccgaggaggcggaggttgtggtgagccgagattgcgccattgcactccagcctgggcaacaagagcgaaactccgtctccaaaaaaaaaaaaaaaaaaaaagtagaatggtagttactagggggttgcggggggttgcggggggagacatgaagagttgtttaatacgtatacagtttcgtgtttttttttttttttttttgagatggagtctcgctgtgttgcccaggctggagtgcactggcctgatctcagctcactgcaacctcaggagtagctgggattacaggtacactccaccatgcccggctggttttgtatttttagtagagacggggtttcgccatgttgcccaggctgatcttgaactcctgacctcaggtgatccactggcctcagcctcccaaagtgctgggattccaggtgtgagccactgcacccggcaagtttggttttgtaagatgataagagttttggcaagtttggttttgtaagatgataagagttttggcaagtttggttttgtaagatgataagagttttggcaatcgattggttgcacaatgtgaatgcatttaaccctactaaactgtacacttaaaaaacacttaagactatgtattttctattctgtgtattttaccacagtttttttttaaagtaggaatatctggctttgtaatgtttacaacataattggagatgaagtacttaaatgcacttccagcacttccatctgagccattcctaaattcttttcccctgaactctgagctacatgaggacagaggcgattgttatctttttgtggtttggtagggcttagtaaggttcgataaatatttgttgatgaatgaacatttgagtatagacacatgttgtgcctaactaaaaatgcttctacacaaacagaaaaccaaagtaatatactgtgagtacttcatgaaaatctcaaagactgtctattcttccctgtccacttcctcctggctctacactgcataatggaaatgcagaccaacgtctcagcttagttgtatgtaacagaggcatcgccttctctaagattatgaatgcttttttaacttacgcatttcctgacaggtaagaaaatgatctggtttgaaagagcaactctgtaccagagtaaatagagaatacagaaaaattaaataatcaaatatacataattagttgtatcagcaaccgacccattagcttttatttatttatttatttattttgagactgattctcactctgtcacccaggctggagtgcaatggtgctatctcagttcactgcaaccttggcctcccgggttcaagctattctcctgcctcagcctcccaagtagctgcagcgtgcgccaccacgccttgctaatttttgtatttttactagagacggggtttcaccatgttgctcaggctggtctcgaactcatgatctcaagtgatccgcctgccccggcctcccaaagtgctgagattggccgggcacggtggctcatgcctgtaatctcagcattttgagaggccgaggcgggcggatcacgaggtcaagaaatcaagaccaccctggccaacgtggtgaaaccctgtctctactaaaaaatacaaaaattagccaggcgtggtggtgggcacctgtaatcccagctacttgggagactgaggcaggagaatcacttgaaccctggaggcagaggttgcagtgagctgagatcgtgccattgcactccagcctgggcgacggagtgagactccatctcaaaaaaaaaaaaagtgctgggattacaggtgtgagccaccacacccagcccctgttagcttttaattaatatttaaaaacaaatccaactgacctgtctatagatactttcattatttttccaggaaagatctgaggtggttaagaatacataaaataaataaattgcaacaaggtaaataaaaagcctcaattttggggctgggcacagtggctcatacctgtaatcccagtactttgggaggccgaggcaggtggctcacaaggtcaggagatcaagaccagcctggccaagatggtgaaaccccgtctctactaaaattactaaaattagccgggtgtggtggtgggcgcctgtaatcccagctgctcaggaggctgaggtacagaactgcttgaacctgggaggtcgaagttgcagtgagccaagattacgccactgcactccagcctagtgaaagagactctgtctcaaaaaaaaaaaaaaaaaaaaaaaaaaagcctcaattttctcatcaataaaataaggacattatcatcattttgtaaaactatttattctctaaaagattaagacaactatttcttttttttcctgttttctttttctttctttttttttttttttttgagatggggttttgctcttgttgcctaggctggagtgcgatggtgcaatctcagctcactgcaaccaccaacctcctgggttcaagtgatcctcctgcctcagcctcctgagtagctaggattacaggtgcgcacaatcatgtctggctaattttgtatttgtagtaaagatggggtttcacaatgttggccaggctggtcttgaactcctgacctcatgtgatccacccacctctgcctcccaaagtgctgggattataggtgtgagccaccatgcctggcctaagataactatttcatgagacagagaaaatacttaaaaactgcaagttccccaccccattcccttcttaccctagactatgctcaaatcgattgtgtgaagctcctggaaaaacatagtaaccacctcccagctgtttgatgtatcgaagacgttgaaattgaggtgtatcaatgattcggacgaggagagggtggagctcaatgtggccatggataggatcattaattacctagaaaattatgtttaattaatacaaataacgacatgtaagtccaactgaaatttgtgtgcagccattcctaattatagtgcaaagtcaaagctatttgatttttcaagtaaaaatactaacggaaatgacaagatgttaacatcattaccttatttaggtatcactaccagacagatcaagtatattggatttgagtatattttacttcttcctaatggatgtgaataacagaaaaataaggattttgattttttattatgtatatgacttagtctttaataagtttgtcttgtattcaagttaaacatgcatattcatttcgatttaaacacattcatccacatcatgtaacccatatcactataggtattatgtctaatttttttttttttttttgagacagagtctcactgtgttacccaggctggagtgcagtggcacgatctcagctcactgcaacctctgcctcccaagttcaagctattctcctgcctcagcctcctgagtagctgggactacaggggtgtgccactatgcccagctaatttttgtattttgagtagagatggggtttcactatgttggccaggctggccgcgaactcctgacctcaagtgatccgcccacctcggcctcccaaagtgttgggattacaggcgtgagccaccgtgcccggcctaaatttttttttttctaaatgtatctatacagcactcatcattaaaacagaaaagaaagaagggaggcagggaaagaaagaaagatggaaattcctctaccatatagataagaaatcatgcaggtccgagtgcaggtgctcacatctgtaatcccagcactttgggaggccaagagtttgagactagtctaggcaacatagtgagaccccatctttaaaaacaaaaatgcagtggcgcacatctgtagtcccgggtactctagaggctgaggtaggaagatcccttgagccccaggggatcaaggctgcagtaacctactattgtgccacaacacttcagcctgggcgacagagagaaactctgtctcaaaaaaagaagaaaaaaagcaagaaaataattttgtacagctgaacaatgtgtttatgtgtgtgtgttctttttgttttgtttttcttagagatagggtctcgctttctcaccaggctgcagtgcgttggctattcacaggcacaatcatagcttactgtagcctcaaactcctaggctccagggatcctcctgcctcagcctcccaaatagctgggactacaggcatgtaccaccattcctagctaatttatttttattctttgtggagacaaagtcttgctatattgcccaggctgacctcgtgtccgcccgcctcagcctcccgaagtgctggaattacaggcatgagccaccgcgcctggctaaaatctacttttaaaccatttaaggacctaaaagccttcactgtaaatttttcaggttgtaataactgtcttttttgtttgtttgttttttgagacagagtctagctctatcacataagctggagtacaatcagggctcattgtaacctctgcctcccaagttcaagcgatcctcccacctcagcctcccaagtagctggaactataccacgcctggctaatttttctttttttggtagagatggggtttctggcagggcatggtggctcatgcttgtaatgccagcactttgggaggccaaggcgggtggatcacctgagatcaggagttcacgaccagcctgaccaacatgatgaaatcccgtctctactaaaaatacaaaaattagctgggcgtggtggtgggcgtctgttatcccagctactcaggaggctgaggcaggagaatcgcttgaacccaggaggcaaaggttgcagtgagctgagattgtgccactgcactccagcttgggcaacagagtgagactctatctcaaaaaaaaaaaaaaaaaagattcattgatacatttgaaaaattagtcctcattatgtcaaacactgcactccctcttcaccattacacaatctcagcttcagaggccaactgaactaaatttagcataaagaacactgtgtcaagaacaaaccatggtgaccttgggttcggcaatggtttcttaaatatgacactaaaagtacaagacacaaatgaacaaaaaaaatataaattggattacataaaaacttaaaacttttgtgatccaaagaacaccatcaaaaaagtaaaaagacaacccacagactgggaaaaaatatttgtgtatcatatctcccataaggatttacatccagaacatataaagagctcttacaactcaaatcaaattgtgtgtgattgaacaacactgtgaactttctaaaaagcactgtcttgcatactaaaaatgagtgaatcatacaacttgtgaattatatctcaataaagcatttatgttttaagtatcaagttaggtaggtatgaaattagggtagaaatccttgaggtctgcaactgagtagcaaactaggtcaattcttgttgaactgcattgctgatgaagttaaattcatttaaggtattgatttcattactaagccgtgattcagtagtttgaaaatctatttccaacaactgtcatttataatttataaatgaggttaaacaatgttggtttgtttttttttttttttgagacagggtctcactctgttgcccaggctggagtgcagcggcgtgatcatggctcactgaagcctccacctccccaggttcaggtgattttcctatatcagcttcccaagtagctgggactacaggtgtgcactaccacacccagctaatttttctattgttttctattgtttgtagatggagtttcaccatgttgcccaggctggtctttgaacttaagggctcaagtgatccacctacctcagtctcccaaagtgctgggattacgggtgtgagccaccatacccagccaacaatgttctttttacagaaaaatagaaagaataaaagtgggcaattgaaaccactgactgccttaaatattacctcaaaaatatattattggctgggcacggtggctcatgcctgtaatcccaaaactttggaaggccgaggcaggcagatcacgaggtcaggagttcgaggccagcctggccaacatggtgaaaccccgtctctactaaaaatacaaaaattagccgggtgtggtggcatgcactggtaatcccagctactcaggaggctgaggcaggagaattgcttgaacccgggaggcggaggttgcagtgagctgagatcacgccactgcactccagcctgggcaaccgagtgaaactccctctcaaaacaacaaaacagggacaggcacggtggcacgtgcctgtaatcccagcactttgagaggctgaggcgggtggattatgaggtcaggagatcgagaccatcctagctaacgcggtgaaaccccatctctactaaaaatacaaaaaattagctgggcatggtggcatgcgcctgtagtcccagctactcaggaagctgatttaggctgaggcaggagaatcacttgaacctgggatttggaagttgcagtgagccgagattgcaccactgcactccagcctgggagacagagcaagactccatctcaaaaacaaaacaaaacaaaacaacaacaaaacattattatatagttgaaccaaaaatgttcattaaattttttcagatgtgattttcaatagaaaataagcctagaacgggctggtggctcacgcctgtaatcccagcactttgggaggccaaggtgggcagatcatgaggtcaggagttcaagaccagcctggccaacctggtgaaaccttgcctctactaaaaataccaaaaaaaaaaaaaaaaaaaaaaaaaaaaattaactgggcgtggtggcaggtgcctgtaatcccagctactcaggaggctgaggcaggagaactgcttgaatctgggaggcagaggttgcagtgagctgataccatgccactgcactccagcctgggcaacagagcgagactccctctcaaaaaaaaaaaaaaaaaaaaaaaaaagaaaagaaaagaaaaagaaaataaccgggtaggccagacgtgttggctcatgcctgtaatcccaacactttgggaggccaaggcagacggatcacatgaggtcaggagttcgagaccagcctgaccaatatggcggaaccctgtctttactaaaaaaaatacaaaaactagctgggcatggtggtgtgcacctgtagtcccagctacctgggaggctgagacaaaagaatcacttgaaactgggaggcagaggttgcagtaagccagattgtgccactgcactccagcctagacaacagagcaagactccatctcaaaaaaagaaagaaagaaaagaagtctataacttgcaaaagcaaaattaaaatatgtattcttatagagagggatctgaaataactcaaatactatacattacatctattttttaaaaaaagtgaaaaatgcaaatgatgatcgggcaaaaaagtacaaaaaaagaagatatcctacatcttctcccaggtctgaaactaagttttcttaacctaggaatgtcaaaagagtaaataaggtctatttcctgtcactaacaaaacaagaaacatttcatcaagtatggttttagaatcactctgaagagcttgtgaaaaatgcacattctggctgggcgcagtggctcatgcctgtagtcccagcactttggcaggacgaggtgggtggatcacttgaggtcaggagtttgacaccagcctggccaacatgatgaaaccccaactctactaaaaatgcaaaaacattagccgggtgtggtggtgtatgcctgtaatcccagctacttgggaggctgaggcaggagaatcacttgatcctgagaggcagaggttgcagtgagacaagatagtgccactgagccccaacctgggtgacagagagagattacatctcaaaaagaggaaaaaaaaaaaaaaaaggccaggctctgtctcaaaaaaataaagtttaaaaatatgtaaaacaatactatacattgtttatggatatacataaatatgcaataagagtaaaaaccattcatgacaatgataaacatcaaattcaggaagatgcttattacttctagggagaaaaggatagaaacataataaatagaaacagggccaggcgtgggggctcacatctgtaatcttagcactttgggaggccaaggcaggtcaatctcttgagcccaggagtttgagaccagcctgagcaacacaggaagaccccgtctttataaaaaatacaaaaattagccaggtgtggtggcatgcacccatagtccaagctactggggtggctgagatggaaggatcacttgagccagggagacggaggttggagtgagctgagattgcaccactgtactccagcctagatgacagagcaagaccacatttcattaaaaaaaaaagaatgtacaaaggaggtcttcaatagtttctaatattttgctctaaaaataacagacttgaagcaaattaggcaaaatattaatatttgacaagttgggtagtggtctacttatgcttttctgtatgcttaaacatattttagttcttcttctgatttaaatactctgtgctcattttagaaagtgcagaaagtttagaaaagatccactactcacaattctatcactgagaagcagatttcctcctattctcttcaaaatgaattttacataattgagttatatcactttatattcaaaaaacataacaaactcagatcctcttaccttcattgtatcaacgtggatttgaaccaatcgctggatataactaagcagcttcttcctctcccccaaggaactaaaattacaataggataagcaagtctatcattatttgcttaataataatccctgcagtatatagtagacataataaactttatattatctacactaacagaagttagattggaaggaacaatcaataattcaaacatacccctcctagaaactctctccttcctttgctgttaagatagggaactctcctgctgaatcaatataggcctcccacagccttctgtccttgaccctcctctctcttggtaaatttaagacttgaaaaactccacatctccatgtctactcaatgctcaaactgtacttccttttaaccaaactgaagtcaacatctaccctcataatcctggattgatttatgagcaccaggtatgactcaagcatgaatgaaatacatatgaaggctttaactttatttatattcattttccattgtcagtactccctcacaatgctccagtttcaagaaaatacataatgggaattaaatttgagcagctcgaagtcctgtgattcattatcctgcttcatttacaattactagttgggcccagcatatcatcctccctcctggctgggtgtcaacagagagtgcaggcaaagggttttactgatctactagataaccagattgaaaaaaaagtatctttctacaagtcatacatagactgggagtcagaggcactacattggcctctatggtacacactgaacccatggtaataagaacacttaagaataatatcttgggatacacagaagcattattacagctgataaattaaagcagcaaatttcgtgttttcctattcccctatcctcctcatcagtttgacataacaagcacagtgtaaagccaggctttcagaagtacttataggtggacttagtttaaggggagtcacatagttgagcaaaaccggagtcatagcataaaatatcaaacctaaactaaccccgtgaccacttaatattttcctaaactgacatttggtattcatcgcttaaaaccccaaaatcggccgggcgcagtggctcacacctgtaatcccagcactttgggaggccgaggtgggtggatcacctgaggttgggagctcgagacaagcctgactaacatggagaaaccccgtctcttctaaaaatacaaaattagccaggcgtggtggtggcgcatgcctgtaatcccagctactcgggaggctgaggcaggagaattgcttgaacccgggaggcggagattgcggtgagccgagatggcgccattgcactccagcctgggcaacaagagcaaaactccaactcaaaaacaaaacaaaacaaaaccaaaatcactgattagagtatataaaaccacccaaaaccagggggttgttttgtttagcaaaggacatggcattaaataaagatttaaagaagtcatgggccaggatatctagattatgaaagaattttattcctgtgttccaacatttctgaaatttaatgcttcttacaattgacatgtatatttaacgtgacaatgtttctatctaacttctttttttttttgaaatggagtcttactctgttgcccaggctggagtgcagtgacgtgatctcggctcactgcaagctccacctcccgggttcacgccattctcccgcctcagcctcccgagtagctgggactacagccgcccgccaccatgcccagctaatttcttttttgtttttgtatttttagtagagacagggtttcaccatgttagccaggatggtctcgatctcctgacctcgtgatccgcccgcctcggcctcccaaagtgctgggattaaaggcctgagccaccacgcctggcctgtttcttacttgttaaaaaaacctttataaatcaatggttgttcataaaattgagggcctactaggagtgcttgtctaagctggattctccctagaaagcagggtccaggataagagcttgcaagtaattaatcttggggtgaactctgggcacagggattggggggtctagggagggtaaaataggaaattaggtaaaaacagtacaaaggtccattaacaagttgattgcattggtactactgtgagcaactggatggagtggtgggtagggctaatcccactggcaacctgtaaggcagcactgtctagtagaactttctgcgatgatggaaatgttctatatctgctctgtccaacacagtagccgttagccatagtgactactaagtacttgaaatatggctagtgtaactgaggaattttttacttaatttacttctaattaatttaaacgtgaagctagttgttattatacagaacaatacagctctaaggagtcctacagaatttgagttatgaggtggggcacagagacgtgcaatatagtgttccttctggaacactgcaatatagtgttcctttgtctgttttgttcactcatgtgccccaaattcatggaagaattcctagtacatagtgagctttccaaaaatattcactgaatgaatcaatagcacttgggtccacaaacatgcacatggctcccttgaaaagaaagactgtattagaacaaattccattcaggtcaaatagtaagcaactattatgtacaagaaacaagtagtaaaggggactttgagaggactgagagggctgaaatgtggttatgaaagagtcatgccggggacagtggctcacgcctgtaatcccagcactttgggaggctgaggcaggcagatcatgaggtcgggagttcaagaccaccctggccaacatagtgaaaccctgtctctactaaaaatacaaaaattagccgggcatggtggcacacacctgtagtcccagctactcaggaggctgaggtggtagaatcacttgaatctgggaggtggaggttgcagtgagccgagatcacgccactgccctccagcctgagtgacagagcaagactccatctcaaaaaaaaaaaaaaaaaaaagaactttgggaggcctgaggcgggcagatcacaaggtcaggagattgagaccatcctggctaacacgatgaaaccccgtctctactaaaaatacaaaaaattaaccgggcatggtggcacatgccagtagtcccagctacttaggaggctgaggcaggagaatcacttgaacaccactgaacttgaactccagcctgggcaacagagtgagacttcgtctcaaaaaaaaaaaaaaaaagaaagggctaagatgaggtccctggagattctgatccaaaggatatttactggaagtcagttaaatgttctacagtgatcttgtttcacaatgtacttctgttatcaattactaagcaacagcacaggaagtaattcagtataatcctttgttttgattctttggttactgttaccacaaacaacatgtaactaaaatttcagaagagaaggccatatttccccactgttgccaattttctaacagaaacaaaatcttcattttaagaagtatttaaggccggtcgcagtggctcgcgcctataatcccagcactttgggaggacgaggtgggtggatcacctgaggtcgggagttcgagaccagcctgactaacatggagaaaccccgtctctactaaaaatacaaaattagctgggcatggtggcgcatgcctgtaatcccagctactcgggaggctgaggcaggagaatcacttgaacctgggaggtgaaggttgaggtaagacgagatcgtgccattgcactccagcctgggcaacaaaagcaaaactccgcttcaaaaaaaagaagtatttaagcaccagatcctctactgagatcattaaaggagccccactctaatctagaccctagaacctacagccatacacagagatggatctatgtaactatgtatgtatgtatgtatatatgtatctatctacctacctacctatctgagacagggtcttattctgctgcccaagctggagtgcaggagcttatcatagatcactgcaaccttgaactcctgggctcaagggatcttcctgcttcagcctcctgagtgtaggtgggactacaggtgcatgcacagtacccggctaattttttaattttctgtatcactatctataaaatttactaagcgttaatcatatgcttcaacactttatgtacatcatctcattattgttatccattttacaggtacagaaactgaagggttaaatgacttctcccaaattatacaactaaaaagtgcctgttttgcatagtgtctttaaatctaataccagggcatattccaatctttaggaaaacctagaaatatgctcaagataggggtgtagccttgattttcttactaacatttttttccctattggttcttatgtatttcccagtgtgtataattcaattattctgaacttgagagtaaaaagttggtcactacaaacttgatgaagatttgtctgcaacattatttaaaataggaataaggccacacacggtggcttatgcctgtaatctcagcactttgggaggccaaggtgggcagaccttggcccaccttaggtcagaactccagaccaccttaggtcaggagttcgagaccagcctggccaacatggtgaaaccctgtctctactaaaaatacaaaacttagctgggcatggtggtgcatgcctgtaatcccagctactcaggaagctgaggcaggagaatggcttgaacccagggggttcagtgagccgggatcgcaccattgcactccagtctgggtgacagagtgagactctgtctcaataaataaataaataaataaaattaaaaataaactaaaataggaataaacagtaatagcaaacataggatttgtacagcgaaaacaaacagcaggtggccagtcgcggtggctcacacctgtaatctcagcactttgggaggccgaggcaagcggatcacttgaggccaagagttcaagaccagtctggccaacatggtgaaaccccatctctactaaaagtacaaaaatcagtggggcagccgggcgcggtaattccagcactctgggaggctgaggcgggcagatcacgaggtcaggagattgacaccatcctggctaacatggtgaaaccctgtgtctaccaaaaaatacaaaaaagtagccaggcgtggtggcaggcgcctgtagtcccagctactcgggaggctgaggcaggagaatggcatgaacccgggaggcggagcttgcagtgagccaagatcacgccactgcactccagcctgggagacagagcgagactctgtctcaaaaaaaaaaaaaaccgaaaaaaaattagtggggcatggtggtgggcacctgtaatcctagctactcaggaggctgaggcaggagaataacttgaagccgggaggcagaggttgcagtgagccgagatactccagcctgggtgaacaagagactatctcaaaaaacaaatgaacaaacaaaaccagcaggcaagggattctgctgttttaaagcacttcatagatttaaaatgaggacagtttatatcagagattttgggctttgtccctgaaagatggataaagtgtgtttggttataacgtgaatttatttcttcattcttaccttactccaagattttcaaaacgagactcatcaagacaaggcagtaatgcgcctgtgatttcattttctatggaagaaaaaagacaaattcaatgtatacaacatatgcttttcattttctttcaatttggatacaccaacatttacccagatccacataagtgagtacccactgcaggcaatggattgtgccaagtaccacttttttgatctgctacttgtaaagacttaattttaattaaataactaaaccaagaagcattttttgataaatcacgtgaaaatttcaaaattatttgtgtaaattagttccaagaaaaaccagttgcaaaaaggaaagtgaaacccgactacctgttggggttttgccaggtcagcagctttgagttggggagggaaggaaacctaagtctattgttcttagaattaacaaggtttgagttggggagggaaggaaacctaagtctattgttcttagaattaacaagttaaaaccgtgaattcaagagtgcttaaagtgttgatttttctcaaacctcctgggaaagcactcaatactctgatttggaagaggtgtgtgtgtgtgtgtgtgtgtgtgtgtgtgtgtgtgtgtcctgggaaagcactcaatactctgatttggaagaggtgtgtgtgatttggaagaggtgtgtgtgtgtgtgtgtgtgtgtgtgtgtgtgtgtcctgggaaagcactcaatactctgatttggaagaggtgtgtgtgtgtgtgagtgtgtgtgtgtgtgtgtgtgtcctgggaaagcactcaatactctgatttggaagaggggtgtgtgtgtgtgtgtgtgtgtgtgtgtgtgtgtgtgtgttgttgggttttttcctttctctttctatacaattaattctaatctttcctgacctcaaattccagaactctggactattttcttttattttctttgagacagggttttgcttgttgcccaggttggagtgcagtggtgcgatcacatctcactgcagccttgacctcctgggctcaagcgatcctcctgcctcagcctcctgagtagctgggaccacaggcatgtgccactgcacctagctaatttttatttttattttttgtaaagttgaggtctcctgatgttgcccaggctggtcttgaattcttgggctcaagtgatcttcccacactggcctcccaaagtgctgggattataggtatgagccactgggccaggcctccagtggtttttgatgagaatacttgttaaggtatagatcacatgagttctagagtccaaagacctaaccttaaaaaatctagctcttttttgtagtggtgtgatctctgaaaagttactttacatctttggacctcgcatacatcatcggtaaaatgtgttgagtgtagtaacttatttcagacttcttgtgaggctgtattccataatgagaaaagggacactgtaccttgtgcttggcttatcaaattaaaaaaaaaatggacttagataaagagagactttttttttcttttccgagatggagtctcactcggtcgcccaggctggagtgcagtggcgggatcttggctcactgcaacctccgcctcccaggttcaagtgattctcctgcctcagcttcccaagtagctgggactacaggcacataccaccatgcccggctaatttttgtatttttagtagagacggtgtttcaccatgttggccaggctgggcttgaattcctgacctcaggtgatctacctgcttcggccttccaaagtgctgggattacaggcgtgagccaccgtgcccggccaagagaaactttattagaaagaaagactattgctggtcgggcgtggtggctcacacctgtaatcccagcactttgggaggccaaggcgtgtgaatcatcaggtcaagagattaagaccatcctggccaacatggtgaaaccccatctctactaaaaatacaaaaattagccaggtgtggtggtgggcacctgtagtcacagctactcaggaggctgaggcaggagaattgcttgaacccgggaggcagaggttacagtgagccgagatcacaccactgcatttcagcctggcgacagagcgagactctgtctcaaaaaaaaaaaaaaaagaaaagaaaaaaagaaaagaaaagaagaaagactatttctacagggagaaagctccaatatcagatatctgcaagaggctcaggaatcaaacacataggccggccgggcgcggtggctcacgcctgtaatcccagcactttgggaggcagaggcggatgcatcacctgaggacaggagttggagaccagcctggccaacatggtgaaaccctgtctttactaaaaacacaaaattagccaggcgtggtggcgtgcacctgtaatcccagcaactagggaggctgaggcaggagaaccacttgaacccgagaggcagaggttgcagtgagctgagattgtgccggtgcacttcagcctgcgtgacagagcgagactccatctcagaaaaaaaataaaataataaaataaattttaaaaaataatcaaacagaggcccaagaaccaaacagaggttgggcatggtggctcacacttgtaatcccagcactttaggaggccgaggtgggtggatggtcactcgaagccaagagtttgagaccagcctggccaacatggcaaaaccctgtctctaattaaaaaaaaaaaaaaaatgaggccgggcgcggtggctcacgcctgtaatcccagcactttgggaggctgaggcaggcggatcacgagttcaggagatggagaccatcctggccaacatggtgaaaccccatctctactaaaaatacaaaaaaattagctgggcgtggtggcacatgcctgtaatcccagctactcgggaggctgaggcaggagaatagcttgaaccaggcagttagaggttgcactgggccgagatggcgccactgcactccagcctggcgacagagcgagactctgtctcaaaaaaaaaaaaaaaaaaaaaaaagaatccaacagaaaaagggtcttcttttatatgataaaggacgggcaagcagaaataagcagaatctttggataggaacctggacgagcaagggaaaatgagcagtgtagcccaacaggacagcatcctactgtggtcagccggttctcaaaagaaactgaccagagggaggcatattccactgctttagtgcctgcctggtcagatctgggggtaagcaagagttgaggggcccataagggaagagagaagtccgaataaagtttggtcaagacaaagcagaagctaagacatgagcaattgggaacagttggtcagtttttaccaaatgaaagcacatagtgtctttgatagcaataggttgtaggtttaaggaacacacatcattctggagggtaacgagttaatctacaaaccactgaaacagagagccaaccacattttgagacagaaaatatggaactacttcactccacttgttgctagtcaaagaaaataaagtaataatccatcccagcagtggagggaaacgaaagggcaaaagggggaagaaaaaaaaaaaaggagaaatgcaatttcccatacccattcaagctatctttgggtcctgaaccactaatgttcctcctaccccagtttccaacctagccaaacagggccccacctaacaaatgcaaaaatttactaaatttgcaaatcccaaccaccaaagaatcaccttcctattggacacctagaggatataaggcaggagtcaaatctcacacccaccacaaaaagttgagtagaattcacaaggatggatgcttggatacgaatcagtaaaatatgattaaaactcaacctaaacacttctccaggggatgtggccaaactgtggcatgctggggattcagtggtcaactgaacaaccccaaggttcagattttggaggggaacctgcttttaaagagcaaaacatgttccttaccatgttctgcaagtgcagtcaacacacgcctatcgggcgctgctgggatgccaaggaaggtgatgggaattcagagattaaccaagccagttccttccccttcaggaaaagcctcaattcagggaggaaaccgaaacctaaaagccccagaacatcctctgatgtggcaagtgttcaaggagctgcggttagcgcggaggggtcccgcgagcctggatgacagcaagccgcccaccaaggtctggggaaaaatctccttctaactaaaaaaaagggacccgagtctcgcttgtcccgcgccggggtggcaagttagtgaagaaacccacgagagtgagatcccaatctacgactgcccctcccaggtcctcaatcccgggagcctgctcccatcctacgaatcgcctatcccaggcgaccccatgtcttcttcctccgcctcggggagtcagtcccgggagccccatgccgcaggccctcctgggaacccccgccgcagggctccctcccccgcctcgggtcttcctttcctcggcgcccccagcgcaggtccgccctcccgggtgcctcccgccgcagggctcgctcctcggcctcggtcctctcgtggggccccctccctcagggcgcctggcccgcgccccaggtcgccgcccttcgcccctcagcccctccggagccgctacctcggatgttcttcagcagcaccggctcttcaaagccaccgcgcctgaggaaggagcacacctgctccggaccccatgtcttgtagtcgggatggagttccaggcccggggaccagtctgcctctgcggaaggggtgtttgagggggttctcgggctgtcatcgcaacggggacgcttggagggctgctcggaatcggctcgctgcatggctacacctggcgtccggcacagcagtcaagaacctcggcgccggacccgcgcgcaggcgcactgacagcagggccctggcggggagtccaaggagtattggcagcctattggcctcctgcgcaggctcactgacagttgagcccttcgggcagggcagcctagcggctcttgccttgggctccctgcgcaggcgcaat

SEQ ID NO: 1968 - DNA, 7899 bp, Homo sapiens
  source 1..7899: mol_type = genomic DNA
aataaacataagagtggttttattgattacatacaattttagctatattaatatatattataaactttaagaattagaaataagtgacttttattttttaaccaagaataatctaagttatggcagcatgttcaatgaaaggtaagtccggcacaatttttctatatctgtttctcagataatcaggaacatcatccaagctttacattacgataccataatgaccctcagaacacaagttccattaagtagaaatgaagcatcatatgttttcttttttaggaaagacccccccttttgttgtatagacatacccctaataatcttactctactgtacaaataacttttcacccacaagagctgcctcaagtaactttcattttggaaagctatcaaggcatgagacagagtagcaaaatgccactctggactttgcatcttggagtttcaattttgctttaggatttagaccccagtttataattaaaaccaaatcattcccacattattatacttatgtaggaaagccttgctgtgtccactgttaacacaaagatagaaaatgtcaaatagtttaagcaagtatttggcagaccacagacatgaaacagtgccgtcggaaacggaaacactttagtgttttagaggtgaagagattgatgggtgtcattcaaatttctcatctccttcttctacatctttcagattgagtacttccaaagaacctttgcctttagtttccttttttattagctcatcaatttctcggaagcagcccgggtcaatcagacatacctgaaacatttaacgtagcagattaccacatgaggatgagcaagacacagaataaactcagctttaacttcctttgaggcaagcacaatgctgtccagatctctaataataccacagttctatggtgcaatagataagacaatgggtagggcggcacactgggttccagtttagcctctgccctcaagtgtccatgtagccccctgtgacaaggcattaatccctatgtttaaacacttattctgattcttcagctgtaaatggaagggacaaactagaaaactctgattcttctcatactaaaatttagcattacattttatagctcagtaaagtcacctccacgtatgaaggagaaaaagcaatgtgaagacttatgtagacaccatgtgtatgttaatttatttttttttgagatagagtgcagtggtgtgatcttggctcactgcagcctccgcctcccaggttcaagtgattctcctgcctcagcctcccaagaaactgggattacaggaacccaccaccacacctggcttattttttgtatttttagtagagatagggtttcaccatgttatctgctcaccttggcctcccaaagtgctgggattacaggcacgagccactgtgcctggcccatgtgtacagttttgcaaagattttagaacttcaagtagtgtcagatgagttagttcacatctacagtggatactcacatactcaacacttctctacagctcatttacttttaaaaagaagctgcagacagggcgcggtggctcaagcctgtaatcccagcactttgggaggccgaggcgggtggatcacctgaggtcgggagttcgagaccagcctgaccaacatggagagaccccgtctctactaaaaatacaaaattagctgggcgaggtggcacatgcctgtaatcccagctactcgggaggctgaggcaggagaatcgcttgaacccgggaggcagaggttgcagtgagctgagatcacgccattgcactctagcttgggcaataagagtgaaaccctgtctcaaaaataaataaataaataaataaataaataagctgcaaagccttgaaaacatgaatttgtagacagctcaatttacactgtgtttgaagctgtggggtgaggtcataaggacataatggtttcgctgcttctttaaaatgttctgtgtttagtgtcaccaggttcacacactaatatcctctggaaacaccctcacagacataccccaaacaatgctttatcaggcttctagggattcctttccagtcaagttgacacctaaaattacatccacaattccaccccttatcaacttggcacccagactcatctctttaaaccatttttaattttcaaatgaagacaataacaaggtcctagcttttcctcacatgatgcaattaaccagacgcgactatcctgcatacaactcaaagagtgctaatccttttgccagaattcagctttcagaatttcatcattcagaattcaatcttttttttttttttttgagatggagtttcgctcttgttgcccaggctggagtgcaatggtgcaatcttggctcaccgcaacctctgccttccaggttcaagtgattctcctgcctcagcctcccgagtagctgggattacaggcatgtgccaccacgccagactattttgtatttttagtagagacagggtttctccatgttggtcagactggtctcgaactcccgacctcaggtgatccacctgccttggcctcccaaagtgctgggattacaggcatgagccaccgcgcccagccaggattcaatcttttggaactgtgattttcaagatattagaagttcaggctttggactttagagattttgatttttttatgatttcaacattgggattgtggcatttgggattgtcttttaggattatgatcagcactggagtaaagcatgcaattgagctatctctgaaaactcaatgtaaatttccatagtgtgctttgtactaatttttgcaaaatttttaaggtaattggaattatcaatcttccactaaaatagcaatttttaagtggcttattttaaatagttgctaaatttgctaaaatcatgtatctaaaacactacgcataatatatgacaaaaataaatgctgggaaaaaaataaaaggatttgtggtaaacaaggctgaccaacctttagtcttaagaaaatatctggctgggcgcggtggctcacgcctgtaatccctgcactttgggaggctgaggcaggtggatcatgaggtcaggagatcaagaccgtcctggctaacacggtgaaactccgtctctactaaaaaatacgaaaaattagccaggcttggtggcgggtgcctgtagtcccagctacacaggaggctgaggcaggagaatggcgtgtacccgggaggcggagcttgcagtgagctgagatagcaccactgcactccagcctgggcaacagagcgagactccatctcaaaaaaaaaaaagaaaagaaaatatctgacgtttacaacatctaaatgtttgctacaaatttattactagagaatacaatatttaggtaacatgaagcaaagaaaatatttgactcttacgatttctaactgttggccataatcttcactttctatgaccttgatcagtggcttgagcttttctttcagcttcttgccttcattgactggaaggatgaaccgaagcctcatgtgagcacgttctatcttcattttctcttttaactgctttatcacttccaaagcctaccaagacaaaatcgagaatgcaatttcttctactatattatttcataaggttttcaaaaacaaagtagtttccatgtagttggattaggtaatggtttcttaggtataacattaagaacataagtgaccgttaaaaaaaaaatagaaaaattggacttatcaagaagaaaagcttttgtgtttcaaaaaactatgaagaaagtgaaggccaggtgtggtggctcacgcctgtaattccagcactttgggaggccgaggcgggtgcatcacaaggtcaggaattcgagaccagcctggccaacatggtgaaaccccgtctccactaaaaatacaaaaaaagaaaaattagccgggtgtggtagtgcacgcctgtaatcccagctactcaagaggctgaggcaggagaattgcttgaatccgggaggcagagtttgcaaaaagagggcggggggggtgggcaaagaacctgaacagagatttctcaaaagaagacagacgaggcaccaataagcacatggaaatatgctcaaatcatcattaaggaaatgcaaatcaaaaccacgacaagataccaccaggatggccatcatcaaaaaggcagacaatgacaagtattactgaggatgtggagaaactgaactcttaaacactgatggtggtaaagtaaaatggtgcagctgttttagaaataggtttggtagtcaccaggtatacagaaatgaaaacatatgtctacacagaaacatacaagaaattttatagcagcattgctcatcatagctcaaaagtgaaagcaacccaatgtctatcaactgatagatgaatgaacaaaatgtgtttctttccgtacagtgggctattattccggcataaaaaagaaatgacatgctgatgcaggttacaacatgtatgaaccatgaaaaggccacatattgtatgattccatttatatgaaatgtccagaattgagaagtccataacgagaggagattagtggttgggaggggcctgtggggggaaaatgggggatggctactaatggatactgactttctttttgtggtgatgaaaatgttctcgaaccaggtagcagggaaggttccaaaactttgttaatataccacttaaagtgtacatactttatgagtgtgaaatttatggtatgtgaattatatataaattaaaaaattcaaaaagaagtgttaaaatgaccctttaaaaactcaagttttgtctttaaaagtttgatttggataggaagaagaaagtcctatatacatatttgtgtttacttgaaaaaaaaaaattacctatctttacaaccccgtccttttcctccatctcttccccaaacctctacccacttgcttccatgcagacccatttttttaaatttaattttttatattaaaaaatttagaggtagggtacggtagctgatgcctgtaatcccagcactttgggaggccaaggcggacggatcacctagggtcaggagttcaagaccagcctggccaacatggtgaaacctcaactctactaaaaatacaaaattagctgagtgtggtggcacgtgcctataatcccagctactcaggaggctgaggcaggagacttgcttgaacgcgggaggtggagattgtagtgagccgagatcatactactgcactccagcctgggcaatagagtaagactctgtctcaaaaaaaaaaaaaaaaaatttagagatggggcgtccctatgtttcccaggctgtttccaggcctcaagcaatcctcccatcttggctcccaaagtgctaggattacaggcatgaaccattgtgcctggccccagacccattattttaatgatttcttcagagaaaactgatttccatggctatattttgatgacatgagaaaccactcacctgctgttttgtactcttgttggttttcaccgaatagtggatgtccttcatggctctctcaataaggatcacggtgtatggtctctttgtttcaggattcacacatttgtctgccacaatagttgcaatgtccctaaacatctgctccagttgtgtgtgtctttctttatctgatacttgaacttctcctttagtcaaaatctaaaaaaatgccaacacatttaagaaatcactatctttctctatcacacactatttattaactaaccataaaaaatgagtaactggatggagagaaaattaaatttcatcctctccagctatcaatatgtaagtaatggtttgagctttgcccaaaagatgcaagaatcttttggctgggctcagtggctcacatctgtaatcccagcactttgggtggctaaggcgggcatatcacccaaggtcaggagtttgagaccaacctggccaacatggtgaaaccccatctctactaaaaatccaaaaattagccaggcagggtggtgggcacctgtaatcccagctaccctggaagctgaggcaagagaatcgcttgaatccaggaggcagaggttgcagtgagctgagtgcagtgaagtgcactgcactccagcctgggcaacagagcaagactctgtccccccacccaaaaaaaaaaggatctgaaagatgaaatacttgaaaacaaattcagttttcaggtataccacattctataaatggggcaatttatagaaaaatgaggtaatttagtagaaaatctgatttcaggaggttttggcaaaaaaaaaaaaaaaaaaaccacaaaaaacaaacaaaaccaccaagttctttattattagaagtgacactgtgcagttcacattattgcttggttagtctttcctccagaaaaacagcctttaatgtttaatatatctacaaatacgttataaatggttattagggttagctatgctgcagctgttacccacctgcttacagatttcagtttggtcatctgttccaaacgcactgatgagatcttcctttttggcaacctgacctttagaaacatttacaaacactgagtgggtctgcagaacttcatcgaggtctttttcccttgtgagggcaggagagaaagtcctatgtgaatatacttgaaacttggacatgcatttacatttaaatacgagatggcaacaacatgaacggcaagacacaacaaatccccctgatgacctttagtgtagagggcagttttctttttcttaccccccaacccccgcccctagatggaatttcactgtttttgcccaggctggagtgcaatggcgcgatctcgggtcactgtaacctcagcctcccgggttcaagtgattctcccgcctcagcctcctgagtaactgggattacaggcatgcgccaccacacccggctaactttgtatttttagtagagatggggtttcatgttggccaggctggcctcgaactcctggcctcaagtgaactgcccgcatcggcctgagggaacattttcaaaactcagaaccgtatttgccttaccatttgctcactggagaaaaatgtcatgggaggacgtaagaaacacaagggtggggtggggtgcagacagctgctgccacggaatgccagtccctagatggcagcagtgaagacactacgcactttaaactgctagggctactgagatctatgacaccagatgtacccacaactatgacagtattcgtaagactaggttctcagccatcattattctaggaaaaggaccacaattacgagatttcttggctgcagcttttatgacaccaacaaaacaaaaccccaaaccaacaacccaatccgaaccaaccaaataaagaagaaacccttggcttaggcgccaagctcggacagcgacgtctcatgctcacagcaggaatgttccatttcctccccggccaacaccccagcctggcccattcactcgacttgggcagagacaggccgcctcggaggtgacggctcaggcccaggcccaggcccgagggagggggctactcacacgccgctccgccagccgacgaccttgtttttgtagcaggcgatttcgaagcgcttcccggcacgcttcatccgtaccacggccacattggttaggcggatctggttggtgggggtgaagatcgacatcgcggctgttcaaagacccagaagccggcgaaccagggctgacccgcgccgtccagcctgaaggccaccagcgcctcgcggtaacgaccgatcggcgcgcggcactgacccaaccaccagtgcgcggcgccgcgactcactagcttcaggcagccgtcacagtgtgtctggcaggcttacttac

SEQ ID NO: 1969 - DNA, 26879 bp, Homo sapiens
  source 1..26879: mol_type = genomic DNA
attactaagcatccccgtctgagtgcaagggtgtgtgttggcagtacagccccaatcttgcaaaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtgagtatgatacggtggacatgggcctgctgagggtgtgggcggtgggcaacagcagctggggccagggtggaggccgaggcaggcaggggcgccggcgttagcagctcgccgacgcctcctccgtggcccaccctcaagtccagcccagggccgtggtggaacacactttcgcctcaatccctcgctggggatttcattccctgggcctcctgctctccagaaggccctcaccagagccttttggggcagctgcagagaatgccatttcgggtggtgaaatgtggtccacagtttaccttcgctccgggaaagacccaggctccccacttccattttgacccctatcgggtggcgccctgcgagccttactctagctctctttaaacgacttttgaagtgtcatcccaaaggaagagcatgacattcagagagaggaggcacattaagaaacagagtcaattactttaagaatgcaatgccagttaggtcgagatgctgagagaggagggggatgtgtgtcagtaaaatcacctctctggatctgctgatgtagcatcctttagaaaagtagtggggggtggggaggggcaggggatttcagaaataggacccttcttgataaacgttaggactcacaatagtcttaaagggaatggagggaaaacacccttgttatgattcagctttgccatttgcctaggcatgtctcattctaaggcttcattttgaatcaaattcatctgcgtctttgctccagggctccggagtcaggcagatctgagactttgtcctgtgctcgtcagatgttaggtttgtgacttgggcaaattaacctctcagttccccagttttcttatccattgaataggtatcatattactgcctacctcataggattgtaagattaagtgccataatgcagtaaaaaaattagcactggggcctgacacctagtaaatgttcaataaatgtaagctattggtattattattataccaaagatatattattattttatcttctcttttcagttgatttcttttaggaatcatgggggcatttctaaggaaggacctagctcaggcattattgtcagcaggataaaaaaaaaaatccatgaaaacagcagccctgcattgtaggttctagacagaaaccaaatgaggttaaatgcttggtagtaagttcagcatctgataataccccacaagagtttgaaataccttatgggtcagtgaagaaagattatcctgatgctggtgctagaagatttttcactgtatattgttttttaaaaacggtcaagccttgtttgtggcagctctcaggtcatgctaaatacatttttcacaaaggcttcaagggaaatacgtggaagctattgaatgtcttgggcttgaatctttatgttttgcttatataattattgttcccgtgtggaacctagggaagggcaatgaaaaccagctaggattcttaggctcttttctcattgaaagaaggtggagtgagtgggtgggtgaaaggcgctgctttagggaagctgacaaaggagataacatgctccttaacccaaaggtgaaaaagaatgtacaaaacaagtctgggcaggggagggacaacagggtatagtgagaggcaagatatacctaaggcttcagcctcacggggctcctggccgtttctcaagctcctcaaaaatgcccccacttaggatttctgcgcttattgttccttctgcccaaaataccttcagttcacatgtttgttcaactgtctcctccctcagagaggacttgcttgaccacctatctagaacaagtgccctctccctgtccctgatacactcactccatctctttatttttcttcaaagagctttaaactatctgataatttgcttgtttacctacttattgctgggctgtcctgcaaaaatataatctccatgagggcggagatactgtctccatcaccagaaacacaggaacacataataggcactcagcagatatttttgaattaacaaactgtcaaggcaaattctgttctttactgcaataaacggaatggccattgagaggttagggtatggactctgggaaagtcactcaaattctctgggactcagtttccatatttataaaacaggaatagtaatgtgtatcctaccttctgcaaaagattgccttaagtaccttatgcaagagagaagggcagctttagacttttgcctatgtaggccggaaccacatgaggaattaacttaggcaggtgagaaattatcaagcatttaagttttcgcccaaagtgaatcttgcataaatgcagtttttatgactcttagttctccatgaaaacctccttgtgaagtagcggaaaatactagacaaattgggagttcccttacggtgtctttcaaatggtacactggggcctcaaagtcttatgtgactgttagggtgatagccagaatgtgctgcagagggaagatatgaggatacattgccttttatcagtttctcaatgtttttgagttgagtgtcccttttgataaatgtaaaaatttcattccctctttttggtgctacactgtaattataaaatcagattttatttagaaataaaccacgtactcattttaaaccagaacacttatgatatgcagtcgaaataacaatataagtggtatcatatacacatggacaacaaggtatagctgacaaacatgcattgattgtagggtttactcagaatggtttctcattctatcttttgtttactcctattaaccaagaagatttaattgagctatagtttttatatttttattgtagagataatacatttcatatgccttcaaactgtactttaaactgtactttcaaacgatgcttgcccttttccccagttctgaacctcctaatcatggctttcagatatggccttttcttctgttctgatttagaaaatcgaaaattgaactgcttcataaagcactaaaggagttttccatttataggattgctcaccttcattttaagtaataagtatttctttcaattactttctctaaataaatatagatttttgtataagtctattaaaaatagttccttatacctattcattatagaaaatttgaaacatatagataatagaaattagagaaaaatcatctatagttttataacctaaagatgactattgctaaaaattaggtgaattttcttctatattttaataagatgaattgctttttgagcacgtgtgctcttacaattgtattcttacgagtgacgtatttgactactaaaaagtttgatttttgtatgcgtcaaaaaaagtaagggcaaacaccaaatgttatatatttatatatatataaatatctaatatatataatatataaatatataatataaaatatataatatataaatatatattatataatattatataatatataatatataaatatatattatatataatattatataatatataatatataaatatatattatatataatattatataatatataatatataaatatatattatatataatattatataatatataatatataaatatatattatatactatatataatatataaatatatattatatactatatataatatataaatatatattatatactatatataatatataaatatatattatatactatatataatatataaatatatattatatactatatataatatataatatatactatattatatatagtatattatatactatattatatagtataatatagaatatattatatattgtatataagataatatattatatattgtatataagatataatatattatatattgtatataagatataatatattatatattgtatataagataatatattatatattgtatataagatataatatattatatattgtatataagatataatatattatatattgtatataagatataatatattatatattgtatataagatataatatattatatattgtatataagatataatatattatatattgtatataagatataatatattatatattgtatataagatataatatattatatattgtatataagatatattatatattgtatataagatataatatattatatattgtatataagatataatatattatatatatattataaatatgtatatttttatatattattataaatatatatattttatatatattattataaatatatatttttatatatattattataaatatatatttatatatatttatatataaatttacatgtgttaaaaatatgattgtgttcttgtattcttacaattgtatacgtttcccatttcccacttaatatgaaaaaaatacactcatatgtaatgttcttagagacaactttaagatgttatttttaatggctgcatggtagtccagctagctagtaagtataccatattttgcttagccagtcacctacttttagacatttgactcattccatatttttgttattataaattccatcaggatgtatatttcagtacattaaagtttccttgcatttatgattatttccttagaatgaatttccagtgtggaatttctaggtcagaaaacataaacagcttaggattcttgatatatacatgatcatgagatattttccctaaatggttattccaatttacatgctcacctgtaatgcatcagtgtccatttcaccacaccctcactagaagtgggtattgtagttaagaaaattttcccttgacatttggcctgttattctttattttatatttacactctatctctttattttccacattttatattcctttggttagtgactgtcattttatatggttgttaagctgttgtatttcctcccatgatttggctttttgtgtatttttctcatttaaccagttgaatcatactttttttaaacacactctatgtgtatatatatatatgtgcactaatccttgatctattgcaaggtatcctttcgaagtttggtgtttgcccttacttttttgacacatacaaaaatcaaacttttttaacacattgtaaatttatatatatactaatccttgatctgttgcaaggtatgttttctaagtttggtgtttgcccttactttttttgacacatacaaaaatcaaactttttagtagtcaaatacgtcactcgttttctttgtgtttgatttcttccttggctagaaagtcctttccccttgagatatgtcataaaacttcactgcagtttttgttttaaattacggttttgttagtttacatttacctctttaattccatttggagttgtattttgatgtggataaaagatctaatttgattttgtttccagatagctagcaattgtcctaatataatttataaatacaacttccattcttcattgatttgctagccgactttaccatatattaaattcttatatataacagttactgtttctggactatctatttgtctcaattgatccatttattcttgcactgatagcactatagtatgataatgttttaatatattttaaaaattatttgctattcttatctgttggttcttcaaaatgaaatctagaatcattttattaagttaaaaaaaattcattggaccaaatgttttagctctcacatgccagtgagaacacatgatatttgtctttctgtgcctggcttatttcacttcacataatgacttccagttctatttacatttctgcaaataacaggatttcattctttttaatggccagatagtattcaattgtatatgcatagcacattttctttatccattcatctgttgctggactcttctatatcttggctactgtaaatagtactgtgataaatgtatgggcgcaagtatccctttgatatattgatttcctttccttttgatagataccctgtagtgggattcctcaatcatatggagatagagagtaaaatgatagttaccagaggttgggaagggtggaaggcgatgaagagaggttggctaatgggtacaaacagacagttagatagaagaaataggttctagtgttcagtcgcacagtacggtgactatagttaacaatatcttatgtattttgaaatagctagaagagagtacttgaaatgttcttacatatagaaatgataaatgtttgaggtgataaatatcctaaatattcaaatcccctgatttgattattacaatgcatacatgtgttgaaacatcacactgtaccccatgaatatgtacaattattatgtatcaaaaatttttttgaaaacaccattggggttacattaaatttattaataaactaagaatgaattgtcatctttaaataatttagtcttcccttcccataacataagtctctccatttataatttttttgtttatatccatcaatcaagttttatagttttctttttgtatgtcttatacattttttgttatttcgagttattgtgtgtatgaatgtgtatgctgatttttaaaaatcataaatgggatctgtttccactatattttctgtttcataggaaagctactgattttatgttctgttcttgtatttatccagtgtactgaatgctcttattaatgcagatagttttttttttaagtttattccctttgttttttttagatacatcaagtttcttttcactgaggtacatatgttctctcacatttcttcccttctcaccctcaatgtagacagccattgggaaagttctgactgcccagtgggattgatggtgataagacgagaactaatttaaaatatttaaaataattagctcaaaaaatagtttatttccatagttggcatccttctggacatatctgcctttgtttgctacttatctgatggaagatttggaagaagaaatgctgttataattctttagcttcaaggacacataatgaagtcatttgacatgtatgtctttagataaatgcataattatctttttgtcctttaagttttaaagggacaactgggaataaagtgcctgtcaaacaactgaactggagaaatgggggaggagcagtgatgaaataaaattccagtttatcagttgcaataaaggggaacagtgtggcaaagaacttgaaattataacttaacttcatttagtgagaaattacaacttgcatttagtttttgaattcaattggatatgtgccttggtgccacatttatcttcatgataacttaggccaccaacattattttcaatttcctgaatacaatccagtggtaaagtgagcctgaaagccagcctaggattgtttgccacatataaaccaccgaatggataattcacggcaaataagccaagtactgactctggttgacaatgtaaaattaaagttgcaagattagcctgaagatgtcatttagcttaagcaaagggggagtctgggttgatctctttcgggctctccccacctggcctcttcccttcagctccctccactgccctccttctctcagtggacagttctagctccatgtccaagcagattccctccctttttgagaattgtgcttttggaattgtcttaaagaccaatttgttaatacattccctctagtataagagaggggcagcacagaatggtggttaagagcccagatcttccagccagatctctgggtgtgcatcccagctctgacccttaactagctattttcccttgggcaggttactttaactttctgtgtctcaggtttcttacctgtaaaacggcagatggtgataatgagagtacttacctcacagggttgttatgatgattatgacatgagttaatatttgtaaagttaacatgtaatatgtgttttttaatatgaataaaagctctataaataattgtaatacaaagttagaacatcataagtatacgtaaataaaacttgatatggaagttcaggggaagaagtggttatatttattttcatgactcatcaaaatatcacatagttttaccatcacacttgaagttgaatgactttcaactgtttcaaaaattaaaattctctctgaaagaataaagtttgggccattgtaagtttggaaagctcttgaatcagagtatagtctcaaaaataatggctttgtgtaggatactattcctctggatataaaagttctgaaacgtttgttaaaaatcattatagttgtgtcttgaattttgtatgtagcattagttcgtatagacgtagagggcataggtactggcttgctttatttgaaatgtcatgaagaagtcagatgtagctaaatgttttcttttgtgtagtacttgacgtggtataaaaaaggaattgatgtggatttgtcagttctaaaccaggatctgtccccaacactgacccactgagaaaataagaaataagtcaggttggttgcttcttgcttcttgtccatttctaacctggacacttttttacagttagggacaacttttgatgaaataaagacaaatttcaatatcagcagagactagattaacacatgctttatagtaattaaaataaattaaaggcaatgataaaactccaccgttctttaacaattattcatgttctgatttttttggtgatacattttaaactctaggattatcaaaaagtccaaaaaagctttaatgagggaaggaagttaaaagtacactacattgctggtttgtctgtattaagggagggagtcagaggaaatataatcctgaaggggatgtaacaatttaaaaaaatgaattacatttttatgagttgtgatttgcttaggctaggtttgtaaggctccaaattgtaattctgcttgtttttcttaaaaaattagtcacttaaataactacatgaaaaaataacatgcaagaatgcatttacgttagtttaaatttacttctagtttatatacacacagggacagacagttttgaatagttgtaatcagagtggcatccccttgtgcccactttttacacatactgtcattttatttttttatttttattttttgttttgtgtgtgttttttttaatactttaagttctagggtacatgtgcacaacgtgcaggtttgttacatatgtatacatgtgccatgttggtgtgctgcacccattaactcatcatttacattaggtatatctcctaatgctatccctccccccaccccaggacaggccccagtgtgtgatgttccccttcctgtgtccaagtgttctaattgttcaattcccacctatgagtgagaacatgcagtgtttggttttctgtccttgcgatagtttgctgagaatgatcgtttccagcttcatccatgtccctacaaaggacatgaactcatccttttttatggctgcatagtattccatggtgtatatgtgccacattttcttaatccagtctatcattgatggacatttgggttggttccaagtctttgctattacacatgctatcattttatgtcaacatagtccacatacttaaagttttctggaaaacctaagactctaacatttttgaattttggcataagattttatttgtttatttatttatttatattttttgagacggagtctctctctgtcgcccagcctggagtgcagtggtgtgatctcagctcactgcaacccctgccttccaggctcaagcgattctcctgcctcagcctcctgtgtggctgggattacaggtgcgtgccaccacacccagcagttttttgtttgtttgttttgtatttttagtagagacagggtttcaccatgttggccaggctggtctcgaactcctgaccttgtgatccacccacttcagcctcccagagtgctgggattacaggcgtgagccatcgtgcccagccagcattaacattgtaaaccttcacctttgacatagaaagtgtaattttgaaccattgtttctgctataattcctttatttttccctaatttatatatttatttctaaactggcaaaattgtatatatgtattgtgtatgacatgatgctttgaaatatgtatacatgtgtaatagctaaattgggataattagcatatgcattacctcacatacttacattttgtgatgagaacacttaaaatctactctcttagcaactttcaagaatacaatacattgtttttaactatagttgccacgttgtacaatagatctcttgaactttttcctcctaacctaaatcttttatcctttgacccaaatttcccaatccccaccctgcacgcccctacgagcccctggtagccacccaccattctactcttggcttgtattagttcaactttttaagatcccatgtataactgaaactacgcggtatttgtttctctgcgcatagcttatttcactttacaaactgtcctccatattcatccatgttgttgcaaatgacaagatttcctttgtgtttaaggctgaatagtattccattgtgtatatacaacatattttctttatccattcatctgttgatagacatgtaggttgattgcattatgtcttggctattgtgaataatgctgcaatatacatgaaagtgcagatttctccttgacatgatgatttcatttccttttgatatatacccagcagtgggattgctggatcatatggtggttctatctttaattttttgaagaactttcataccgttttttataatggctgtactaatttatattcccaccaacagtgtgcaagggttcccttctctctgcatcctctcttgttgtcttgtttttgataataaccatcctaacaggtgtgaaatgatatctcattgtggtttcatttgcatttttctgatgattagtgaggttgagcattttttcacatacctgttggtcatttgtatattttcttttgagaaatgtctattctggtcctttgcccatttttattttattttattttttttgcaatggtgtctcggtctgtcgcccaggctggagtgcagtggcgcgatcttggctcgctgcaaactccacctcccaggttcatgccattctcctgcctcagactcccgagtagctgcctttgcccatttttaaatgggattatttgttttctttctattgagtaatttgagtctcttatatattttggatattaactccttatcatatgtatggtttgcaaatatattctcccattctgtaggttgtctcttcactctgttgtttcctttgctgttcagaagctttttagtttgttgtaatcccatttatctatttctgcttttgatgtctgtgcttttggggttatacccaaaaacaattcccttattttgagcaattattccttatttaggggtgcttaggttagttccatttttttcactattaaaatagggctagtatgaaaatctttgtcaaattgcgttttcctcttgacttgtttccttggagtgtatgaagataagcaaggttatgcagtcaaaaatatgtatggttttataggtctcgttatataacttgccagtttgaatagcgattttccatggacagggacagagtatgttttgtttgaaaaggcatattcaatattttagtttaattttatgttacaaaattactggtttataatagaagctatagaaaataaaactaagaaatattattggggaagaaaggaaaaaatggttcagaaacactgtcctgtgaagactgaaatgattgacaaaccttcagcttatactaaaataaaattgcattcttaaagcatagactgaatgactacggaggaggtggcacagaactgccctgggcaggtggaagaagccaggttgacaacagggaagttgccatcaatattcccaatgagatgtgggcattcgctttacattttaatcagtccttctgtaactttaatgttcatacaaatcacctgggcatcttactaaaatccagattctgatttaacaggtctgggtggggcctggaagtctacatttctaacaagctcccaggtgatgttgatgctgttgtcctgggaatgcaatttgagttgcactgttttagatctcttccttgtatgacatattatagtaagagttgactacaggggatccttggtcagttacttcagtaacttgaaagtgaaagatataaactgctggcctatttgaggggtgaaacaattttgctcattcagaaattggaggggttgtggggagaaggaaattgttaatattagatgagttaatcatgagaagttttatgtaccattcacaccaggttgttcagagactgaaggaggtacgaagttttgaagtggtactcaggttcctgctacttaactgaaagtgagataagatcagattcgttaggaaacaattctcaaaacagactcatttactttgactaaatgcgtctgaatgatagtagggagatagagtcattgtattttttagagacccactgttttagaaagtggaaaacttgttgcttaccattctgcttatcttgttgctgagattttaaataatgaatctccacatcacccttatgatactgaattattgccattaatcatttctcatagggaaaatggaactaagaacctatgctgtttcactgcttccatctccattttgctatgtggctttaagaaaatcacttaaaggcttatgttgagttcccatggtgaaaaatggaaatcaaagctcttgccttgttccccatagagtacttgctgaagttagtgggctttgaggtagatttcaagtgtttaaaaagacaaaagactttaacattgtaatattgtatatttattcagcatattatatataggcatatatcaagctattttatatatgatctaaatattctggcaatccttcgtaaaaaataaaacatcatataatccacatcagtagttaaattgaccttttgttcagtgtcacgaatcaagtaaatctgaatagtgtgtttcagatttgttttggccctttaggtaatcagttctgatgcatattgatgaaagatatagtaatttttttttttagatggagtctcactcttgtcgcccaggctggagtgcaatggtgcgatctcagcgcaccgtaacctctacctcctaggttcaagtgattctcctgctccagcctcccgagtagctgggattacaggtgcccaccaccacgctaggctaatttttgtatttttagtagaaatggggtttcaccatgttggccaggctagtctcgaactcctgacctcaggtgatctgcccacctcagccacccaaagtgctgggattacaggcgtgagcctaatttaattcacatatttaaatacttttatttccaaaggaggttaatggtaaatgtgatcatcaagtcaagcatgacactctgcttgtaaacacattgattttaaccagagttcagtgcatgtcctggctaggtgtggtggctcacacctgtaatcctactactttgggaggcctaggtgggaggatagcttgaggccaggagttcaagaccgtcgtggtcaacagagcaagaccctgtctctgcaaaaactaaaaaaaaaaaaaaaaaaaaaaaaaaattagctaggcacagcagtgtgcaactgtagtggcagctactcaggaggctaaggcaggagggcaaggctgcagtaagctatgatcaccctactgtactccagcctgggtgacagagcaagacaccattaaaaaaaaaaaaaaaaaaaaaaaagcatgtgtcctaaccaaaagatctctattgacccaaacttgtgcccaagaatagcaatcagaaaatttatgaaatgaatgatttagattcacattcaattgattcacaattgattttgattcacattcaaaaactgaaacaattcattataaagtttaccttactgttttatgaggtaaaattttattaggcaaattaagtaggattactatatatactaaaatataacaaataatctatatccagtacagtgtggggatcaggaactggggatctagaatcaaatgggcctgattcaaatcccatttttgcttcttaatctctagactgattttggttacttaacatctcaaagtctcagtttccccatctataaaataaatattacaacataaacctaataggatttttgtggggtccaaaggagataatgcatgtgctagaaacttaactttttatcctcctaaattcacacgtttaaacccttacctccaatatgcttgtatttggagataggacctctaggaggtaattaatgataaatgagatcataaggatggggctgtaatctgataaatttggtgaccttatgagaagaggaagaatgcatgtacaaagaagaggtcatatgagcacacagcaagaaggcggctgtctacaagccaagagaagaggcttcagaatgaaacataccttaccagcaccttgatcttggacttcccagtctccagaattgtgagaaataaatttctgttgtttaagccaccctgtctatggtatcttgttatggcagcctgaacagaccaatacagattttggtactgagaggaggagtattgctgtaacaaatacctaaaaatgtggaagtggccttagaactaggtaatgagtagaggctggaggagttttaaggtgtatgctagaaaaaagcatagacggctgtgaacagaatgttggtagaactatggatgttgcaggttattctgatgaggtctcagatggaaatcagcaacatgttactgcaaaatgggagaaaggtgttccttgttataaatggtaaagaacttgactgaactgtgttctagtattttgtggaaggtggaatttgttgagtaaaaaaattgactttttatctgaggagatttctgagcaaaaagttgaaggagtggctcagtccctcctgactgcttatggtaaaatacaaaaggagagagatgaattgaagaaggaattgttaagcaaaagggaactggaacttaaacatttggaaaattctgagcctttatgtattgcaataaatgaggaagcttgttctggagacaacactaagggtgtggctggactatctgtcactacttaagattacttatgatgttaaccagccatctgagcagaagtcaggaatagagtttggaaaaaagcagcagaaatattaccagtttggaccaaagagaacaggacagtatggtatagttatttggctgcaaacatggtttatctttcaagaaaagggaagaacgaccctgagggtgattcagagataaccagggctgccattcctactataggcccaaagtgcacaggcctggagggtaaggctgcctctaccttggtttcaaaaagtgagactgacatccaacagagccacataggtggggccatcaccctagccaaaggatgtggccaccttacagagctgtgggggtgatgctgcttttccagtgaacctgaagggcagaatattgaatcgaagaggattattcttgagccttaagagctaatggagtttgccttgctaggttttggacttgcttgggacctgtgacccctttatttcttccaatttctcccttttggaatgggaatgtctatcctcttcctgtagcaccattatattttggaagcacatagcttgtctggtttcatagtttcacagctgaaaataaattttgcctcaagatgaataatactgctagtctcacccacatctaattttatttagatgagactttggactttagattttaagttgatgctagaatgagttaatttcttttgaggccgttgggatggtataagtgtgagaaggacatgagttttgggggtcgagagtggaatgatatagactgaattgtgttcccccataatatgtttaagctctaacttccaacatgactgtaattggagatagggggtaattaaggttaaatgagttaaatcataagggtggggctctaatctgataggataatcataagtgtggggctccaatctgataggattgggggccttattacaacagaaaaggctgtctgagtacacagcaagaggtcagctactcacaaggcaagagaagagggctcaaaatgaaacttatgttgctggcacctcgatcttggactttccagcctccagaactgtgagaaagtaaatttcttttatttatgccattcaaggtatggtattttgttatggcagccaagcagactaatacagcaagtaaaactcttggcatgtagtagaaatcaattagacaaatatacaatatagatataaactgagtaatgggaaggaatgtttaccccatttaaaaggataagctgcttttaggaaaataaagttacaactaaggcactttggagatagtcctagtttacagaattttagagttgctcttccacaaaagtataatttaaaacaagcagcacttgtttttaattcatatattttttactattacttcatttataatatattatagggtaatatagtaatacagtcatgtgcaatatagcaacattttccttaacgacgaacagcatatacaatggtggtcccataagattataatggagctgaaaaattcctaccacctactgatgttgtagccattgtaatgccacagcacaatgaattacttatgtatttgtgatgacactggtataaacaaaccgactgtgctgtcagctgtataatagtatagcacaggccaggtgtgatggctcgcacctataatcccagcactgtgggaggctgaggtgggtggatcacctgaggtcaggagttcaagaccagcctgaccaatatggtgaaattctgtctctactaaaaatacaaaaattagccagccatggtggcatgcacctgtagcctcagctactcgggaggctgaaacagaattgcttgaacccgggaggcggaggttgcagtgagctgagattgcaccactgcactccagcctgggcaacagagcgagactctatctcaaaaaaaaaaaaaaaaaaaaaaaaaagaaagaaaaagaaaaagaaaaaaatgtatagcacagacaattacatacagtacacaatacttgataatgataacaaattactgtgttactggtttatgtatttactgtactatacattttatcattattttaaaatctactcctacttatataaaaaaaagttagctgtaaaacagcctcgggcaggtccctcaggaggtattccagaaggcattctggaatatgaatatcataggagatgacagctccgtgtgtgtgactgcacctgaagatcctgcagtgggataagatgtggaggtggaagacagtgatactgatgatcctgaccctctctgtaggcctaggctaatgtgcgtatttgtgttttagtttttaacaaaaaagtttaaatagcaaagaatacataaaataaaaattttgaaacagagaaaagcttatggaataaggatataaagaaaaacagttttgtacagctgtacaatgtgtttgtgttttaagcgaagtgttataaaagagtcaaaaagtttaaaaaaatttacaagtttataaagtaaaagagttgaagctaagattaatttattattgaagcgatacagttttttttttttgagacaatctcgctccgtcacccaggctggagtgcagtggcgtgatctcgtctcactgcaacctccgcctcctgagttcaagcgattctcctgcctcagtgcctcagcctcccaagtagctgggactacaggtgcgtgccaccatgcctggctaagtttttgtatttttagtagagatggggtttcgttgtgttaaccaggatggtctcgatctcctgacctcgtgatctgggaaatataaatattttaaaataaatttagtgtagcctaagtttacagtgttcataacattctagtagtgtaatgtcctaggccttcacattcactcaccactcactcattgactcacccagagcaatttccagtcctgcaagctccattcatggtaagtactctcaacaggtatagcattctttatcttttatactatattttactgtgccttttctatgtttagataggtttagatacacaaataccattatgttacaattgcatacagtattctgtacagtaacatgctgtacaggtttgtagcctggagtaataggctataccacatagcctaggtggtataccatataggtttgtgtaagtacagtctatgatgtttgcacaacaacgaaatcacctaatgatgcacttctcataatgtatcccccttggtaagtgatgcatgactgtggcaatattatattgctatacattataatagtaattttataaaaatatagttatattcaatttatagtattatatccttatactattgccattatatttataacaaatattattaatattaataattatttatgtgggcctgatagtgtattatcccagtgaaatgttttcaccttaagtttcgatatgtacttaaaaataagtctattgtttgttaaaactatctaataattcatggttttatcaattacaacaggtccctgttgtagtttctttctgtccaaatggtctctcaacttgacaaatctttaggagcatgaatttccatatttcaaaaaatgaaaagataaagaaatctcactggaaactgtggttgggcagatacaatatggagacaagttagattcactatgctttacttcctatgaatgcaatgacaccatatacgtgtgtcctagtatatgtgacatttatatgtaatattaagctcaaatttaaagtatccattgttcttttggaatctttcagtaatggaagtttattctttcacaggtatcacggttacatttatacataccgagtgtcccagacagaaacaggttcttggagtgctgaggtatagttgtatttatttttgcttctgggggtgtcaaggaggtatttgaaatttaggctggttttataaaagagcaaattatacattattaagtattcataaggtttaaatctctaaagctccaatccaaaattgttcatggatcattaagaaagctttagagaattttggtcccagtcctgtttagccatcattttgcagagttgtatgactttgggagaaagataaaaaagttgaagaattatgtcaaacttttagtgactatgtgaaatcttagcatatcaaaagtaggtaaaataattaaatgaacaattatttaccaaatgataccaatatgagtattggtatcgtgggagattaaaaaacatgatgcttattttctaagagactacaatatacttgggaagttataacttgaaattaaacagttatgagtggaagaaactaggctttgtcaacaggtgaatctgggttccaggtctggtctcccctcctctctgataggtctatgatcttgggcaggttacttgacttttctgtgagccagtttcttcatttgtaaacggagcctaagaatcctcccttatgcacaaggctcaatttgaaaagtaaataagataacacacataaagaagctgtttgccacaaggcctggcacacagtgagccctcaaaaaagtgaactcctgaaaattgccacaactcctattaataactcaatctgtgcatttaaaattttctgaagtctagacttcaagaagttaaaatagctctcacgtttactgatttatcagtaagttggaaagtataaattacagaccacaaatgttttgaaccactgagatgaattaggccaagttttcaaacacacttttgctgtattatgtaaggatcattaaaactataatactaactaaagataaagttataccatttctaattgaaactatttatacctgtttatttaaaaaattctctgtatcactgcagagatgattgaataagaaattaaactttattatgaagaaagttatgtgtaaaatatactgacaaacacacacacacacacacacacacacacacacacacacacacacgtttgtatattatttcgccagaaatagctcttctccccagagaaatacccttcagctgctgaagaatattatgtaaggaaaggatcttaaatgcttagggtttaacaactttgtttttcaacttgttttcctgcattttgagtataacatcatatgagattgttacatgcttgtgatcatgttaaagaagagagggcttattgaacacaaatgccccctcatcctgttgtctgatctgacgttgtttatgtaataatattgtaattttctgcaccaagagagcagaagattggcatgacatccgcaaatagaaaatagtttaaaaaattctttaatttttgaaatgcatattgcatttttttctatctactaaatttaccttcttagcagtgcttttctaaggtgaaaattaaactagtgtatattctcagagctcataccacctgactggaaaaaatttctctagagcatattgaagaccagctgtgatctaatacatgtttccatggataactaagaggtgacagtatgggagatttgcaaatttgaagaatagctgagttcagtgacaggatgagagttgtcagtggtacaattcttgtgataaatgtattttcgaaactgggtaaatgatagatattaatactgatttttggaacaatgttttagtttgccatgctgcaggaaaaatcaaggcagtagcatgccaccatctgtgcatatattatgctagaaatctaggtaagtgagatttgttttaaagagtgtaatgaaatcaaaccctggccccactgaattatgaaagacagatatcatgtgtttttctagttttagagagacttttaggttaaatctttgcctagtgtattatcttatatgactcagactaaaagtttgttacattgttaatttagataattccacaatctactttcatttattaatatgtgatttgttggcaatacattattaaaaatgtactgacatcaccctgttgacatcagtgtcttcaggctttactgggtatatgatcaggagatcagcagatgttaaataattgtccttattaatctaagtaaaacactgtaaaataggccagtcatttgcttatgaaacatcagatccccaattcaaatagcttccatacttccagtgctattattcatttctgttagcatggataatcaagtgttagctacatatcagtacccataaaaatgttgcttctctgttttgttttgttttgagacagagtctcactctgtcgctcaggctggagtggtggaatggcccgatctcggctcactgtaacctctgcctcccaggttcaagtgagtcctgtgcctcagcttcccaagtagccgggattgccaccacacctggctaattttcatatttttagtaaagccaggctttcaccatgttgcccaggctggtcttgaactcctgacttcaggtggtccgccggtctcagcctcccaaaatgctgggattacaggtgtgagccactgtgcccggctatgcttctgttgataaatgactttacaagccacaagaagctaaaaagatgtgtggtttgaaatctttccacactttaggtgtgtatagtttttcttctgtttgatgaccctagcttcgctagatcctgtttggcccagttctaatctgaaaggcaagagactgggtcctgggattctgagccagttctgcctctggttgtctgtgtgactttgggcaagctgattaatttctttgcattcatattttcttatctgtcaaatgggaataactgaatcagccaataactgccattttgtgaggaaatagtgaaggcaagagataggaatgtgctttgaaaatgaaaaagtgcactgaggaaagtataaggaggcaatttgtgcctatgacctgcatttgcaatttggagactctatcttggaaccaacgaactgtttggacttctgcaagaatggccatgttattttggatgagttctcaatcgagctttaggaaggtggagggtaggtgagagagtggggtggagctgggtgagagagtgttctacatctactgtgaacatatgggggaacactaatatagagctaaaaagaatttttgtcatgttttcaatgaaaaattaccccaacataaggaaatgactgagagttactatggatagtgtagtatgctatcttcagcataccactatctagctgacagaagtcttcatgctcgccttcatgttttctcattaaatgctaaaaaaacaaacagctcccacctcaaaaatctaccagatggaatagctgaaaaacaacttaaaaaaaaaactagtcattgttcaattgctcatagcaatactattttattttacgtaaaatgacaggtttgagctgatgcctgaagcttggctcataagcttttgcaggaaattgttgttgatttcaggcagtgtctttgcaagacaactgatgtcaggaaaggaacacattttaatagtcacctgcaaataactgtctctttaaaaacacacaaataaataaataaaggtgaccttatatagtctttcattttcatgtcatagagaaaaccttgttacagtgacgtgctgatggagagaacaattttgggagtatagggaagtttcccaaggaggaaaaaatttaatgtgaagaatggcgcaggaaatattgtgaggtgaaagagtatgaggactgaactagccgtgcactgtgtgcatcataacagccaatttttaatttcctgtgtagcattttatattgtgggatgatggcagggaggatgggttgttggtttttcttttgttgttgttcctcaggctttttattaatgacctgtaggatctgtttttttgtttttgtttttgttttttcctgtttaactgcatcccctctgttggtgaattcattgtgggtaatggcctgtatacccttagaggtttgagatgtctgatggggagcaggcaggaagggcagggcaatgagcaagagcttgtacaaactaataccacctttgggagaactgaaatgacagctcattagctcctcttgcagggaaattcagccaaccaaagtaagctcttctggaatgttgtttttccttcttccttatgttttcaaatatttcaacaagttacacaaatgttacttctcttagcatccctagcacattttgtaggtctttttgtatcattatgagataggtaaataatttgcttggccttttattttccagacagcacctggggtacataaaagatatttccggaaaataaaaaatctcatttcagcatttcagaagccagatcaaggcattgtaatacctctgcagtatccagttgagaagaagtcctcagctagaagtacacaaggtactacaggtatgatttcctcttaatttttgacagggtttggaagctcagagttatgagtcaacctgttcataaccatataatcaattagaagttatgtaagaaaaatgcagtgagaaagtagatgtagccagcaagtcaaatgagaggtgacaatttatgtgctataattttcatctattattctaataacttttaataaatctctgtaaaaacatcaaaaattctataagcccataacattttaactgctcttgtctgtctcatcttgttctttcctgtccctttaataggtagctaagtatgatttcacttcactaattcagacacaaataatgtgaaagatggtataattcagagaacacctgggctgtcctttatctttgcttagtaaactgttttttccttcagggacatgaaagctaacgttagcctggcacacatgattctgatttctgaattggtggtgcttgaattaatgacatttttctgaagcaaaggaaattaaatagtgcactttattgttccactggcacatattgttacatatcctgagcaaacctattttagtgtatgtgtcgtgctaaagactgaataccagccaatgtctgtagctatctgatacgtgactgtttactcctctattgaatggggtttatcatttgtttggagtaagaggataggccttgattgaaacaataaatatttatgataaaagaaaacgagtccctttttgacagggacctaggctcaggcataaactgacaattagactcaagtggtgaattaaattaatgaatagttagcctttataatacaaatgcaaatagagctctaatttccaagttggctagttgtttttttctgcctaatattccattctttataactcagttttaaataatagttgcttgaggtatattactgtgttgtgtcattgtgagttttatgcagttggaaattttataagtttgagttaatctgtaattttaatagtttgtaagtttattttttcttgatttttgttatttttctttagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttatttacctaa

SEQ ID NO: 1970 - DNA, 26879 bp, Homo sapiens; identical to SEQ ID NO: 1969
  source 1..26879: mol_type = genomic DNA

SEQ ID NO: 1971 - DNA, 5605 bp, Homo sapiens
  source 1..5605: mol_type = genomic DNA
ttgctggctcttaagggtctttaatggtttcattttgtggcccttccccccaaccctggtgactgtcccagcaagcagtcagtagaggtccccggagttcagtgggggcctggagatgtcggacttgtgagggaagggccactctccccttgtaacctgtgggggaggagctgggtcattcctgtggattctgccctgccccccacctcccctgcctgtgccacctctggtacctctggtggctgctaggtggaagctgcagcaagggggtcccaagtgcagggcctctgggtgctacacatctcacagccagggcggtctggggcattgatgaaggtgcaggaaggacaggaccagctgggctgggggaagagagacagttgttgcttccctgctctttccaatgcccatggctgtcctggccctccctgcccagtcccgtgcccacctggagtggactgggcaggctggaggcagctggctgggggcctgggggtagccccaatgatgggggaaacaagcgtccaagttccccgtccatcttctgggggtgctgagggctaggtcctgtggctgagggggtggagctcaggactgtggggctgcaccccacctcccacaccccacccccatcgaggactgacctggggcttctcgaggagctgacagcaagtagaggaaagcagggtccccatcctgccgaaccccgtaagaggcaaggctgcgctcaggcacacacaggcaccgtccgatgacccagcgttgcacggctggcgggaaaccgagctctgagaacacctgtggccagagcatcagggcaggtgatgtcacctaggctcctctgcccctggcagggctccccagaccctgtgcccacctgctcctggagagctgcaacagtgcagtgggggtggacctgcagggcaacgtgtgcagaggacgcggcggatgcggcagaggcagcgtcttcaagtgtgacctgcagcctgtgccagaatgtgggttcagggatggatgggggacctgggatggtcacgaggacaaggtgaagaagcagccccaggcctcacctgatggggccaggtgggaagcaggcctcctgaagctgaacactcagggccacacgatgctgggccaggacggctgccacttgggctgcccccttctcgtctccacctgcaatagcccgggccaggctccctgccagctcttctgcagggtaaggaaaggacagctgtcaccactggggactatctgctatccccgaaccccccaaccccctccccccacctgtacctctctccgtcaagtttccagggctcctaggaagatctgcctcaggtggagggcccttgagtgtggaggcttccgggggactgggcagggagacagggcatgcttctgggcccaaggctggtggtgagttgctcttgctgcctagaggtaagatatgggtgtgctgtgctgtggcctctgtccaggcctctaggcccttggttttccaggacctttgccttctccctcacctcagtccatgccagggccctgcctcaggccacacttctagccacaccttctcccagccttggctctggcaagaccctcagaggcccctgccagacttctgttagtgctggagctgcacttagttcatatttgggaattagagccttttcaaacccttttgtgcctggctaggccacctctcttggctctttctgccagccagggatgcctcacagcagaaccaaagcaggccctcagtggccctgcagtcagggtggcctcttggagcccttggggacctcccctctccgggctccctgacccacacctgggctgccagcactccagacaagccactgccctgggcgtcttcagagctgagcaccctgctgactcaccttcttacccgccctgtgaggcccagcccactgcaatgggggggtccccatccagtgctgacacagctcccgtggtctcaggcccactatattctaccatctccctactaggataagcagggccttccacgcacccagcgctgttcctggccccggccccggccccggcccccactgaacctcaaggatcacttatacatgctcacctcagggtttgtttgctgcttccttggtcacatggttcatgccatgaccttcaaatttcactccagtgtcacctcaatgaggccttccctgccaccacttttttttttttttgagacggagtttcactcgttgcccaggctggagtgcagtggtgtgatctcggctcaccgcaacctccgcctcctgggttcaggcgattctcctgcctcagcctcctgagtagctgggatcacaggcatgcaccaccacgcccggctaattttgtatttttagtagagacgggatttctccatgttggtcagactggtcttgaactcccgacctcaggtgatctgcccacctcggcctcccaaagtgctgggatgataggcgtgagccaccgcgcccggcccctgccaccgttttaaacagcaatcctcccagctccaccattctcattcccacaccatctaacagactttcttttttaaaaaactctacagtaattttattatttttgtttttttttttggagacaggatctcgctctgtcacccaggctggagtgcagtggcacgatcacagctcactgcagcctagaacccctgggctcaagtgatcctcccatctcaacctcccgaatagctgggattacaggcagacacgactacactcagctaatttttttttttttttttttttgtgagatggagtctcgctctgttgcccaggctggagtgcagtggtgcaatctcggctcactgcaagctccacctcctgggttcacgcccttctcctgcctcagcctcccgagtagctgggactataggtccccaccaccacacccagctaattttttttttttttttttttttttagtagtcagggtttcaccgtgttagccaggatggtctcgatctcttaacctcatgatctgcccacatcggcctcccaaagtgctgtgattacaggtgtgagccaccgtgcccggcccactcagctaatttttaaattttttgtatgttgcccagccctgtacttattttatatgtctgcctcctcccctctaaaaatgcaagctccaataggatggggatgggaggttttgttcatgccaaaggagtacctgggacagggcagctgctgaatacatatgcttggtgaatgactaaagagagcttagctccttttataaaccctgagttgcttgagtctctcttacatcactgtctggctgtcttcctacccctctggcagctctgcttatctcgtttgtgggctgccctctatctgggagccccatactacctagtccttcatgtttctcagtctcaactgctaactcttccatttaagcagccatgtgagccaggggcagtggctcatgccaataacagctacttaggctgaagcaggaggatcaccgtagaccaggagttcaaggctccagtgagttagggtcacgctactgcactccagtctgggtgagagagggagtctttgtctgcaaaaaacctcccaagcagccatgaaactcagctaattccatcttcttttttttttttttttgagatggagtcttgctctgtcacccaggctggagtgcagtggcaagatctcagctcactgcaacctctgcctccgggttcaagtgattctcctgcctcagcctccccaagtagctgggactacaggcacacgccaccacgcctggctaatttttgtatttttagtagagacagggtttcaccttgctgaccaggctggtctcaaactcctgacatcaggtgatcacccacctcggcctcccaaagtgctggaattacaggcgtgagccaccccacccggccactaattccatcttctaagcatctctagaaacatccttctccccaaccctatctgcaccaacccttgccactgcagaactctgtcttaagcaggaggtatctgagtctgtcactctcccactcctgtcactctcctgctgctcttgggatgatgtcttctcacacaggtcctgaccctgcctgctctgcctcttcatgcttgcctctcatccttcctgagggttaaggaagtgcaggctgaggttccagggcttcctggtggaggctgcaacttgtgctggctggggcctcagatggtgtaggagactgactccagcagccactccaagtactccaagctactccaggctccacctactccctcctggaagccttcccagacatccagcagtggggaaggtggatccaacttccccaaccaggactggggggccaaggctattccaaattgtaattgtatccattacagggcactgaccattctgtccttccacggtggcacctcggactaggactgcccaccgctgagcttcctgagggttgaggaagtgcaggctgagggttccaggccctcctggtggaggctgtagctcgtgctgggtggggcctcggatggtgtaggaaactgactccaggggccactccaaattaacctgagaagagggagagtccaggctcagggcgtccccccgccctacatcgcacgaggagcaaagaaatacaaggtaacatttatagaccatttacacggtcctaagccctgtacgcctatcatcaaatcctcacaatagccctgtaaagtaggtccaggtaggtcccagtaggtccgagcgtcacccccatttcacggacgagaaaacagaagcaaagaaacataactgcttaagggcacccaggtggcaagcggaggggcctaactttgggctccgtgccctgcccgggccaagaggactgaccgcgcgccctccgcccccactcaccgccccaggtcccgcgcccagcagctccagccggaagcgcccaggccgctcagggtccgcgctcagctgcagcctccgcagctgtgcctcggcgtctggcccggcgcccagcggcctcaccgcggcgtgcacagccaagagcactgcggcggagcccaagtccgaggccgccgccgccgccccgcccgctggcggcgccatctccggtccggccgggtcccacccctccgagcgcgcttccgtgggatcgggccgctgagccccctccgccggtcggaaacacgggccgcgaacctggggttccgggcgcgcccagagcgtcgggcctgggacggcgccgagtggtgcactctggccaagcctgccccgctggctttgcccacaaatggacacggcccgagggtctccggacaccggctgggcgaggctggcggcgtgtacgaggctggggcagggcggccgaggcgctcacgttagagctggtctttgggggcgaagggtcagggggcgaagcaccggccacaactgaaggcggacgcggcctcttcgccccaggggctcggcggacgtagatgcatccagcgtgcgactatcccagcgcctaacggcagctggacttcgctcccgggacctccaatgggctgccaccttcgcccgcagaccccagcccccgccacgcccacac

SEQ ID NO: 1972 - DNA, 5599 bp, Homo sapiens
  source 1..5599: mol_type = genomic DNA
tggctcttaagggtctttaatggtttcattttgtggcccttccccccaaccctggtgactgtcccagcaagcagtcagtagaggtccccggagttcagtgggggcctggagatgtcggacttgtgagggaagggccactctccccttgtaacctgtgggggaggagctgggtcattcctgtggattctgccctgccccccacctcccctgcctgtgccacctctggtacctctggtggctgctaggtggaagctgcagcaagggggtcccaagtgcagggcctctgggtgctacacatctcacagccagggcggtctggggcattgatgaaggtgcaggaaggacaggaccagctgggctgggggaagagagacagttgttgcttccctgctctttccaatgcccatggctgtcctggccctccctgcccagtcccgtgcccacctggagtggactgggcaggctggaggcagctggctgggggcctgggggtagccccaatgatgggggaaacaagcgtccaagttccccgtccatcttctgggggtgctgagggctaggtcctgtggctgagggggtggagctcaggactgtggggctgcaccccacctcccacaccccacccccatcgaggactgacctggggcttctcgaggagctgacagcaagtagaggaaagcagggtccccatcctgccgaaccccgtaagaggcaaggctgcgctcaggcacacacaggcaccgtccgatgacccagcgttgcacggctggcgggaaaccgagctctgagaacacctgtggccagagcatcagggcaggtgatgtcacctaggctcctctgcccctggcagggctccccagaccctgtgcccacctgctcctggagagctgcaacagtgcagtgggggtggacctgcagggcaacgtgtgcagaggacgcggcggatgcggcagaggcagcgtcttcaagtgtgacctgcagcctgtgccagaatgtgggttcagggatggatgggggacctgggatggtcacgaggacaaggtgaagaagcagccccaggcctcacctgatggggccaggtgggaagcaggcctcctgaagctgaacactcagggccacacgatgctgggccaggacggctgccacttgggctgcccccttctcgtctccacctgcaatagcccgggccaggctccctgccagctcttctgcagggtaaggaaaggacagctgtcaccactggggactatctgctatccccgaaccccccaaccccctccccccacctgtacctctctccgtcaagtttccagggctcctaggaagatctgcctcaggtggagggcccttgagtgtggaggcttccgggggactgggcagggagacagggcatgcttctgggcccaaggctggtggtgagttgctcttgctgcctagaggtaagatatgggtgtgctgtgctgtggcctctgtccaggcctctaggcccttggttttccaggacctttgccttctccctcacctcagtccatgccagggccctgcctcaggccacacttctagccacaccttctcccagccttggctctggcaagaccctcagaggcccctgccagacttctgttagtgctggagctgcacttagttcatatttgggaattagagccttttcaaacccttttgtgcctggctaggccacctctcttggctctttctgccagccagggatgcctcacagcagaaccaaagcaggccctcagtggccctgcagtcagggtggcctcttggagcccttggggacctcccctctccgggctccctgacccacacctgggctgccagcactccagacaagccactgccctgggcgtcttcagagctgagcaccctgctgactcaccttcttacccgccctgtgaggcccagcccactgcaatgggggggtccccatccagtgctgacacagctcccgtggtctcaggcccactatattctaccatctccctactaggataagcagggccttccacgcacccagcgctgttcctggccccggccccggccccggcccccactgaacctcaaggatcacttatacatgctcacctcagggtttgtttgctgcttccttggtcacatggttcatgccatgaccttcaaatttcactccagtgtcacctcaatgaggccttccctgccaccacttttttttttttttgagacggagtttcactcgttgcccaggctggagtgcagtggtgtgatctcggctcaccgcaacctccgcctcctgggttcaggcgattctcctgcctcagcctcctgagtagctgggatcacaggcatgcaccaccacgcccggctaattttgtatttttagtagagacgggatttctccatgttggtcagactggtcttgaactcccgacctcaggtgatctgcccacctcggcctcccaaagtgctgggatgataggcgtgagccaccgcgcccggcccctgccaccgttttaaacagcaatcctcccagctccaccattctcattcccacaccatctaacagactttcttttttaaaaaactctacagtaattttattatttttgtttttttttttggagacaggatctcgctctgtcacccaggctggagtgcagtggcacgatcacagctcactgcagcctagaacccctgggctcaagtgatcctcccatctcaacctcccgaatagctgggattacaggcagacacgactacactcagctaatttttttttttttttttttttgtgagatggagtctcgctctgttgcccaggctggagtgcagtggtgcaatctcggctcactgcaagctccacctcctgggttcacgcccttctcctgcctcagcctcccgagtagctgggactataggtccccaccaccacacccagctaattttttttttttttttttttttttagtagtcagggtttcaccgtgttagccaggatggtctcgatctcttaacctcatgatctgcccacatcggcctcccaaagtgctgtgattacaggtgtgagccaccgtgcccggcccactcagctaatttttaaattttttgtatgttgcccagccctgtacttattttatatgtctgcctcctcccctctaaaaatgcaagctccaataggatggggatgggaggttttgttcatgccaaaggagtacctgggacagggcagctgctgaatacatatgcttggtgaatgactaaagagagcttagctccttttataaaccctgagttgcttgagtctctcttacatcactgtctggctgtcttcctacccctctggcagctctgcttatctcgtttgtgggctgccctctatctgggagccccatactacctagtccttcatgtttctcagtctcaactgctaactcttccatttaagcagccatgtgagccaggggcagtggctcatgccaataacagctacttaggctgaagcaggaggatcaccgtagaccaggagttcaaggctccagtgagttagggtcacgctactgcactccagtctgggtgagagagggagtctttgtctgcaaaaaacctcccaagcagccatgaaactcagctaattccatcttcttttttttttttttttgagatggagtcttgctctgtcacccaggctggagtgcagtggcaagatctcagctcactgcaacctctgcctccgggttcaagtgattctcctgcctcagcctccccaagtagctgggactacaggcacacgccaccacgcctggctaatttttgtatttttagtagagacagggtttcaccttgctgaccaggctggtctcaaactcctgacatcaggtgatcacccacctcggcctcccaaagtgctggaattacaggcgtgagccaccccacccggccactaattccatcttctaagcatctctagaaacatccttctccccaaccctatctgcaccaacccttgccactgcagaactctgtcttaagcaggaggtatctgagtctgtcactctcccactcctgtcactctcctgctgctcttgggatgatgtcttctcacacaggtcctgaccctgcctgctctgcctcttcatgcttgcctctcatccttcctgagggttaaggaagtgcaggctgaggttccagggcttcctggtggaggctgcaacttgtgctggctggggcctcagatggtgtaggagactgactccagcagccactccaagtactccaagctactccaggctccacctactccctcctggaagccttcccagacatccagcagtggggaaggtggatccaacttccccaaccaggactggggggccaaggctattccaaattgtaattgtatccattacagggcactgaccattctgtccttccacggtggcacctcggactaggactgcccaccgctgagcttcctgagggttgaggaagtgcaggctgagggttccaggccctcctggtggaggctgtagctcgtgctgggtggggcctcggatggtgtaggaaactgactccaggggccactccaaattaacctgagaagagggagagtccaggctcagggcgtccccccgccctacatcgcacgaggagcaaagaaatacaaggtaacatttatagaccatttacacggtcctaagccctgtacgcctatcatcaaatcctcacaatagccctgtaaagtaggtccaggtaggtcccagtaggtccgagcgtcacccccatttcacggacgagaaaacagaagcaaagaaacataactgcttaagggcacccaggtggcaagcggaggggcctaactttgggctccgtgccctgcccgggccaagaggactgaccgcgcgccctccgcccccactcaccgccccaggtcccgcgcccagcagctccagccggaagcgcccaggccgctcagggtccgcgctcagctgcagcctccgcagctgtgcctcggcgtctggcccggcgcccagcggcctcaccgcggcgtgcacagccaagagcactgcggcggagcccaagtccgaggccgccgccgccgccccgcccgctggcggcgccatctccggtccggccgggtcccacccctccgagcgcgcttccgtgggatcgggccgctgagccccctccgccggtcggaaacacgggccgcgaacctggggttccgggcgcgcccagagcgtcgggcctgggacggcgccgagtggtgcactctggccaagcctgccccgctggctttgcccacaaatggacacggcccgagggtctccggacaccggctgggcgaggctggcggcgtgtacgaggctggggcagggcggccgaggcgctcacgttagagctggtctttgggggcgaagggtcagggggcgaagcaccggccacaactgaaggcggacgcggcctcttcgccccaggggctcggcggacgtagatgcatccagcgtgcgactatcccagcgcctaacggcagctggacttcgctcccgggacctccaatgggctgccaccttcgcccgcagaccccagcccccgccacgcccac

SEQ ID NO: 1973 - DNA, 10952 bp, Homo sapiens
  source 1..10952: mol_type = genomic DNA
cgtagcgcccgcagagcaacgcaaagaggaagaacagagaaacggctatgagaaaaagggccgaagagtgagaagcagagggccttacccgagggggcggcaaccgggggccccacggtctccggccgcgcccgcgctggccgctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcggggctgtaccggaagttgcctctacttccgcccgttccggggcggggcttacttcgcagcgactacttgccgcacttccgggctgccaggcagctgctgtggctccaggatgatggagacagagcgacttggtgagggggaggggagggaaatggaacggagtagccgatatggaatgaactttgacccctgacttttgacctttccccgtagtgctaccccctccagatcccctggacctaccccttcgggccgtggagctcggatgcacggggcactgggagctgctgaacttgcctggagctccagagagtagcgtgagtgacttttgaccctaacctttgacccgcattgagtccaaacctccttcaccctcctcacagtaggatctagcttaaccttgttcatctgtgcctgtactcctgtccatcccagcctgaaggggtgctggacagattacagcccagtgtacctgcagtacatgtgaggacagagcagaaagggctggggatatttttgctttgagagctgctctttcaaatgtggcatttctccgtggagctcccttctgtatccaagcaccagggcacttggtgactgagatgataggctttgagcctccaacctttcatccttaggtctgggacccctttttctaaaatcagtgagtctccaatttcagtgtgcttcatgattagccagggagctttttaaaaatgcacattcctaggtccagcctccatgtttctgaaatccaaaatctgccccaggtaattcagtagcaggtagtttttggccaagcctgattgtcctagtctgtttgacacatctgccatttctgatctgaacacaagtcccatcatctcttttgtctgcattttatcctctttccttacctaatgcctctcatcttgcccttgtttcagcttccccatggcctccctccttgtgccccagatctgcagcaagaagcagaacagttgtttctgtcatccccagcctggctgcctctgcatggtgtggagcactcagcccggtgaggagtctggaggggcttagactagggtgatgggttcctgaaggaagctgggacagaggaagaaagaagacccaaaagttactatttttctctccagaaaatggcagaggaagacggatccctggtctcttttggctgtcctgggagccccagtcccatccgacctacaggcccaaagacacccaaccacaggccagatactgggttacaaagaggtaggaggtcaggggtcatgagaaacagttggggagaaggggaggtggtcagagacaagctcagcctcattggggctctgatctcttgccttaggtcttgctggagaacacaaatctctcggctacaacctccttgtctcttcgccggcctccagggccagcctcccagtccttatggggaaatccaactcagtatcccttctggccaggtgactcttgtggagatgggatggtagaagagggtgtctttaatctccagggaagggttccccacctatctcgtattaccctcatcccatgaatccctgtctgtcctgtctcttcccaggggggatggatgaacccaccataacagatctgaacacacgggaggaggctgaggaggagatagactttgagaaaggtaaggtggggctctgagtctgagccttgaggaggaagagcccaggctatcactgggctactgctagccctcccatgtttttgagaaaattagaaaaagatattctgtccataacaacctttactgtcatctgctgggaaatttctacaacaacctttactgtcatctgttgggaaagtgtcatagcaaacatccctatctacagcatctgtcctgtaaatggtatcttttaggtttatataatgtacacaatttgttcaccagtgtgcagtgacctgatttcatgtccctatcctacagatcttcttactattccacctggtttcaagaaaggcatggactttgcaccaaaaggttagttttagtttttgagtggggtgtaggagaagtcatgtccttctcctaaggaacagagatggacatgacaaggttgaccttgttggcttgctcctcagattgtccaactccagctcctggactactaagccttagctgtatgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggttggtggttctgtgtagtggaggcaagaaagagccttgccaccaggatgtgggctggctaggatgggtctgaggggaagaaagggacatcttttgggaggagtgctaattgagagccctctggttgtatctttatcactgctacccctgactcttccaggaagcgtccacagctgtatccaccccagaggccccagagcctccatctcaggagcagtgggccatccctgtggacgccacctcccctgttggtgatttctatcgcctcattccccagccagccttccaggtactttggccccatcttcacacgctcctctacctctttctgggtcacactcccagccgaccccttgtctcctctattggccagaggtcagatccatcccaggccagtcttggtactcagtcccagcctcggctggctccggccttcatccgcccgccctgcgtgctccatgagcaggaggcagcaaggccccgctcctttcttcagctcctgtctatttctctctcccatagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacggtatgagttcctttgccaacctcccccttcaccagccagccccattttctcctgcatcctttgaaaatctcatctcttcccccacctctctagctcatcctttaagtgagaggttcagggctaagactgagacaagagcccagagagaaatgaaaagacatggtggggagaaagtttagaagaatgacctgggttagtttaggaaggggttggggacagaatttttctggggttatatcatgcaggagaatgtaagggcagtttgggtgaagaagaggagcacctgagcttctggggcatgcttccacgagggctccatgtgggagaggaagtgcgggccatgagtctgcggagggactggctaacttcatgctctcttcccagcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcggtgagagatggacactcaatacaggggagttttggctgggaagatgtggccgttgtggagagtgtgctgtctgaggagggggtggagacgagccactggggagtcaatccttggcctcttctccccagctccatgctgtacagtggctcagatgttattcgggacctggagtgggtcatctttgatgaggttcactatatcaacgatgtcgaggtaagggccatgggctccccagaacccggcagtcctctcctttgggaccagttgagcgtctcccttattccacacactcagggccccttactgctttctttacccccatatggaatcctgtgcctctttatgggcagaagggcggcccctgccctcatgtgacctcccttccctctctgtgcccagcgtggggtcgtgtgggaggaggtgcttatcatgctacctgaccacgtttctatcatccttctgagtgccaccgtccccaacgcccttgagtttgctgactggattgggtgagacgtgtgtcccgggttgcctgggtgaagggggctacagtactccttgattcgggtgggggactaagtctaccacagcaaggagagcggtcaggccttaggggtgatgctggggaacatgtcccacctggtggctgtgggatcccctttgggtccagattactttgcatgttgaaatgggatgagatgttgggggatagccttccattctgggtctcagaaaagactgggtaaagttggaggggtagggaagggggtggggatgtgggttccttcccacgttcccacccctgacctgcttccctctcctttcttcaggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtaagcctcgagatgggggaaagagttagggctgggcccccagctggacattgtggctacccctccctgtgccccaggtactatgcagctgtggaggccaagaaggagagaatgagcaaacacgcccagacctttggggccaagcagcccacacatcaggggggccctgcacaggtgagaactgggagggttttgtacctgccagcacctgtttttcctcctatcttttttttccccttgtcccccaggggttttgacttgagctttgagcactgccccagttaacactagctcacctctcattggttcaggaactcaacctctgctccttccccttccccttccttctccaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtgcgtctgtgtgcgtctgtgtgcgtgcatgcacacatttggcagactggtggggatagggtgttccgagactccatccctgaccatgggcctcctcccaccaaaggtcctgcacatgtcagagctcctgaatcgcggcctgggtgtgcaccatagcggcatcctgcccatcctcaaggagatcgtggagatgctcttcagccgtggcctggtcaaggtgcatgtggtggtggaaagggactcctcagggtgcttgttgcccacttaggggctgcccagagggcagaggggcagaggtttaggcaggccagtgctgtggttaagaatctgggctctggattcagactacctgggtttgaatcccaggtacaccatgtattcacagtatcatcctggaccaattatttaaccttcctgaactttaggtttcccatcttaaaatggggatgcataagatatgaatacgtaggtctcagaaaagaaacccaggaagctagcaagcattcgaaaagttattagtaatcagaaatatacaaattgaagtactcacaagatacgactttacagctattagactggtaaaatttaggaaactagttcatgccgagtgttgccagagatataggaggttgtagggttctgggaatcctttacgggatgcctagccagtttggaatgcacgctggcactatttagacaaaataactatattggccgggcatggtggctcacacctgtaatcccagcactttgggaggctgaggtgggtggatcacaaggtcaagagatcgagaccatcctggccaacatggtgaaaccctgtctctactaaaaatacaaaaattagctgggcatggtggcaggtgcctgtagtcccagctacttgggaggctgaggcaggagaattgcttgaacccaggaggcagagattgcagtgagccaagatagcaccgctgcactccagcctgggcaacagagggagactccatctcaaaacaaaaacaaacaaagaaacaaacaaaaactatatcatactctgagcttatatttcattcctgggtatatatcacaaagaaattctcaccctggtctgtgagagaacatgtacacccatcctttgtttgtggtggcatggtgttggtagtaccagggtgcccttcactgggagagagggaaggttagtgtgggggatgcacccatagagtgttctgcagcagttggaagcagtgggttagatgtggccacaggaacatggacagatgttgaaacactaggtggagaaaaagaagcaaaaaaaaatcagatatataaccactttttatatgaattataaactacaagctcacaaaagaagacatgttctataagatcatatttatataaaaagatatttgttggatacattggaatgattgcagtcagggatgggaatgggatatgaaggtaaaagttaagaaatagaaataagtagctacataagtaaaatgaggaaaacaataatacctgccctatagatttgcctggagagttcagtgagatcccataagtaacaactgggatggtgccttatgcctacaaagtaaggtgggcttggccagggctgggggtgtgtgtatgtagagcctttgctgatcctttctgttctcctctgtcccaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggtgagcgggccagcatgctcggcagggccccagctccaggaccttgctggattctgtcttcgattctcctctcttctttttcttcttccttttttttttggagacagggtcttgctctgttacctaggctggagtgcagtggcacaatctcgggtcaccgcaacctctgccttccaggctcaagggatcctcccacctcagcctcccaagtaggtgggattccaggcacatgccacacaggcctggctaattttttttttttttttatgctttgtagagatgaggttttgctatgttgcacaggttggtcttgaacttctgggctcaagcagtctgtctgcctcagcttcccaaagtactgggattataggtgtgggccacagcgcccaacttcctccgacttttttgttttgcctgggagaagctgaggtaggagtgagtgaatccaaggatgagattggagcccatctcttccagttttctcccatgtgaatatggagctagatggggcctttgagtccatttatttcagtttgctcccttatgttacagaagaggtgagcaagtggtttgtccaaggccccatggttgcagagctaggaccggatctgacgggagtaggcccagtccagaagactggctggggttcagtaggtcccaccctgatctcagtgacttctgtgacctgactccaggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggtaaggagcctggggtaaccagtgtgtggagcaggaggttggccaaagacaggctgggaataggtaggcatccagaggccagtgtgttgagggtggggagtgtgacagattgggcctggagactcccctttcacagcttcccctgctcccacccaaggcccatgaacaggccctggctgaactgaccaagaggctgggagctttggaggagcctgacatgactggccaactggtcgacctgcctgaatattacagctggggggaggaactgacagagacccagcacatgatccaggtgagcaagtgtgagtgctgaggaggtgataggagaagggaagagaagatcgtgttactctaggtgctactaaacttagtccaagtgtctgtccctgtgatgcctcctcccatctgtcctttgctcttcagcgacgcatcatggagtctgtgaacgggctgaagtctctctcagcaggaagggtggtggttgtgaagaatcaggagcatcacaacgcattgggagtgatcctacaggtgagggtgatgggaatttggactccagagggtgggagggagcaagccctctctccattttccccacttggccagggcaggttgcgtcatcatagggccctcattttcccctcttgccctccttttcaccctctcccttcccatcaccacatcatgctcactccttcctcccaccaccccaagaagtctgctctgatcgcttgacttggttgcccctctctactggtgagctctgcatggttgcttcctgattcctgcccaagggtgggtatctggtctctgcctttgatgtctactcatcacacccccctctcctggcctctctgaccacccccaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaaggtgagagtgtggcagatgtctgttttctgccagcagtataagcaggatgcctgggtccatggcaatgtctgccctgctctccccttttcacagggccttgtgaccacaccgtggtcaagctccagccaggagatatggctgccatcaccaccaaggtgctccgggtgaatggggagaagatcttggaggacttcagcaagaggcagcagccaaaattcaagtcagagatgctagggaggcccttctcctccagaggggcacgtagaggcagggaggggcagtggtctgggagtttcctccagcctgagggagaccatgaagtggtggggttgtagtgagggggctcccccagcctaagggagactgtgaagtggaggttgtagtaagagggcttccacagcctgagggaggcttctgggggagagaagatcttaccccagatcttaagatctgctccctcttcaggaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccaggtaggaccctgggtggtaactcccaagctgggagtaggggcttttcctctgtggtcccctgtagactgaccgcccccatctcagcccttgtcctcagtgcacccctgctaaggggcaaggagaaggctgacgggtggctctctgcagtacctgaagctgcgggagcgaatgcagatacagaaggagatggagcggctgcgcttcctactgtcggatcagtcattgctgctgcttcctgagtaccatcagcgagtagaggtgggtggggcagtggttggggcaggggggctaggggacagcagtgtgtccaatgcccaccctttttcttgcaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcaggtaggggacaccacccctttctccctgccagggctgtggcattcctgaccttcaccttcaggtagtcccccaggtgaccccctccagccctgtaagtgccccaaggatggaaaatggctgccttcttgatctggtccttccctgtcctggagcaggaaggcaggccttaacctctccttctttcctgcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcac

SEQ ID NO: 1974 - DNA, 6556 bp, Homo sapiens
  source 1..6556: mol_type = genomic DNA
gtgttcagtatcaaatctagttttaatcttctataacaagtcaccttttcttcccacctatatccaactgcgcctagtggtacagtgagaatgatggcctcctctctttccctggagtctgaggtattggcaacagcagtcacccactgctgagaggacttaggacccagcagaagtcaagggtcattagtgccctgcagctgcagggatagcctcacttcaggtggggatggggtaggatgcgggcaggacagggcctaggaaaagaagaagggtacaggagccttcctgactgcagaagtttcctgtttgtctgaaggcaggaaataggagctaacggagtctaaggccaaaggttatcttttaaatagagcataggatcagggagctgggacctcactagccactgataacttccagcgccacccgggtgacagaaaaggcgcagaaatggaaagtgaaaggttcagggctagccaggcaggcccctccttttctccccgcagagcgtgcagggggaaggccaccgtgggatggtgctccggaacctggactctcttcactcagccttcttggacactcggcccatcttggtgcggatgtttcgtaggaggaagaaggcagccgtgctggccgcacaaatcacttcagccacccagaaggctgtgctccaactgtagtgcttggcaatggtgctgaagggcagcccagccagaaagccgcccactgtcagggggaaagggaagaacctaagccagtggtgctagctccagcttctcactggtctatatgcaaagcacaggtgggggtgagggagagactctagaagttaacacttaccattggccatgagtcccacaatggcgtgggaggtgccacacaagttgggaggggcactctcgttggctatgactccaaacagggcaatggggccatacgaggagaaaccaaatacagctcccaataccaggatccagagctgccaagggcagagtggagtggcattcagagtcggaaagccgacctgcctacccacccctgccaaagcaagaagaaggcttggtccccagaaacaaacagtagtcataaaaggacagtaagtaagtgattcttttccttccactccccaacacaactgacaatacagagctagagtaggagatgccacattgagcaaacccagggacctaggtgggcaaggaaaggaggtacagaagtcatccctctgagctagaggctgtcctcaggatttacacaaactggattggctaggggtaaggcagaagggtaggacaaaggtgagacagaccaggagaaaaaccagagatatctttaaggcacctcatgctctgtaaagcctgtgagctccgcgagagggtgaagagccagagtccagaaagcaacatcctagaggagcacagggaagaaaagaaaaccaggcccagagtggaggaggagaacccagacacagaggaacggtccaatcagaactgaaaagggtatctgagaggcgaagaaaagattggcccaggctgaagccaggagagggagacagagtcagtggcccttgcgttctctccttgtgccctgccgtgagccaggcctttcttaattaccttgggggagtcactggtcactgttacccggaagaggtacatggacactgtcatgccagccatcatgaacagcaacaggccatggcgagggttcccgtagttggacagtcccgcctatggatacagtcccggcaatgtcacgtcctcagaacagggcagagaacacccacccctggactctgacacagcagggcctctgctgacgggtctttggcaatcccaccacagttcttggccctgggcagctctgggaggccctgggacctgctcattacattctgaggccaaactctacaacatcccctcctcccccgtcaggcaggactaggacacgtgctggggagggcacctagtctgttcccagcccattttcctggggctgtggagcaacctacagctaagctaagaaatattctggctgtccttcacatcagttaaaactctacccaagagccttacttccacaaccgtaggaaagctaagaccagcctggaatcattccctcttcacccggtctaaaccagcagatgccaacctgcctgtgccctgggactcccatctctccagtgcctgtcccagccacgccgtgaagactgaaagggacccttctccttcctgtcccttctgcccgctcacctttgccatggcccggtctgacaggtagccagctgcgatgctgcctacaaggcccccaacttccagggcactcatgtaggagctacctgcagtagggagttgtggtgggaagagggaagggaagggtgggagggtgttacacattggggttgtcccacaatggcttaaacctggagaggtacagggttcccataggtgactggccatagctgcctgagtagcgcccggcctcaaggaacgaataaagaggataaatggaagcaaggcctgaatttgcatcccctgcattggttcctgctccttatgcccacccttgtccccatgctcatcttacctacaagggctgactgtcctttctcctggataaggaagaactggccccagtcagtacagcaggtctttactccaaacaccacaaggtaaccagtggagagcacccacaggtaaggggacagcagcagctcctgcagggtgctctcctccttcaaggagcctggaggtgggaaaaggctgggcgtcaggctctgccctgactgctctccccaacctgaacccccaacattcattaaccagccacaggggcagagtccatctgcacagccaggatcagcatgaagggtattccctcaccccactgctctcctctccccctctccgctgcaaggtcaatgaatgagaaacaggaccagggaggaccaagccacttaaggaccaagctcaatgaatgaaagacaaacaggaccaagccactaaagctcatgattctatctatccaggacagggaagtctgtgctgttgtgaggaagggccagaaaataacgagtcacagcacttgctggctctgccgcttgtccagtacttgactgcctcttgggatggatttgtgtttgctacccatgcagcctacatcaccacctcttcccccacatccactgaccagcacaggaccgggcaaacgcctagtcttcaacaaacatctgcctgctaaatgagtgccccagtggtcggtctgggtgggggctcacccttcttgccctcagagggcatggggtccaggttgcggagtccaacatcagcaggttcattgtggatgagcaggagacagaggaaggagacaaccacaccacagtgccccagatagggccagcgtgctgcgccagctgtagctctgggcaaggatggttgccaggatagggcccagccctccagccaggttcatgctggttgacaggatggcccaccaagtgccaaactgagatggctcaaaccactgtggggcagagggcgacacgtaggtgtccagcctactgcccatgttgagggtggggtcagatggggcagccccagaagctcacattacagggaagagggagagggcgcttctgtttggcagggcagtttcctcctctgccacctgatcccaccactctcagcctcctaaaatatcttgacaagcaataggagctggccaggaactgctcaggaacctgctctgggttgggtgtggaggtggtgggtaagaaagggcgctcccacatgctctttaggcatcctctatgacaatccaaacaggctctttggaagcactcaccttccgcaggaccttcccacatgggggccagcccagcccctgggccaggccattaaggaaccagagggcagcaaagacaggtactgtggagctccaggcaaagaatatgttgaccaggccaaccaggagcagcccagaagagaagagccagcgagcactcatctggtcagacagcaccccactgacaaacttgctgatagcataagctgccgactggctgctggtgatgaaccctgcagggaacattacacttaggggttagggaccaggggagaaacacaggagcaatgaaagaaggcatggggtcaggtgtgcaggggtgcccagtggggtgagacaggttacttcccagaggaacaggaggagcctgtgctgcaatctgacactcatggggccctactacttcggccacttctcctgcctcaccatcggcactagccccagactgacccatgattctcagctacagttgtcagggaacaaaaagggagcaggacgtggcagttccccctccctgggatttgcatatgggatttcccacctcactctggatgccagtcccgggcctctagcagttctgttgctccaccacccaacatggggcaaagggctcaggattggagtcagggaccttgtccctcctgaagggtagcatgccaggccacatgaagtcgttgtgccaactttttagttcccagtgctcacagtgtcagtagccagcactcaccctgaagcctccacatgcacccacacaggtgtgaaaaccatgctcagaagcccctcaaacactctcggaataaacagtgcctccagggcatgcacacacacgtcaaataagcagccctccttagccccgcaggcacccatgtccatggatctcagagcttctttatctggcatatgcagactggcccctggcctctactgtgcagacaatccacccacaccacatgcctgtacacaaacacccagtgtgtctggctggttctgtgtccccaggtccaccaccctgctgtttcagggctcacccaaatcatccttgtccaaagggatctcttccaccaatgatggcatgacaaaggagaaggtcttgcgattgaagtaatacaggctgtagcccccaaacatggctgagaagatcacagtgcgataatagccatagccctgggctgccatggtagaaaagagcaggccctaccagccaagacgcacagcctctgaccacagttcctgcttgccgctctcacagttcccagatctgctgagttgggttttttctgctccctcctccacccagcctcccaggctccctttatagccgccttctggacaatcattaagcctggggaggctccaaggggacccagtgtcctgagggagacaagaaaacaagagattactgagcgccaaactgtagggggtggaggaggtcccggaaggaggcatgcctgtgagccaggccagcaccctgtgtccccaggatttctgcctttacctcctctatcatgtctgcttgcctgtgaaaccagctttgattaaaggttcaacctaattacttttgtctgcctgagcccaggggaggcaggggtgggatgagcagagatgccctctctagccctgctccctcagtcacagaaccttctcattcattcacggaaggtttattaacttactagttgacaggcactgcacttggcactattagtttctacacccactcaccaccaccgcaccaaaacacaaagtcagacacataccccggctaccccacttctaagccttctagagagggcctcaatccgtggaactctcaatacttagcacataatagatttaattgtttcctacagttgccccttgtaattctgtgcaagggggacctccccagttcaggtcccacggtgtcacacagaaagccccgctaagggctgaggtcctgatggggccccacagagctacctctgggtccccattaccctgcgacgtcagtctgggcttccttcgggctagctgggggctgcagggtctggtttccaacctgtgggacgttggcaggggccgcaagcagagggactgggcagctcgtgggcgggaaggtgccccggcgggcttcgggctgcagggcacaaccgtcccgcccagggccccggcaacatgccccggcttttccgctcaattgggaaagcaactggagcagaaggcgtaggcgcacgcggagcgggcgaccgcacgtattctcccggaggccccgcgcttctggcacccagaggctcagcctggtaggggagggccaggcggcgggcgggagaggaggagaggcggcgggcggcgaagaggcggcgggctcgtggcacctgcccagccccgtgggtcctcacgctacccaggacacgctactgtgcggctgggaaccacgggggccgggggtgcaggagctggagaggtgcggagaccacaggactggcgcgatagaaaggggtctcgtgctggtggtcagggacagcgcctcggtggccccaagacccatgaattgtctctggaactgcaggaacagctccgggtcgtatcggaagttggggttcgccaacaatggctccccaagacctgagatccccgccctcaggtgactcccctcccccgcataccgcctcctacctgaacagaggcgggagcccgaataggacggggcggggctagcgaaggctgcgcaagc

SEQ ID NO: 1975 - DNA, 6556 bp, Homo sapiens; identical to SEQ ID NO: 1974
  source 1..6556: mol_type = genomic DNA

SEQ ID NO: 1976 - DNA, 6556 bp, Homo sapiens; identical to SEQ ID NO: 1974
  source 1..6556: mol_type = genomic DNA

SEQ ID NO: 1977 - DNA, 6556 bp, Homo sapiens; identical to SEQ ID NO: 1974
  source 1..6556: mol_type = genomic DNA

SEQ ID NO: 1978 - DNA, 5218 bp, Homo sapiens
  source 1..5218: mol_type = genomic DNA
gtgttcagtatcaaatctagttttaatcttctataacaagtcaccttttcttcccacctatatccaactgcgcctagtggtacagtgagaatgatggcctcctctctttccctggagtctgaggtattggcaacagcagtcacccactgctgagaggacttaggacccagcagaagtcaagggtcattagtgccctgcagctgcagggatagcctcacttcaggtggggatggggtaggatgcgggcaggacagggcctaggaaaagaagaagggtacaggagccttcctgactgcagaagtttcctgtttgtctgaaggcaggaaataggagctaacggagtctaaggccaaaggttatcttttaaatagagcataggatcagggagctgggacctcactagccactgataacttccagcgccacccgggtgacagaaaaggcgcagaaatggaaagtgaaaggttcagggctagccaggcaggcccctccttttctccccgcagagcgtgcagggggaaggccaccgtgggatggtgctccggaacctggactctcttcactcagccttcttggacactcggcccatcttggtgcggatgtttcgtaggaggaagaaggcagccgtgctggccgcacaaatcacttcagccacccagaaggctgtgctccaactgtagtgcttggcaatggtgctgaagggcagcccagccagaaagccgcccactgtcagggggaaagggaagaacctaagccagtggtgctagctccagcttctcactggtctatatgcaaagcacaggtgggggtgagggagagactctagaagttaacacttaccattggccatgagtcccacaatggcgtgggaggtgccacacaagttgggaggggcactctcgttggctatgactccaaacagggcaatggggccatacgaggagaaaccaaatacagctcccaataccaggatccagagctgccaagggcagagtggagtggcattcagagtcggaaagccgacctgcctacccacccctgccaaagcaagaagaaggcttggtccccagaaacaaacagtagtcataaaaggacagtaagtaagtgattcttttccttccactccccaacacaactgacaatacagagctagagtaggagatgccacattgagcaaacccagggacctaggtgggcaaggaaaggaggtacagaagtcatccctctgagctagaggctgtcctcaggatttacacaaactggattggctaggggtaaggcagaagggtaggacaaaggtgagacagaccaggagaaaaaccagagatatctttaaggcacctcatgctctgtaaagcctgtgagctccgcgagagggtgaagagccagagtccagaaagcaacatcctagaggagcacagggaagaaaagaaaaccaggcccagagtggaggaggagaacccagacacagaggaacggtccaatcagaactgaaaagggtatctgagaggcgaagaaaagattggcccaggctgaagccaggagagggagacagagtcagtggcccttgcgttctctccttgtgccctgccgtgagccaggcctttcttaattaccttgggggagtcactggtcactgttacccggaagaggtacatggacactgtcatgccagccatcatgaacagcaacaggccatggcgagggttcccgtagttggacagtcccgcctatggatacagtcccggcaatgtcacgtcctcagaacagggcagagaacacccacccctggactctgacacagcagggcctctgctgacgggtctttggcaatcccaccacagttcttggccctgggcagctctgggaggccctgggacctgctcattacattctgaggccaaactctacaacatcccctcctcccccgtcaggcaggactaggacacgtgctggggagggcacctagtctgttcccagcccattttcctggggctgtggagcaacctacagctaagctaagaaatattctggctgtccttcacatcagttaaaactctacccaagagccttacttccacaaccgtaggaaagctaagaccagcctggaatcattccctcttcacccggtctaaaccagcagatgccaacctgcctgtgccctgggactcccatctctccagtgcctgtcccagccacgccgtgaagactgaaagggacccttctccttcctgtcccttctgcccgctcacctttgccatggcccggtctgacaggtagccagctgcgatgctgcctacaaggcccccaacttccagggcactcatgtaggagctacctgcagtagggagttgtggtgggaagagggaagggaagggtgggagggtgttacacattggggttgtcccacaatggcttaaacctggagaggtacagggttcccataggtgactggccatagctgcctgagtagcgcccggcctcaaggaacgaataaagaggataaatggaagcaaggcctgaatttgcatcccctgcattggttcctgctccttatgcccacccttgtccccatgctcatcttacctacaagggctgactgtcctttctcctggataaggaagaactggccccagtcagtacagcaggtctttactccaaacaccacaaggtaaccagtggagagcacccacaggtaaggggacagcagcagctcctgcagggtgctctcctccttcaaggagcctggaggtgggaaaaggctgggcgtcaggctctgccctgactgctctccccaacctgaacccccaacattcattaaccagccacaggggcagagtccatctgcacagccaggatcagcatgaagggtattccctcaccccactgctctcctctccccctctccgctgcaaggtcaatgaatgagaaacaggaccagggaggaccaagccacttaaggaccaagctcaatgaatgaaagacaaacaggaccaagccactaaagctcatgattctatctatccaggacagggaagtctgtgctgttgtgaggaagggccagaaaataacgagtcacagcacttgctggctctgccgcttgtccagtacttgactgcctcttgggatggatttgtgtttgctacccatgcagcctacatcaccacctcttcccccacatccactgaccagcacaggaccgggcaaacgcctagtcttcaacaaacatctgcctgctaaatgagtgccccagtggtcggtctgggtgggggctcacccttcttgccctcagagggcatggggtccaggttgcggagtccaacatcagcaggttcattgtggatgagcaggagacagaggaaggagacaaccacaccacagtgccccagatagggccagcgtgctgcgccagctgtagctctgggcaaggatggttgccaggatagggcccagccctccagccaggttcatgctggttgacaggatggcccaccaagtgccaaactgagatggctcaaaccactgtggggcagagggcgacacgtaggtgtccagcctactgcccatgttgagggtggggtcagatggggcagccccagaagctcacattacagggaagagggagagggcgcttctgtttggcagggcagtttcctcctctgccacctgatcccaccactctcagcctcctaaaatatcttgacaagcaataggagctggccaggaactgctcaggaacctgctctgggttgggtgtggaggtggtgggtaagaaagggcgctcccacatgctctttaggcatcctctatgacaatccaaacaggctctttggaagcactcaccttccgcaggaccttcccacatgggggccagcccagcccctgggccaggccattaaggaaccagagggcagcaaagacaggtactgtggagctccaggcaaagaatatgttgaccaggccaaccaggagcagcccagaagagaagagccagcgagcactcatctggtcagacagcaccccactgacaaacttgctgatagcataagctgccgactggctgctggtgatgaaccctgcagggaacattacacttaggggttagggaccaggggagaaacacaggagcaatgaaagaaggcatggggtcaggtgtgcaggggtgcccagtggggtgagacaggttacttcccagaggaacaggaggagcctgtgctgcaatctgacactcatggggccctactacttcggccacttctcctgcctcaccatcggcactagccccagactgacccatgattctcagctacagttgtcagggaacaaaaagggagcaggacgtggcagttccccctccctgggatttgcatatgggatttcccacctcactctggatgccagtcccgggcctctagcagttctgttgctccaccacccaacatggggcaaagggctcaggattggagtcagggaccttgtccctcctgaagggtagcatgccaggccacatgaagtcgttgtgccaactttttagttcccagtgctcacagtgtcagtagccagcactcaccctgaagcctccacatgcacccacacaggtgtgaaaaccatgctcagaagcccctcaaacactctcggaataaacagtgcctccagggcatgcacacacacgtcaaataagcagccctccttagccccgcaggcacccatgtccatggatctcagagcttctttatctggcatatgcagactggcccctggcctctactgtgcagacaatccacccacaccacatgcctgtacacaaacacccagtgtgtctggctggttctgtgtccccaggtccaccaccctgctgtttcagggctcacccaaatcatccttgtccaaagggatctcttccaccaatgatggcatgacaaaggagaaggtcttgcgattgaagtaatacaggctgtagcccccaaacatggctgagaagatcacagtgcgataatagccatagccctgggctgccatggtagaaaagagcaggccctaccagccaagacgcacagcctctgaccacagttcctgcttgccgctctcacagttcccagatctgctgagttgggttttttctgctccctcctccacccagcctcccaggctccctttatagccgccttctggacaatcattaagcctggggaggctccaaggggacccagtgtcctga

SEQ ID NO: 1979 - DNA, 11570 bp, Homo sapiens
  source 1..11570: mol_type = genomic DNA
cactttacttactattagttgtttattatgtcaaccttaaataatgagattcagaaaataagactaagtatagagtttctttgagtgcaaagtttgagaatagccacccagtaagcattgactccaaaggcatggggtgagcattccaaactggagaagttaaggtttcacttccacaggcaaagagagaggaattttagcaggattacaacattttccatacaagaccagtgcgtatgttacagtgctttgattggttatagattgctacattccaaggaagatgactttattaccccctgagaaagggtggtgatctaagtggggatctaagggagtcttatctctggtgccatttggtcttcctaagtaattacagaaaaaaaaaaaataggtggaagttgcagctgcatgccccatgactcaggctgcagagaccaattcctgtcaaggctcagaataacttaaagttccaagagctttaggtttgatttaacaaagcttgaataatagtaataaataatattattaatctcaaaatcctgggctcaagtgatcctcctgcctcagcctcccaaagtgttgggattacaggcgtgacccaccatgcccagctgaattatttaatttcacagttataaaggacacagctcaagaatagccaaatggaagagatacataggatctctacgtatggagggtggaggtgtggatgccatgccttctaccaccttcccagcacctacacctgtttatcaacctggaggctcttcaaaaccccttgtttgggggtttttatggaggttccattatgtaggcatgattgattaaatcattggccattggtgattgaactcaatctccagcacctctctggaggctgggaggtggggctgaaagttccaatcctctagtcatgccctggtctccctggtgaccagccctcttcctgaaactatctaggctacccccatagcaccccccgggcccccagtggggaatcatctctttagcatacaaagacactcatcactcaagagattccaagggttttagcagctctgtgccaggaactctgggcaaaggaaaaatatttattttttattacactacaagggttaaggtagacatcaaggtggacatcaggactggtgtcctgccctgggcccagcctcgggccagtgggcctcccagcacctgcctggctacaagggtccctagatgggtacaggggtatcttcctcctttcctttctttctccaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaaaggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcgttttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacaggtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataacttttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggatagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcattacccaatcagaacagccgggatgagcaggaggccagctcccaggaggaaggggaaccccttcataaagttcagagtggctgggtagagtgagttgaagaatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggacagtagctggcacagaggggctactaaacaaatggctgctattaaatccacattaaaagtacatgtgatctgacagaacccagcacataaaagaaaaaaaaaagtacatgtgatattgtctgatgaaagcttgatggaaatggcttttttctggtttatcctctttggaatcatctcctgtttgggattaactgctggtctgatcagttccaatattcatagcggtgtcaccactgaatagcttcttatcctttgggttcctgttcctccttctgctaaataaggataatacctatttcctagattgtgagcaacattaagttcacatggaaatcacccatcactgggcctggtcccctggaagtagctagttagtaagggctgttcttttctcctgtttctcttgacatctctgggcacagagaaagtgctgggaaaaaaagtttaggtgaatgaatgaagacacatggattctggggacaccagaacccacagtgggctctgtatggcaccagagtctctgtcatcatcagatcctcattccaggacagatggaaaaagatgaatgtttccagactggggcataaagacccagaggctggagaagctgttctttatagatataccaggagaacccacagtttacaaaatgtgcaacaacccaacagaagttgagattaaattctgtcacatctagaggggtctgtgatgtcatcaaaagcaaaccacccacatcacagatgaagaaacaggcctgtggcagggctcggactaaaacccagatcctgagaccagctgcttttaaacacagacgtaggtttgcatcctagctccaccatttactgagtaaccttgggtgagccaatgtaaccccctgggtctctgtttctttatctgtcaactgtggaaaatgaaacccatgtcacaaggttgttcacttctgggcttgtacacgctgaccccagagaaacagggaactctggcatcaccacacccatcttacagacggaaaagctgaggtctgcagagagtaaatcctctgctctggttatctagaaagaacataattgtgctctgctgactgcaaatcccaactctgcggtttgaaaatccaaggtggcatgatcctctgcccattgtgggcaatttcacagaaatgtgtttgttttggccacttacttctccagggtgagaggggggaaggcaagctgttcccccagccatggctgcccatcagcccgtttcgggcagcactggacatgaggaaccagacacaggtgggttctgacactcaccctgctctgtctctctcaccagcttggagagtttagcccggatgacaggtgtgatgactaatgacaggaaaagcaacccatatcctgtggagaaacaaacactcatcaggaaaatggggctggggagaggggcgtccaagggaaaggcagcagagctcctatccataccccacgtggggcttaggttagacccaggaagaacttccttgatggtgagggtgggaagacagtagtcaaggaggaatggagactgcccttgtctgggcttggccacctgctagctctcatgaatgaatgctaattcccattgattgctttcttgtctgaacctcttgtggtcacagcaggcatcacccacccacttggcacttagtagggatatggcagggcacagaaaacaagcatgggctttggagtcagccctgagttcaaaacctgatgccattacatattatctgtgtggcctggggtacttaccctctctgatcctgactccctgtatgaggaagataataaggccttcatcacaggatggttctgaggcataggaggctgaataatggtgcccaatggcatcagattcatagccctggaacctgtaaatactaccttatttggaaaatgagtctatgcaggtgtgcagttaagcctcctgagagagcagagttatcctggattaggttgggccctaaatgccgtcacacatatctttataagaggaaagcagacggagatttggcaccgacagaattgagaaggcacaaagaggaggagagtcaatgtgagcacagaggcagagactggtgatggccgccccaagccaaggaatgccagcagccccagaagctggaagaaatgagaaacacgttctctcctggaggcttgcaagggagcactgcctgctgactgcttccattcagcccggtggtactgactttggacttctggcctccagaactgtgagagaatatgtttctgttgtgttaagcccccaagtttgtggtatgtcattacagcaatctcagggaaccaatacatgaggtaaaaaggtaacatctatgaagagcatggcatagggacacagcaaatgggagttccttttccctttgcattcagttacttacaggcttcctgttttcttcataaccatttctctccctgtgcgactgctgactcctcagcaaaactgcaaactcctacaggacagtggatcctccaaagaaggtatacgatgaggcatccagggaccctagcagtgtcaggcccctcaaatcccactctgttgagacctccccccgacccagagcaatgacagcatctttatcatctctgcatcccccagggccatcagcaggagggaaaggttcccttctgcttaattgtcagacaagcagttgagttaagaaatctgtgattattgtattgttgactatacacagcacattttagggctctatcaaaataaatctgtccctttaaaaaaagttaactaaagccgggcacggtggctcatgcctgtaatcccaacactttgggaggctgaggcaggcggatccttgagctcaggagttagagacctggactgggcaaaatggtgaggaccccatctctataaaaaatacaaaaattagcaaggtgtggtaatgtgcaccagtggtcccagctactagagaggccaaggtgggaggatcatctgggcccgggggatgaggctgcagtgagccatgatcgtgccactgcactctagcctgggtaacaaagcgagaccctgtctctaaatacatcaatcaaataaaaattttaaaaagttaacttcctcatttactggcctgttgaccctctcccatcaaaaaaagaaggggaggaagtgaggagggaaaggagaaggagaaagaggagaagaggaactgaagcaggaatttcatatctgtggtccgagaagactggtttttaaaaaacccaaagaagctgactaagggtatttgaggtaggtcctgtgattcttatcagagaagtgagtaccaggcattaatggcatggactttgtttaagaacatatgaataggcggtgggaggccaaggggtaaagcaattagtgtatgagccacacttttgtcttttgctctatattactaacaatattaatggttgataacagtgggttaattactttagctactgaaggtctatattttccatgtatcaaagatggcatttttgagggatttcttagttgtctgttctccagtgcaggctgggggcataactatgtttccaaagacacaggaatgaaccacatctgggggcagtgagtggccggcccccagttcttacccagtgcctctgggacaagctgtccctgagcccacacactttacctgtgaacatgagaggcgtgatagtggcaaaggcaaagaccaccatccccaggatgttgaaggccaggccgatctcagctacccaggcatcggccaggcagtactgcaggagcttcagggccagcaggctggtgaggtaggggagatgctgagctgcagaaccatagccgattagtttggagtcccagcagaggggtgtgcttagttcataaagggttaagatgtcctgggccccaaagtgcacagtgatcaccacgaagatggccagtgagtagagggctaaatgtttcctggacttctctggggcgggagccacatagagctggacaatggatcggtggtgacggaacgtgaagagccgggtggactttggctcctttaaggtctcaccaaagcagaaagctgcatagagagtcatggctatcagcaaggccaaggccagccagaaggggttggcataaccctgggcccggagccagtggcccccgaggaggcttgccagcatcccagccaccccgatgctggcttccagcagggccatccggaaggtgcggctgcgactggagctgacatctgccacggacgcaaagctagcagccagaaggccaccgaagtcgccgaggagggcacaaaggatgcgacccagcacgaagtagccgacgtggagctgcagctgcaccacaaaaacggacactagggcctggagcagcaggcccagcgaggccagcactagcagcgggcggcggcccacactgtcgctccaagctcccagcagggtggacgagaagagccccaccaggaagccgcccacgttcatgtagagggtccagtgggaggtaagggtctccacttcctgtaggggcacaatgaccagggtgcggttcctcactctgggttccacaatccccaaatcctcgccatcccgggagctacagggatgaggacttcctttggagccctaaacctcagagaatcttagcacagctttcaaaatctgccagtggagagggggaaggacatggaccaaggccccattccctttcctttccccccccttttgttaacctgcaaggccagactttagctcagcttttcgcatcccacccgctgaggttctcggtcaggcccctttgctctggtcccgcccaccatccaaaatgcaccctccctccagttacccgccactaccattacgcaggccccgcccctccgctgcccccacgctccagaccagggccctccacctgccaggctcctcgccgccccgctacctgcatggtggggtccgcgctgcggttgctgcagccccccctttggcgggtgccattgtagccgaggtcggcgctgaagcggtgccacagatactgcgtggtgagcgggccctgcaggaccaaggcaaagttggccaggaagaccagcggctctaccgggccccggcacagcacggcagccgcagggcgggcgcggggcttttccggggggctcgcgctcccctccatgtgcgtgcgcggcggagctgtcgccaggcgggcggcggggcgcgcgagcgactcgctgcctgggaccagcgacgcgtggcgtggggcttgcgctgtct

SEQ ID NO: 1980 - DNA, 11570 bp, Homo sapiens; identical to SEQ ID NO: 1979
  source 1..11570: mol_type = genomic DNA

SEQ ID NO: 1981 - DNA, 318159 bp, Homo sapiens
  source 1..318159: mol_type = genomic DNA
taccattttggtttttatttcttcaaaacatgaaaacaaaaaatgaagtagatgacaatgagaaaggagaaaacatttcatacagaatatgctgtatcactagtgattaaatcagaaacaattagaaactttatttgtctgtgtcagtaatatgtaccatttataaggaagagcacaattagtgcatttcccgccccccccccaagctgtgcacaatacacacaaaataaaataattttacacaactataataataacaatcctgaacaaccagaatcatagtttcctagaacatgaaaatttaaaaagcaaacaaaccaaaaagctttcaaattgaaatcgaccaatgcaagaatttcttaaagttctctgtgaaaatttgctacaggattattgacattcctaatacagctaaaaaatgagtgcaaaaatttttctaatgtttaaacaacttatattccttgaatatatttacttggtgcttctaggctagctttccatttagcaattctcaaaaaaaaaaaaaataaggatgggaaggatgggttagaatgacaaagaattgtaaagtgtgggccatagaaaagttccattgccaacaaagataaaagatgggatacactgggctttctcagtgatctggatcaccaacatgattgcccttcttggtttaaaatggagagatatatttatctgcaagtcggtcaaagataaagagggtggttttccaaacatatgccttatgctctcttagttaaagaaattcttgggtataaatacaatttggacaattgctttgatacagtttcagtgtgtttatgttaaaagagtttcataattgttttttcttgcaagataaaaatctttccatatggctttcttcacttttactcatgaaaatagtaatcacataaactgtaacccttctgagggcagggatctagactgttttgttcatggcttagtccccagaaagtatcatactacctggcacattaagtgggtaaccagcatttaattactcattcagtcaccaaatgtttattaaatgaggaaggatcatggttactgagtgacagaagaaaaaataagtctcaacagctttaatttattaagtatttttgaatcaatacagagggctaggaatgtctccagcctgggattccttatagacacagaagtctccgagaggtgaccaaagtcattctattatttttctcattagtggactcactactttggaatgttgggtttatccatgttctttggtattttaacatagaaacagctattctttttaaagggttaaaaatatcccagtccaatcctcctgggaggtactagtcttatttaattgccttctctttcagcataagtagaggagacaacacttttaaaggcccgttggtcaccctggcttctttcttactcagcaactactgatataatcaaagaggactagactggacagtgaaagaaacagggctcaaaatagccttttaagtaaaaaaataaaatgaacaaaccagcactatctaccatctgtgccagacagtgcagatgtgaaataaatactttgcagggaggggtgttgtggaaagggtggctctgaaagcctaggcacatccaacatatcaacgtctctataaggcctttctccttggccttcctgaattaatgggtgatttttagaggcctctgatgtgttccacatggctaattttccatgaagatctttgtagtttgcctgctatcctctcaatagctttaacttctccccacatgacagttattgcttcttagaaatgaatgtgcagaaccgtgaacaataatccattttctccttttatccctagtaattaatcaaactcaataacagcacaaaagtaacaactcaggtgaaaagaaaactcacttatgtcttcaatgtccaatcaacattgccaaatgggagaacagtatgtactatactctactatatacagatactctttgttttgttttatttgtttttcaccatgcactgtgtaacaggtatcacaacaacatttccgaacggcacatgaagaaggagcaaatgttcagtcatgactggaacaggattgtgcaagccatggatgcctttgaaaataaaactgacagacaatcccaagcaacggcaacatgggactgagacacatgttaatgcaaatggaaaacgatgatgtgctttttgaatggggttattcttactgtttgcataggggatggcaggtggacaggaggaacagggttgggatggggcacctgggggcttagctgggctgaatgctggaagaaggaccttgccaatcacagtccagagctaaagagataagaaagaaaggattttgcacgttcctgggaatctaggcacgttttccttgtacctgttaaacgagactgccaggtatcacatgtttaaatatcagactatttctagaaccatcggatttcctggctccattccacttttatgcttcttcttggaggcagcttcacctccactcacattccggagataagcatgaactttggtaatacgatgaagacatgcttctttcttcttccatgcccagattttttcttaatccaaaataagttttaaagtgattgggggaggtgagggggaatactaatgatttaaatttttaccaaaacccatttacatttggatggtttcactttccacaaagaaaagcaacaaccctgactctcccaaaaaaacaaaacaaaacaaaataacaaaaataaagccaaacattaactacctccccagctccactgaaaacaaaaccaaaaacaaaacaaatcaaagccttaaggatttatcaacctggagagagtgcagcccttctagactgagctgcaaagatggccctgcctccatgccttgttgaacatgatgatgcccctgggaatgggaggtgatggttttttacttcggccctagtacagagtatgctcttgaagctggattccatcagcaggtaagtgaacatgacaaatgtcagtttcctctgtccattatacataatttttatgtatatatatgtatatatataaatttactatatctgatagttcctttagaagccttttatgtggcagtaggcctccagggaggagaagaaaatgtacaagagccataggagcacaaagaggcaggatgtgaggagcttggcagtccggggcccacccagctcacctccgatttctggcctccgccgatacagcagcacccccacattgatgaaagcaaaaatggtgaagagagtgacagagaaagctagtgtgccaggggacactttgaactgttccccattggctgcgtggtagatggcagcgatggaccaggccacaccgattcccaggaagacattcaccgcgttgctgcccgtgacgttacctatggaggcgtctgcatactggtcctgggtggctgccactttgctggcaaatgtgtctgcagaggaagaagagaaagtcaatgacactcaatcttttagagatgtctttggagtgctgcaagcttcagctgtgtactctaggacccaacccttaatataaacccagtgaccaagaaatggctttgatgttcctctgagtcagactcatggggtgaaaagaacaggatctagatattgggagttaagggttcagtgctggctgtgtaatggactgagcaagtgatcttggtcaagttttgtatccacagatactgcagttctttgtaatattgaccttgcagggcagcattttttcagaaagtagtcacagctcacctacatcagaatcaagtggggtcctttcaaagagtgagtattgcaaggtgccatgcggctgtgctggtcataatgacagcggcccaggaatctattttaacagtatcctaaaagattctaggtcactaaagtttcggaacagctgctggagggtattactaaaagatgctgtatcagcagctctagtttatagatgagaaagttaagatgtcgggagagatttttcaagattcaagagcaagccaatagtggaattgaaaacaattgaactataatagagtagctgacatttgcttagagccttaagaataaaaaagcagattcagctatattactgcattgattgtgatggtacttttttattattattttttattattatactttaagttttagggtacatgtgcacattgtgcaggttagttacatatgtatacatgtgccatgctggtgtgctgcacccactaactcgtcatctagcattaggtatatctcccagtgctatccctcccccaacccccaccccacagcagtccccagagtgtgatgttccccttcctgtgtccatgtgatctcactgttcaattcccacctatgagtgagaatatgcggtgtttggttttttgttcttgcgatagtttactgagaatgatggttatgaggtgagggaacgaggcttagagatgacaagtagtggatgcaatatcacaactaggaaaaaaacatgttagggctacagctcctgcctcatgtcttcaaaacgaatgctttctcatggtgcttttctacctttcactgtgctgtgggcaccaatgatcattttcaaagccctttatttactcataatcctgactgtatctttttgtgatgataggaaaatcttggtccactacagaaggttgaacaacagtgacttaaacttcttgatgggtagaacacaggggtttagagcacatttgagctgggggacttcaaatcctgccttcgcagctgactgtgtgactctggaagattacttaacttctctgggcctcaatttcctaatctgttaaatggggatggtactgctcacttcagagtgctgttggtaaggtgaaatactacatgtaaataaaatgcttttgatgctttttggcacaaagtagtaggagaggctgtttttgttgttttggaaacacaatataaaccgagcaggctagatcggtttaaaagttgaggtaggatctgaaatagcttcctgtattaagcatgtgaacagaacttgcaagatactaaatttcttgtccacattatgcctacttacatcaaagtcctggctgggcacggtagctcatgcctataatcccagtactttgggaggccgagatgggcggatcacttgaggttaggagttcgagaccagtttggccaacatggtgaaaccctgtctatatactaaaaatacaaaaaaaaaaaaaaaaaaaaaaaaaagccaggcgtggtggtacacacctgtaatcccagctacttgggaggctgaagcatgagaattgcttgaacccgggaggtggaggttgcaatgacccgtgaccatgccactgcactccagcctgggcaacagagtgagactccatctcaaaaaaaaaaaaaaaatcaaataaagtcctttcagctaccttgcacagtaggattatagcagatattaataactgtcaaattgaacttatttccaaagccagtaacagcaagcattaaatgactgcaaggtgttgtgttatctgctctggtcctcctgaggtcctgggcatgctctgagcatgtatgtagttgtacgatacctgtactagtctctcccctctgttgttatgctattgccaccatccttcctccgtaaacttccagtggggaagatatgtacagcatgtaaatatagatcagcccatggattctcctgctttacaatggataagaaggctttttaggctactaaaaggctactgcatctgcagtatgacattcttcctgaaagggagttggtcaattctgaaggcctatcatcaattctgccctctgcctgtgatgaaaagcagatctgattattatttcataattaaagaagtagacaaacactgcttattccatgctaggcactatgctacacaggcaacgtgtgtattctcattcacccctctcacaagcattatgggctagatgtcattactcctctttcatgatatgagaaactgtgacgttgtgatattatgcctcttggatagggtcttagcaaatgtgaatttttaaaccaaagtctgatttcagagcccagtctcagtccacaccacattgccccttccaggaagcctgaagtttgtctttcctcttagttcatttcaggtggccctgttcctttcactcagaaactttgaagcaggttcttaccaaatgctctttactgtatcaggagaacaaagattgaagaaggtatgggcagtttgtgaatccagactcctggatttgtgctgctttgtgcattcatgatcacacattcacacagcccaatcaactatcacagagactggtgagtaaaagcaaagcgagacaaatcttaatggtttcttgtacttcattattaaaagttaatagaaacagggcagcagcctcaaaaagaaaaaaaaggaagtttttttttttttttttttttttttttttaaggtcaggcagtggaacatggaaagtaaaggaacaaaagtctgaggcaggagaaagcagcttccagctcaggtacagctgagaaacacctgagatgttattctaagctgaaatggctggtagcactggctggtggtgaacagatggccacgttaggtggggcagttgcgggggtggtaattccctctgtatgctacagggacaggtgacctggtgctgttccatagaacacacctgcttacctcccctggcacctgatacattgcacactggacttcctgggtatcccatgtgtactcagaaactctgggctttctagatggcacctttgctgccgcaccagaaggaaaggaagtttaaaatcaaagactcctgggtctggggactcaaagcacccaaaccagtcctttaggctgacatggagggcacacctgggtatgcagtgatttcctctccctcaagccatgtatcagtagcctattaatgtgaatgttgcataaggattcttacttgtaataataataggttcctattttcaaatgtctttctttgaatttcctaagagttaatagccaaagtgactagcttgtcacataagtaaaacatgtttttggctactttgtgtctcataggttttatttacttgggttagacatcaggccttttgtctgtttttattttcaattcaaaagcaatgtaaaaaaaaaaaaaattgcaggaacacacgcaaatccaaaccactaaccttagctccaacagagagaactctgttttccaaatgaagtgcgatggattctccccaaattaccttttattgccgctttgctgctcagcacatagggcaatacatcacataccatatgttaggtgctgccaagccctactttgaacactaagcctgtaacctgcctatggttaaaccaggcaaatgccatatcctaaaataaaatccaagaaataactactgccttgggtttgaaggggatataataatattcagaggttggcccattagataaaaacttttatatatggatcagatttccaatgcgattgacacaaaatatgttgataataacacatgtattttttccttcatctatgtccctggctaggtttttaatagtttttgctattaactcccaccttgaattctaattaattttagatcagtcatacagttttagacttttagtcctggctccttgatacatatgactataaatcaataagaaggaagactgttgaggagacagcatggctggaattaaactacacatcacaaagtcaggacgtaattgttctttgcagacctgcctcaagttcatggtatattaccttgcccaagtcatctggtcaacatgcaaaaataggccaatactctccctttccttcagcaattattctttacctaaatttctcaaactttattgctacttataggctaagccttaaacatctcttctgcaaaaaaaggtcattctcacagtcttgcaggatggatgcagggataatgtattatctggagcaagggtttcgccccagatggttcatcttattcttggctcttagtgttctttggggaccagctgttcagctctccaatgcttcatgcccaggaactgacactggcagtggttttaattggagtccatcctggctatgaaggtctgcttgcttctcccagcaaccagaccttgacgtattcgttcactgacaatgaaagaggcagccaaggtgtacagatcttcatggtgtagtagtggaagaagcctcatcaaagagactctcggctcttccaactgtctgtatgctctcggcaagtcacttcacttttttagattgcagtttcctcatttaattagagtatctctaagactctttctaactttactgtttgggtggtgcacagaatacattaaaatactaaatttatatgcaatgtttgattttgctggtttttttgataggagtttgtacataaccactcttcacaataattaactgatgattataactattttatcattgtgaagaagaaatgacttaaatatttgaaaatcctaggaaaatctcaagacctgaagatactacctttgatcaaactgtgacaatatttatggaattaaactacatggcacagtcatttaccttttaaaattaggtaagaaatgttggcaaaattatcaacttcaaatcactctgactggccattcattgatacgagtgaagccaaggtggcagacagatgaccatgtttcaaaggctgtgtctagtgttaatagtgttagaagtacctggagagctttgcttaaaaaatgtaggtttggggcttcacccccaagcttgtccagcctgccttattttgttgttgttgttctgttttattttgttttaggcttttgacagcctgaagccatggtttttagtttctgtctctagtgataagcagacaggagggatgtcgaaggggctttactggcccagacagaaacagaaactaagaagccatgactgtattctctctcttgggcatccctgctagatccacttaatcagactctctgaggacgggatacagaaatacaccttttaacaagcggcctaggttgttcttatttataccaaggcttgagaaccacagttgtaagacatgggaaggggagatactactcgaagtgcccacagttttgggggccttcctgcgagtaatagatgtttgagtttcagggaagcagctaatcggaaagaagtaagaagctggtttctcttagaaacatggatgcccttagctatagtggttattttgctgataaaatgtgggtaggcgtcacggagatgctgggggctgcttaattgtagcttcttccactcacaatatggttattctcctatttttttaaaccctattccagctaccctaaaaggccaaatgagggggaattacctaaattgattgaattgtgctgctctgtttgccaggttggaagcttacctacttcatagggttttgaaggaaatgagttaacatgaatagaatagggcctggcacttaatgggtgttcagtattattagctatttttataatacaacagagccagatccccagagaatccatacatggtagggaattctgactattgccaatgattctatacttttaaggagttataacaccctttaaaaattattaatttgacaatcctttgcatttaaaagtgtgatagagcttaaaattcttaattattttactttgaaaatttcatacaaccaaagtcattaaaagacattagagctcttttggtttagagcccaaatcttactaatggctgtaaggtagatatctttacttaaacagtgtatatattcctctcttttttcttttttgccttctataccctcatctgtcttgctcttttagaattaaaagagaaatagtgtttacttatgtacttgttcttctgctgtcactgaagaccttaaacaagcatttgtctttggttgcgatatttatttacccaagtaaatagaaaacctctctttctctctcacaagtgcatgcgcgcgcgcacacacacacacacacacgtgtgcgcgcgcacacacacacacacacttcactggttcatgtgaaaagaatcatcatttggcttccaagtgaagttcaagaggtaacagaattgctgatgtttgactgattaataaccaggtagatgaggagttgaaaaaaggaaacacactgaaaatttctgcccataaaagttgtccctgaagagggtaaagaagaaatggagacagtgacatgacctacttttagaagagaaggaagcagcgataagtaaaaagttcaagaggacctatattggcaggatcagggcacctgcttctagtcacttttgtccccagctacaaatgagagtcagcaggacaacttttgaaaacatgaacttgctagccccaccttgagtttctgcttaatcggcctgagatgtggctggagcattggtatttatcaaagcttccccaagcagattgagctccactaactgaccactcacagccctggtttctttgtccctgtaaggaggacaatgatgcctcccttagattaactgaggtaatgatgtatggaatgagtgacacatagatttgtttttagagtaaccatttttgttattgaaaaattagctatttttcatttttgcatgttaacttgaatgtttgcactttatggaggtgccccgggcttagttttcctactttgtatctgatatcctgctgtattttaagttcaaagaaagaaatttattctaattaaaggagagaaaaaaatggaggtttatttttcagggaacacaaaacagtgaagtgaaaggatacaaaccagcagcgcagcactatttgatctgctttccaaactgtaattggagtcatgttctcaaaaggaaatgataagactccactacacacacctagaataggattatttttcagtgtgatgttcacaggtgtccaagagagaatccaaggggtgctgacaaggtctagataactgatacatttgacaacggacagagtgtccaaggaaaatatcaagaagcttcatcatgttcaactccgactgtgactacacaatggtaaagcagctgatcgtttgaaagaaaataaatacaattattccatatagaaacatcaggctgactcctttagcaaacatggataagaaacagattaagaaggagctattttcatgaaagactccttattctttaataccattaatggagataattctctgataaggaaaattacactctgccactcacatacacacactcacttcactggttcatgtaaaaagaatcctcatttggcttccaaatgatgaacaatttttttttgattccttaaattcttggcttctcctggcattacatttgggctgtctttatagtactttaaaatgggctggaatgaacttgcttttaaaatagcatcaagtttttgatattttcagttttaagccatgattctgttactttcataataactcttattttaataatgcaaagtccgtgagggcaaaaagaatcataagatttagttaagcaacatttggctaattttgaaaaggaaaaaagcaagggcaaatttgaagctaaaaacaaatagctgaattaattgtcattttcccaagccagatggtttgttattatatagatataactgaaactaacttcctgcttaaacacaatctagggctgccctgcacagatcggtgtcctctgactcgcttctcctcccttcccaataatctccctctttcagttaatcctctttgcatttgaagcctagttctttcttctatgctttgttctatttctggaacatccatctcctatccaaatctcctcaaattctcttctctcctattttagagatagtaaagacataggttcgcctgtcttgctagagctagctgagaaggatcagatagagaaactgtactctaacttgaagagaaataaaaagaaaacagaaaccttcattctcacctgcaggtagccttaatgggttataaggaaacttcgttgtcagctggattatactggtgtgattctaagtgtatggatctagacaatacaccgaagatgcccaaaatgtgcctttccccaatggatatctacctagttagttactcactccagagacacttttttgaaggggctgctttgtgtattatcagttcacaaaaatatgaacactattaaaagtaggccactgcatgcaacctcaatccagcacaggaggcagcaggtgacacttgaggacacgtgagacttgaatgggttctgaaagtttccaataattcacctattttgccttccaccttgctgtgatttggtgtaaaatttcctccattaactcattcctacagattagtcataggatacaaaaaagcatatgtgcctatcaaaagcctgaaaagtctactaactatttggcccagcaattctctacttctgaggctctagaggcaattttacaaacacacaaatttatatcagggattggagcagagtttctatgttagagaaaaattagaaacaattgtctatcattttagaaaaaataaattgcaacttcatataacatgatactgtgcaactgttaaagtacactaagaaaaacattcatgacacactgctttgtgagaaagcaggttatgtaactatgcctactattagtccataaaaaagtatgggtaaatatttgctatatatctgtatacacattttttgtgcaatttacttaaatgtcccaggatttcacaattttaaaggtgcaaatggctgaatgtagatggtggtgagatggcaggatttctttttgttgcttgcttattaacattttctatttacaaagagcatgtattgtttattgcttgtgctactaaaaactaataaatataggttaaaaatagacatttaaatagagtctctctgggaaggagtgaacggctgaatttcagctttttcctggtccttttggttaattcagcattcataattatgttagacaaatccttggatgaaaagcatcctatatactacacacagagcaggtgcatctcgaagggtgtagcggggaggaggaaggagtggaatagaagaagaggagatagccttgacatcaggatctggcctgggatccagtgtcccgagggtgcctaggacagtccacaatatggaacaagaatcgtaaaaagcaacttcacccactatgaaagtttgcccaggaccagctgtgaagggaagatgtgtttgtgtcttcattttcccccacctactcgtgttaagcattgaagaactgcagagcagcaccaaaatcttctctcttaattttatattttgtgctacaaataccttctattttatttactaacagtatgttttagtgacttcaacccacaaaattgctttgcatattcacttaacctgacaaatactttttacaggcttgttaagagattcatgtccttgagatgtttgggaagggattgtaatgcccatctttcttgggctcttactagatacgtaacttataatgaaaaaaagaaaagaaaagaaaaaaaggcatagagctctacctaagctgctaagaatatgccatgagcctgatctctcaaaatgttctcctttttctctctcccagggacgtaggacagtttcttgtggatacttaacaaacagcttttgttaaatatctcttatttttatagattcttgtaattttcagagcacgtccatgaatgttatactatctgctgtgcctgacaattctgaggaggaagatgggtgggagcagttacccttagtttcattttgtcagggtgaggaaacggaagctccttaggggtcagatgaatgtgagggcacgaggtgggattagaatccacatcctgtaatttctggtgttcaggtcctcatgctgccagtacatttccaggatccttcatcagtttgccagataacaactccatgctctgaacatgataacacatctacgctgactaactctcagggctgctgtgggtatcaaagagatgaattataaaaacatacttttaaaatgatgaagctatataaatgtagttactatgaaagcattttttatgtgtgtgtgttaaatgcaaggggtctatcttcctgaaaccatcattaaccactgggatcttactgtgatcatttgttggatattccaaagtcctaactaatccagaatatttagaatggagggtctgtgggagaagaatccagggcagtgggataccatctgctgagaacagaggtggtaggggagctcatatgagagtatcaagtgctggagtgagaaggaaaaataattcaaagccattatttgaagtggaaagaaaataacttttcagtttctgggactagacctgcctgagtaaatctaggggtggggtgggggaggacacagattagaggtttgaagtgtgatttgttagagattagtagtgtacaaagtcaaagtttcctattaaaataccccctcccccacataaacactctccattctatggctccatgatctcgtttaattttcttctcagcagtgttcatcctctgtgctacctgaaagtttatcatctgtttataagtaccagtcttactccacgggagtagacatatcatctgtcttgtttatcccccacctccgccatgcccaacactggccagtacatagtgggggctccttaagtatctgagaatgaacgaaaagaaatgcagaatggcttgaaagcctatgctttgccactgggtcatattgcttcctttgttttaattttttaaatggtatttatctcttttttaatgactttatgaatggtgtggaggaaaaaccacttgaaaatttgaggatcaagaatgccacattgcttcagagactcagtttgggcttcctagttagctattggcattgtcaaaatacagtgtttcattgtgaatatttcttgtcattagtattccactgtagactcagttcagttatagaagctatagatgagagagcttaatctttactctcaggataagaatacttgacatagcagaaagttattgtcaggttcttctatgtggtttaccccatttctccccaaagcacagactaaacggcaggaagcacgtccaaccacttccagcgcagcctcaaaccaagtgctggttccccttgagcaaccagaactgcagtcttctaatgtgataactgggttagttttggggttctgatttgccatatttcacccatctgaaggctcatcatacacagaatccttcacagaaggacattttcatgatcacttggcatagttgtggttacctgcttttttgcgactataactcaggaatcacaggctatgattaatcctctggtgggcctatctgtggaccccagtgggggtcattttagtctggagctacagcaagcctttcttgttatcttgacccaggattttttacaatgatgacctaataatagcttataatttatggaggactatgccaaaaagtcccctgggctccagagaggcaggatggggtggggagcaatcgagggagagaaaacaaatacaacacataatttcttgaatgtaactaatacaaccaaaataagctgttttctccttgagtacaaaatacaggatttatagatgctgagctgaacaaaggttataaaatacgggcactaacggagttagtgtttttagatcatgtgctagaaaagatgggtgaacaatgcaaagcatctgatggattgaaatccttttctggaatgaatcagagtataaacaagtaatacacagcttatgtttcattcctgagaaaaggcaggatgtgaggtctgtgtgccgaggagcagtgatgggattccagctggcgctgtgcataaatgccaagcaccatgatttcatatctataatatgcactaccccaaacagatattaaaattttttatggccacatgtaagctttgccttttaaattgagttagcattttatttgttctcttttctaaaaataccagtgggcttaaattcatttgtttctcatgcagggaccagacatggcaatgaagttttgctttcttatagcccctattttcttctcttgcatttagcaacaatgtgtcattctttgtgcagggagatcatgcacagagcctcttaccaataggccttggtctctgtactctcttcctaatggttgtaatggatttgaattgatttaggagccagcagtcagcacctacagtatgacgtgctggggccatgaatgagagtaagaagctccatttgtgagagttgcctccttagcactgtgttgtgatcaactgactgaactggtcaccgacatttggcatttgtctatcattaaacatcaggtactgccctaagagtcacagtgctaattctaagcgccattgtgtgatccccacccccagcaatttgcagtgtatgaaccaagattactgttgggggcagggtagtggaattgttttaaaaaggtggacaaatccatatatacacaaaacaatgaagaacaaaaaatatctcatgtaatttacaaatatatagagagagattctgtgatgaataaaacaaaataatttcaaaatcttacagaatccatggtaaattctgacactatcatgtagagaatccatgacatttttatattagaattagtccttgtgaaaaatagagaaaagtcaaacctattgagtcagaaagtacatcagtggttgcctggggcagagggtggagatgaggattatctgtaaatggccgtgaggcatcttactggggtgatgaaatgttctaaaactggattagggtaatggtagcaagactcagtgaatttactaaaaatcatgaaattgtatgtactacaaatggatgcattttatggtatgtaagtgataccaccataaagctgttaaaagatgcagactgagacagcattaaaataaaaacaacccaccagaaaacagtggtccttgagatgtttcatttttttttttttttgagacagtgtcacactctgtcactgaggctgagtgtgatggcatgatcatggctcactgcagccttggcctcctgggctcaagtgatcctcccatctcagcctcctgagtagctgggacaacaggtgcataccaccatgcccagctaatttaaaactttttttttttgtagacacagggtctctctatgttgcccaggctcatctcgaactcctggactaaagcgatcctcctgccttggcctcccaaagtgtggggattacagacgtgagccagcacacctggccaccttcatttcaaatgtgaaaagggagaaataaaagtcatcaactcaacattatttacaaatcattccttagagactgacactcttgtgaatgcttctgctacactcgatgctcattccctttgcaatacaccctgagcctcaaaagaaagggaaatttacactcattcacataacacatgcataacaccaaccctccaaacacaaaacacatgaacgcacacctgtacagcatgatgtttctaccaagtgcccttgctctggccaacctagagtatgtaagaaggcctagatagaatagaataaaatatttttagctctcttctcttacactgtgacttttatgggactgagtaaagttggctggtatggggttggggcactaatccaaaggctctgcaggacttcagattgggcaggacacatgctgagcatccctgctccctggaccacctcctggtaaatgacatcattgttatcatcctgattcccctccagctttgtactcaatgccaggtgcccatgcagtactgccctttgagagaaataaggagtatgactaccaacaaaaaacccttaaaagtatttaataaaaaaactcttcctttgaggagaaagaataaaagatgcaaagagctttgaaatggatctttcccaggtttttacagaatctttgggtcggctgcatgcggcctattccccactgtttcttagtatacgataacaggcagttatggtgccatttatagagaaaatcttgtaaattctggttgctagccttcttttgtttcattctctcctcaaaaatgtttgcctttgcaggcttcctttaactctaatgacatcatctattcatgggaaagtgtgctggaaagtacaaagcatttaaactccagactgctgcttgctaaagtgaggttaagataaggtcctgtggaaagccatttgagtgattagggctgtcccgtgctgcccgtctggcagtgtccctggttagctttgcctcttggcctgactgcagatctgagggtccattcagcagtactgaacttttttggtagtaaagaaacgtgttgcttattagagtatgtgaaaacaaaatatacttgccctttagtagcctcttggggaaactgacaccatagccactgggaaatactggcttagggtaaagtcactctgttttcttttccatttaagctgatgtgaaatgtagccatccaattaaatatgtatgcacactgtcacaatggcacctcttgacactggctatctgacttgaaatgtcaatgttgagaggagaaagctcatggtcagtgaaactgcaggaaacagaagcacatttggatatgtccacctcactagaattcctaccatagggaaaaatgaagataggctgaaaatttacttagtttttcagttttcaattgctgcaatgtagctaaggtaaataacccaggaggcctaacttgtttatcagtgcattgaaatagaaagtaagggagatccaacatttttaagggtctactatatgcgaggctctgtgttgggtactttataaattctctctcatgtaatcctcactacaactctgtgagatggattttcatgttcctattattctggcttagaggagttaagcaatttgcctctggggatgtcatacatctagtaagtagcggagggagggttgggtttgaacacaggtctacctgcctctctaaagctcatgttcttttataacccctcagcacgtagtcattgtgctaagactttgcataacttctctgagacagaggctgttaactgtcaatctatctgtgagctttgcactgagaacaacacatctatttgaagtaggatgggatgagaagaaatgatggaattaatctgattccctgctgtccttcaagggagctcagaattcagaatgactgggtacagtttcccaaggggaacatgtttgtgatgagtgggcatttttgtgttcgctcctgaccacctctctgctgttaagagtagactgagtgtgtttactggttggtgagaccttggaatattaacctctatggttcccactcctacttctgctcagagatctagaacactggaatgtaatttccaaagctgccagtaagcctgggcagaacatgactgctaggagggtgtcctcaacatgcccttcctgggccccactgaccggcacctgggtagctgtgtatcacagctgtgtttggtctagctcgggaagaccaaatctctctttgtgttcagattcattagtggcacatggctgtgctgatgaggattatcttggtattctattttttttttttttttttttttttttgccagctgggtcagaactgaacatctttcagttgtcttagtgattaaatttttacatacaggaaatgctaatagtttacaggtatagaactggatcttgattcatttctgaatttttttgaaagcatggactccattaggtgtttttcatgccaaacagaataatagttcctgaccttgaagagtttaaatgtaatcttactgttgcatgccttaaaagtaaaaaataataaaattgaggtaaagagagaaatttaaaaatttcttaaaacgtttgtgaggcatatggaaaagagcatatgcaatactttaaaaataagtccaagatggcacgatagagtagctaagtaccagattataaaaacgagagataacatggattccacagtttaccatccctacaaactttggctaaatatggacaagtcatttattctctatgagttttagtttcttcatgtaacatgaggatacttgtattcactctcctataagctattaagtgattttagacagggccactggagttacatccaggcatattgtaccctatacagctccaggagggtcactcagattatggggcctcttggagtatgtagcatacaacctgcacaaccatacaagttacttgatggtccaccgagaagtaaagcgacaggacccagtaaattgtaaagtacttgctgtttaagtattctacagaatatcttagttttgagagttattagaagccagaaaattaaaaactgaaaaacataagctatcaatagctaactgtttttctcagttactaaaaataatataatgttttgtagcacagtgctgaacaaacagaaaaaaatatcattttcaggggaaggatctaagcgtcaaaaaaaataaaggttgaaaggaggcaaaatcagttcacatcacttaatgacataacctaagtaagataatagataaagtatatacagtgcttatgcctagatatagtggagctttgtggtaaattttaaaaatgttccttctctgctcaaaacttttcccatttattctcattttctggtgttttctattccttttgacatttttttagagttgatctcagtgtaaataatgataatagtttcctgtattttataccaattttcagttgatacattctctgagatccatgctgttacttaatcttcttgaaaagtttgtttgaattgccatgtatcattaggctgattttacaggcccagagagtcaagaaattggttaaagccatgcagtaagtaagggttagaagtccaggttcctgaattcagctctaaagctcttgtccctctaccctcttggtgcacagtcgttaacaccacgctaagagaacatggtgaacaaccagggtaaccagttttatatatcaagttctttctatggaattcagaagtcgaaaagtgttgcaatttaaaaatgacataaattttccccaacataaggttttattttattaaaaaggttctatatacaaaattggggggggggggggtggaaaccaaaaccatctatttccttctccttcagccttaaaatccttagagggaaataattcatgtttgacagaatccaagggataaaagaatattcgaaacataggaaggacacagaaaatcatacaatgccagaaactaaaggacagcctatcatacccaatttttaagcttttctggcccagtagcaaccagctggtagcaggaactagtgggagaagtcagcaagcatcaggcacaacccccaccaagacgcgcagagaaagatgaaggcaagacttaatggggcaaaaatcccccccccccaccgactcatcagtatctcagagttctccctgcagttaaaggaggatgcttacttctatttatttgaatccaataggaacaagacatgaaaggaaagtccatattttgaatctgggatataagctggaatgtcctggcccaatatacccaaggcttatccaagtaaataactgtaagctaaaagaatgtccaatgactaggtggcccttagtccaaaaaaaggctgggctccaaatgctccttcttaattttttccctttattttgaacctgtttttccatagaaataatgtgatacataacatagtgatacacttgtgttaggctactgcaaaattcagcactccagagtatacctaaagtttttgtttgtttgtttgtttgtgttttttttttttgagatggaatcttgctctgttgcccaggctggagtgcagtggtgcaatctcggctcactgcaacctccgcctcccgggttcaagccattctcctgtctcagcctcccgaacagctgggattacaggtgcccaccaccacgcccagctaatttttgtatttttagtagagacagggtttcagcatgttggccaggttggtcttgaactcctgacctcaagtgatctgcctgcctcagcctcccaaagtgctgggattacaggtgtgagctaccgcacctggtctacctaaagttttaaaagtactggcctgaggtctgggtcttgcgagaagggatcatagaagagaaaagaatgaagaaaataccaaaaaaataccttgctcctcatcacagttcccaccatagccaaaattatgaaagaggaaaaatgtttgttctgaggtcctcagtgcttttaacttttgtcccttcttactacaataaccgtctcagatatgtcctattcaagaataagcaacactaaaaatcatctacttacctccctcaataatttcaattcttaactgtcgctagaagttattaggaagaaagcaatctgattgaaccaacttgtactaatgtgtaaatgactgatttgtacatgtatttacatatacaacccaaagacaaacacacagatacacaattgcattacttctgtgttagctaggcaccattctaggcactagattagtggacagagttagaaaataataacattcaaaaataagtaaactaaaaaaatccagaatgtaataaatatagaaaatagagtgaaataatacataagaactggttgactacttcacagttggtgattatgaaaggactctttaaagatatcatttaagatgagatgtaattgaagacaaacagccagtcttgtgtaaatgaaggggatatgagacagctagtgcaatccaaagaaaggaatgagcttggtgtgtggatagaaaaaaaggcccatgggcccaaagaacagcaggcaaggaagagaacagactggaaagataggcaggggccaaatcacattggtcttggtaagacagagtgatgcttttcagagtttatcctaagttaaataagaagttactggaagactataagctgtagtctggcctgatttaccgcttaagatgatctctagcagaagcagggagacagataggaggctactgcagagatatgggtgagagaggacagctgtgtagactaggatggtggtggtggagagatagctagatgggctcaaacaagacacactttataggaaaggtcagccaggtgcagtggctcactcctataattccagcactttgggggcggcaggggaggggtggcagggggatcacctaaggtcaagagcttgagaccagcctgaccaatacggtgaaatcctctctctactaaaaatacaaaaattagctaggcatggtggtatgtgcctgtagtcccagctactcgggaggctgaggcaggagacttgcttgaacccgagaggcggaggttgcagtgagccaagatcgtgccactgcactccagcctgggcgacagagcgagtctccatcttaaaaaaacataaatacaattaaaaaataaagatctgtaggacctttgaccatggggaggagaaaaaggaatcaaggatacctggacggaatatgacttgttctcctgagaaaggcaagatgtggaaagagtaggtttggttaaaggataaggccattgggcagtagaaatcaacagttctgttttagatacagtaattctgagctgcaaattacatgtctggcatcaatatagggaagacagctagtacataaatctttcacttagaggaaaattgaggctggggatatacatttagcagtcattggcatatagatgtcatttacaccatggagactgatgtccaggaagtaagcatggaccaagatgagaagaaggatggagaccagtcttgggcttactccaacatttaaaggtgggaagaggctacttgggaagcctctttctccagagaagtaagtctgaaaaatggtgatttgggaagaggaggccctttctctattcacaggcacgggtcttcaagctcttgccaaaacacctaacattgagggtaagtgaagacctttatgaatccttctctgccagtagagtatgagcatttgctaccagctggtgcaaggaagaagctttgtctcacttgaaaatgtataagcttttccccatacattttgaatagtatggtaaaaacacttttgatgagatatatagatattaattccttccttgaggcaggaggactaacgggaaagttttcaatgtccgtctggcctttagaatctaagaatcccaaagtctaacctagaaagaagcagcagaatatcagacactaggaaagagcccttctgtttcaggaaaagtgccaaaacatgggcctagagaaaacgctgggccccaggactgctgctgactaaatagtaggctataaatgaagggaattatttttctttattcttctgcctgtagcaactgggctttgtcacctagaaacaatagcatcatttttcttaggagtcaggatatataataaaacattgctctgaatcagcagggtcaaaaaataaagtcagaaatgtgatgttcatccaacagcctgttcaattttcagtttttggaaaaaatgtctttatatagatatgattgtctgagattacctctgaatatattgtttggggagcttgctgcacagttaatattgcagcaaattatggaattctctcaataacagcacaaagaaatctgcgtcccgatggaaagcatttatggcagtgtagggaaactgtttcaacaacaaatgattctgttgtattttccccaaacagattttcttacctcttgatgtctccacctggcttctgagttagttttaagtggcagaacaagtgactcctctaaacatgaaggtttgctgtaatccataattcatattatagggaaaaattttaattataaggctgccacaattttcaagagtttcttaaaacaagagacacacagaggccttttggaagactgacatttagaaaaagccagcttgagggtatattggataagaggtattggggagtaaaaacactttcaggaacaaggatttcagataggaaaagcattttttaaatccttttgaaaacaagagatgtatttggttggataaactgctgattttggacaattgttataagagacctaatttttgcctttatgatcattatttgcacatattctcctcagagactaaacccatgaccaacagcgtgtgctaacttggacacaatgtgattcagtgacttaaaccataggaaaagtggactccaacatattttcctataattacctcagatagaagcaacggacaaccacaatgttgattcctttggttttatatatagtctctaatcaaaacaccttaagaatattttaagtttttccttctgcttggtaaatttctggtaactctggaaaaagatgcaaagaaaaggaccaatatggaactgctggaacgtagttgggattgagagggagtctgctcttctgtaaggatcgatggtcaactgaacgacttcaaacagccctgcttgctaaggtgaaagtaagagaaccctctaggtctcctagctcctccattcccttaattggttaccagaagcatgtggagtctttaatcagaacccccaggcaggcagtcagttgcataacaccatgccttatggctgaccagtataaatctggatacttcatccatggttaatgaatgaagtgtccagatttatactgttcagatcatcctaacttattcaatataaaaatcaccagaaatacaattttattaaattttttctatgtcccaggtgctttactagatgcataatttgcaggtatttttttccaatcttgaccataattctgcatgttaagtatgattatccctattttttaaatgaagaaactgaggctcagagaggtgaagtaacttggccacagtcactggacgataaatagcttcctgaagaagaataactggtgaatttgagtagaaagaaatacatgatttaaactgtagttgttttcagactcaaaccaaaagtcaggcttgacaactatggcaaactttagtagaaaacaaagtgactatctcaggactgtgggaaatatggaaagtggacagtgaatagcaccattagcacagctgtatttgcttctagtcctgccttttcccaagtctactgtaatgcttgtccttggcttggtatttggttaagaacgtgggtattgttgctcaaagtaaaggctatatatctgtcaagatgctaattagtgctggagactagatccagagtttcagttacaataagctctggtgtgtaccagagtcacttgtgagctttacaacccacattcctgggccctgtcactcctagatcttccagaggttgttgatggttcttagggatttgtatttcttaacaagctctcaggtaattctgatccccaccaaagtttgaaaattattgctatcaatgttgtttgggaagatgatgtcttactcagaaatatgagtaaacataataaagtatagttgcaggtcagacaaaaaattcagcttgtaaggaatgcatgaagggatgttcatgaaatatacatttggcctgtccacttttgtcaggattacttttttcctgtcttgatcaatgcctactttctcttttgtctcattaatatttgggtcaagagaatattttatcaggtctccagtaagtacgttttcctagttacctaaatgaatacagtttcatagagatcattaaaatgtaccaagtatataaaagacagaaatttggttcttaaagctgactctatatttttgttttgtcttttcaaaagtgctcattgcaatgggaagctgatctgaaaatctatccatcaaaccaatctggtctcttacaggccgtggagaccctctggggatctgggatgctttcctgtcattgcaatgacactgaccggcttttgaaccttgagaagggccatgacaatgttccggcagtaacatttatttatacctcagggctctcgtctttcataggtcttggtttgttatcacagcccttgaaattgtaggaaagaaagtgtcaagaaggcaaatgaacttctgctactgggggaattatacatgaatgtaatttgtacctggcactgatgttccaagtgcgacgaacacgactgcagtcacagaatctttcaggccaatggtgcagccaaagtgggaagccaggtctccaatgaaagctgtcagtaggccaatcatgaggatggagacaatgaaacacgcccagccattccagtattcagtaggggggacgaaggcaaacaggaccttccagaacacagtcagaaagtgcatcacgtaatcgaaacaggagggcagcttctcttccccacattcatcgtcgtcatcatcttcccctagagagaatggaaggaagcacatttcatcacaacctgtgttgccgggtcttcctctctctcaatctctcctatctaggtcggtcatccctccactctgtgacaggaggccatgagaggtgggtgaagtttagggttttccaagagttaatcataactaatgaattagttatcaagacactgaaatgcctcttacctgtggctcattggtcaatggcaaaaacttaacccctacccagttctgcatccatgcaatcaacacaccctttctactttcacatctggtaagacttgtcacttcagagaaatgaaaatgatttattccaaaaggctggcaagccctgtgtcagcctgagaaataaccctcttttgaagaaagaaaactatagatggagttctactagggttcttttcttgcaacttgaagtccaactctgggttatataatcacctacaggataatgttcacacagggccgttaatcatggctctgagccttgcatatttctccagcgtcatctcctgcaactatttcaaactcaagccttggaattacttgccaaataattatatgccaaaaaatgaaatttatttgcatttttccaaaccagatacactttctcctacttttgttctttagaactaaatgtgcttggcatatcctaatcgctccacccttatccttcctcacccatcctttaagactcgcttcctctgtgatgcactctctgacctccccccaaacccatgctgggaactccttctcagaggagcttcccaacacttgtaactctggatcagtggttctcacaatgtgcttcctgagcaggtggcacagagaacttattagaaattcaaatgatcagtcccactgaatcagaaattggggagggggtggacagcaagctgggcttgaacaagccctccatgtaatactgatgcatggtcaagtttgagaaccgcttttctaaattgtacatgttcatgttctcttctccagttgactgagaacccttccagggcaggaattcatgcatctttgtgtccctgctgtttgataccatctccagcatgtgaacaaaggtggttaagtatgtattaaatgaaggagtgcatgcagaaatttctattgactttatataactatgcaattacctgatatatatatatcacaattttgccaattaagtcatattatcagtgtacaaagaaatgcacaaagcatgctatttaaaggaaccaggaaatcaataatagtaatctaaaatggagatttcacttatgtgaaaataatgcccattgacatgttttaaaatgaggatattgaatgtcaacttttcttgaagtggtggcaaatacatgtgttatgtggccattttggaaagaagaacatctccttgaagtctttgttgacccattccaaccttgtcatcagggtgctactttacttggtcccactagtgcagccggcagtaggtggggctgcaattttccacctgaaccacgtgacctgagatggccagcatggagcacacatgtatggtcttcgtgagacactctgtggtaggcaagccattgggtgcagatgatgattgagaagaccctctgaaagcacaagagatttgagggaaaaacccctctcagaaaacatctaaagaggaatgtctggatttgtcctctgtcattttacaggaaaagagaagaggcaatggcctgctctttcatgagcacatggttggaattatatgaatacactttgggcgtctgtgaagaaagcagcctcatctttgaggctttggataaactgctgggagaagccattgcagatgagtggaatagcctttggagaactccccagtgaggagcttgagtcaggtcagctcatcagaatgtttgtgagtgaaaaagcattgctgaccgtttgctctgctgttcatgcagtatttattatatcaactttacctggaagcagaagatactttttaataaaaacacctggtatgggctgcactgtgtctccccaaaattcatatgataaagctctgtcatcacctcagagtgtgaccttatttggaaatagggcctttaaaaatgtaattaagtgaaaacagagccattagggtgagttctaacccaatatgactggtgtccttataataggaaattgggatgcacagggagataccagggatgtgcgtgcacagaggaaagaccatgtgagtgtccagtgagaagacagacatttacaagccaaggagattggcctcaggagaaatcgaacctgccaacaccttgatctcagattttcagttcccagaactgccagaaaagaaatttctgttattcaaaccacccagtctgtggtatttattacagcagccctagcaaactacagcagcccttcagaagcctctctatatcatgacgtggaaatgtaggaacaattactcagtgtttctattacctactcttttttgtttgtttccttatacatttcttcttttttctttcttttactttccttaccacttctcttttaccctacactttagctccaggtagaactccatgttagagatgcaattctcagggtttatttgaaggaggaaggaagaagaaagtcacattaatacattcccattcccaggctctcctcttacccactccccattccagccggggctgagaagggtgcatatactcagaaaagttgagaaaaagcactaggttttctagttatatttattttggatcctatcctttttaatttctatatttgtgaacattttataatttcacagggcatatgaataaaatgctttggaaagcattttaatcaatcattcacagaaacatgaactatgctgccttttctctacaaaattacttaatttggggcatctaaatctcttattttgaagacgaacaagagaacaaataatgaagcttctcagaagaaatgccatttataaattgagagtagacattatatttgtcttcaagatggaaataacacctttcccgtgagagatgtacacaggaataattagatcatgtttgtaaagtgtctgagaatatttcaaggtaatgattatcatggtagttatcattatttccctccatttaagattgttactgtgtttctccatcattatttgtttagtcaacatgctaggtcctaaggttacattataggtttttaaaaacaaaaattaattttgccctctgaaattaccttcatgatcaattaatgcaaaatgtgtgtgtgagtgtgtgtgtgtgtgtgtgtgagagcgagagagagagagagaacgtgtgttctttctgtaggcttccaatatcacaaagaatcttaaatgttttaatgcataagtctggaatgggaggcccatctgcttttataacatttgaaaggaaagtggcctcccatccttttctctgggatctcactgctctttataaattttaatctccaactcagacatcacttaaatattaaaaatgaccacggactgccatgcatgatgcacaattaccctgtcttgggaaaggacaaagaaatatcatgttcatccatcaccatctggactacacttaaaagtctgttctttctttgtgaagagtagtgaaacattaaaaaatcctaggagcatcttttatgtgacagcaaaaatgatggtaggatgcctgttctgtggttctgtatgttcaccagcctagggttcctggaggctacataattctttcaagtcccttctctgtgttagaaaagaaagacaggttggtgggtttgcttttatagaatcccaagtaaattcctcttatctcagaatcattcttttcagctaatggaaaataacctgtatttgattaacccttcctattgccttttaaatggcttccctgatacacactggacttcttaaatataactacaaaagtaaccaaatcattaaaaatgcagatagtgcacagggtgtcagttcagctattgatgtaacagtacttggaccgttcctgctcggaaacatgagagcaagagcatcatcagcatgactgacggtgaaagacaaccccctgggctttgcatatatctttcttttaaagtaaacaggtgtttctttacgtgtctctctacctgctcagggcttgaattcagggagagctctgataaccagaaaaagagactgctggaaggtaatggacacgtgggtcagaagacttaagccactttatagttctgacagcttgttttggggcaagacacttaaatttcccaagcctcagttgctcacctgtcaaatgagtttcctaactcccatctctcagagctgttgtggggattggaagaagaaatgctcaagtcctttataaaactatatgcatctttatagacaaatgtgccatattccattattgttacttgtctgaaggaaggcagtatatcaatacaatgtgagtatcctgatttcactgagtatatattctgtttgaatgagccattatcattcatttccccaagctgcttgcttttaagaaaagaaagaaacaggaagggaacctggtggggtgtctcttaaatgacaggcactaagctaaattctttcacatacctgatcttatttcatccttaaaataacactgcaaagtgggcattattaatcccattatacatatgaagatcctgaagttcagagaatttaagtgacttgctaaaataatctcacacagaatttaagtgactgagttgggatttgatctaacagtccagggaacattttactatagaaaatgccttatggaagaaagtagaggagttcagtatcacatattgattcgaagtttgagtcggaatttttttaatgcctagtgttatatagatacagtggtacctttttttttttaggaatgtgaaaatattgaggtgccataattaatatttgtattctaatactttctagatacgatttttgggttgtttatttctttggcagagccagccataagctctttctcagacccgtggggaccaagaaaacatgggaaataaaacaatcaggtaaaagcaggggatcatggtgtgactgttttggaacctctatttttttctatttaaacatttgtttaaaattttatcatatgcatttgagattagcaatgtcatgttataagatatatttagatagtaaaattattatagggaggcaaattaacatctatcatctcatctagttactttttcctgtgacaagagcagttgaagtctacttatttaacaaacatttctaatacaatttcattagctttagtccccatgtggcccattcgatctctaaacatgtgcatccttcctatctgctattttgtatcctttgacctatgtctctcattgcctgccccaacccctgcccatagtaagatggtaaccactgcttcattcctatcttggtgtatttgagctcttttcaaacatatatattttccacatataagtgagaccatgcaatatttttctttctctgtctggcttctttcacttagcataatgtcttccaggcccatccatgttgtggcaagtggcagaatctcctttcttaaggttgaatcataaggaatctctcctttagagtgtgacaagttcttatttccatttctggttgccaaaggtcaaccatccagttctgaatcaaacatcttggtttgcctctagctcatcacccttgaatttgggaaagtggcctgaatcatcacaagtctgtatgtaaagcggtctggaaaatgtatgctgctgttcatctgcggatgtgtctgactttcgattctttccaggcactcagtaggctttctcctccagaattatgacttttttgcaacctgacatacagtaattacaaatcaaattctactctcctgttacatatttctgtttctcttttctttaaaggttctgagagaatcgtaaagaataaaagatgaaagaccttagcgatcagctaagaaaaataaaacagaatggtgattcaattgatacatttttgttccctagtttgcatctgtatatatctgtttgtgtatgtgtgagaaagtgtgtatgcatgtgtatgtgacgccataagggccagcagtttttactgtcttgctcataaaatgatctgaaacttcttttctttcttttcccttttacatgcttttaccttatgtctagtgacaccttatctcttcccactcttaatggcctctgccactaaattcagtaacccaaagatttattcccaaacaagagttgatctctcttttttttgtattttggagatgtgcaataaacatttctctataccttaattggtgggaagtacttaacatattctctgatgcaaagtagatgatgtcaacaacttttcttctaagtatattggaagacacttcctatcaacgatagctcagaaaacaataggttcgaattcctagatctatgagttgccagtgcacagaagaaaatgtaggcattttcttctaccaactgaaacgtgggtcttagaaaatacctgagcttaaagctttaggagggttttgcagtgtgccaagttcaaccccggcttaatgtgaatttctttaaaatttctctgccgaatggttacttgtgccacttctgagagtttcagctattggggaactcataatctcacaatccaggtttagagtctctggcagtcagctcaggctgttaggttctactcatttgtccaggccccatcccctaggccagtggtctccaaactttttggcaccagtgactggttttctggaagacaattttgatggttttgggatgattcaagcacattacatgtattttgcactttatttctattattgttatgtactcaccataatgtggaatcagtgggaaccctgagcttattttcttgcaactagatggtcccatctttgggggatgggaggcagtgaaagatcgtcaggcattagagtctcataaggaatgcacaacctagatccatcacattggatattaatactattgtacataaaatttgagttcaagtttgctatatatttgtaacttggactactggactgttcttggatggagaagacactatacaggccccattagccatccctacccgcttcttccaagccacagctaatctgtgggccatactgtcccacgggactagtgctacttcttaaggggtttgggccaggtgatgtgtgacagtattgtaaagggcgtcaagaaggcaactcactctctgttaataactttcaaacctggctgaaatgaatgaacatctagatgaaatcatccacaaaaaacagaatgcttacaagcttaagccattatggtctttgttggggtggttaacatagcacaagaaatatttaacgtgacagaaatatttctcagcaaatgtagccactgtccaaatgaaaaacggattcactaaggagttctagctccatgcaagttcgattattaccaaaacaaatctgtttaaagctgaaaattgatggctttagtgtctcttgttcctaaaaaaaaatccgctatatgaattgggtgttcctaaattacagtttaatgtaattagtcatgtgtgtttttgccccaagcttggttgtttataaaataactccaagttagggtaagaatcttgaaattcagagtgttctcttacccttaactaattgtaggactgacagaattccaagctcccgaaatagggaaacattccctgtagacttgaatacctaagaaataaggctttgtcaagtagaattggtactcagcaagtgtagatacctcctgctagtgtagatggtttagttacagtgggaagtatgtgggcacaccaggttctaagactggcctgaggactctgataacactttgtaaatatcaccagctgtgtctaaattagcctcctgtagtgtgggaagctgagtcgtgaagcaactgtttgggcagtgataaccctataatttttaacagacatatcaatgttatgtcctagagaatgttaacatgtatataaagggtaaatgtatacccaagtctgctccacatgcagaggggcataaatgctgcccagagcctcttaagatgctgctatgattcatctatgaatgcaggttcacttactgagtgttacttttatgcatgtaggtaaaagtgtacatcccacttagtcttcatcctcccaggagcctgctgcagtaggtattattttctctgttttagagatgaagaatctgaggctcacacaatttaaatgacttgcttatgagatctaaaactctgtcacctcgctacaattacatgacccatggtttccatagagaaaaatctctgtggtttgtacagcaaaaattcattctgataaaatgtaagctcacttagcattgttttatgaaaagtgtaatggggaaatgtctctcctccttaaattaactctctggatatgatataatacacaaaatactatattgttctttcagagaatgaatggctggctcaattttattcttcctggaattttatttaaaaaaatgcatctttatgcaaatcctctattcgtgatttatttcagcctcattgggaagtgggattctcctcattttggtggcaaacatctgtctctctgggcagcaaatggaaaggacgctggctctacagcaatgacaataacactctcataactcttttcctgatctcaggatctcctgaatggactctgttctgaacatagggtttgaaagttgacgtttgagcaaagtggtgatgcaaattgagtaacagtctaatgatggcctcggtttgcacaatacaaagtgatggcagttgctcaaggcacccctcatctgcctgttcctctttccttctttctgttgtgattttttaacgagatctcagtaaacacggccctccactgaccgtaaggtcccatgatttacttgctcttggccacctcacagatcctgtgtgcctcagtttctccttctggaaaatgggcatagtcaaaaccaactttctcttttgtgctattggaaaggtataaacaagatttttaagagaagttatatgcttacatatagtaaacttagttttggcttgagggaaattagctgattggtggaattcagatggagcatctccttccctcactgctcctgaacacttctattagagggtaagtaggctaaggtgggtgctgacaatcttgtttgtctgtctgccatggctttcttgtctctcataaatagtaaccatgcatcacgatgttgtgatgtttttcttcaatatcagccatctggaaaatctctctttccctcctattgtcaataagtcagtggcctatcttttttatttggtcaaggcctggtgcatattctattaagtctgtaggtttgaactctaaaatattttgggtcactgttttgcacctcaagcccaggctgaacccctaacctggacctctaggaaatcttcaaagggaatgggatggttggaagactgactttattagtgccactcatttctttagtaagtatttattgtcaacttatgtatcaggcacagttctaggcattgcaaatgcagaaaaataagatccctgatctcatagaatttccattctggcaaggggagatagtaatcaaagtaaacaaataacaaatataatatgtaataatttcagatactgatatgagttatgaatataatgaagtctggtgactgggaggccgagaaacccctctgagcagttgacatgtgagctaagactttagtgaggagaaataatcggatatggagggaaagtattccatgcagagaaaatatctcatgcacaactgtgtagagaacagaaatatgcctgtgtcctactggcattaagctttgggaggcaagtgtgacaagatggaaagaggattgacttgggaatcagaacttgtgggtcagggtgggaatcccaacttcaatttctccatttcttgtaaatgggttcatgagtagctactgcacgaggctgctgtggggcttatgtggatataaaacaactattcaccaattgggagaccatttggtcactcagtgctgctaaggtgttggtcaggaaagcttcaatctttgctttgtctaatcctaaggcatcacatcaccaagaagcccattggtcagtaggtaacatcagagggcagacatggagtatctgatggttaaggcgttggttctacaactccagaagaaaaatgagcaatgctttatggtgcagcaggagccttgggttctaaaacagtctctctgtgatcttggaggagactccctctctctgttctcaggttcttatttgttaaaaaaaaaaaaaaaaaaaaggcaaggggaggttagaatcactgctcctttccagctcggggccaggattctaagatgctctatctaacaggccataagacacaacacccagccagacctgaccaggcaaaggcaaggcaagggagaagcatgcggtgggatgtatgtgccaaggttggttcacgcgagtggcttttcattgcaggagttggaaagacaaggtctttatcaagagagcaggctgtgaacagcaagaagtaatgctgccagtcacttttatgtggctcctctctgcctatggagagtgtttgtgtgtggtggagggtggctatggtttctcttccttccacttctttgggttaggctgcaatgtttcccctactgaaaacagcatacaaaggctcccgactggggatgaaaagtcccctcatgcctcacaccttgatttgcaagcaacaactaaaactgtattcacattgcagcagcccatgccaacaaaagagctcttggacccagtgatggcacattgtttgcagagcagagctgctgccaccccagacaaaactgcgttagagacacgacttcgggcatacaaataagagtgctgaatcattctagagcccttcaatacggtgttttcctcaagattttataatacgcaatttaagagaagaacagaccaatgagccaatattcttttcagaaacatcagctaaagcatatccagaggccagaaaataattgctttttttctcccaccctctcgtacttccacctttgtttctggcctgccttgttctggaagtggaaactgtagctacccgattcaacattttctcctgctactgctgcatttttagatcgacagatatcctaaatttgctttgctcacctactagtatgtccctagaatatctcccataaatagtttatatctggaacttactctgtctttcttcttagtcatgtcctccgcttttcctcttaggatcatcattatcagctacataacagtgaaattttactaagaatacttaagaacactgagagaaaatgtcattttatatttgcatgtccaatttgcaaatacacagataaatatatcttatgtgtacaaatatgtgaaagttcacatctccatgtcaagtgatatgaagtttgacatagagaaaacaaatgtctcaaactccttttgaaacatggcgtgtgtatggtgcgtgtgtgtgtgtgtgtgtatgtatttatatagattgttttctagatcagacacagtatgatgatgtcttttaatccagttatatacggattggaaaactttaattcacaaataaatgtattcattctttataaaacaaagacttagcattgccaagcgctgtcttagtgccaagcactgtcttaggtgttagagaaatagcgatgaacagggcagatttgcggttgttgttgcttttttttatttagattcttcctacttctaagaggacttgagcagatctgttcctattaatagagcataagatattttaagacaaaaataggacaaaaaatgtctgaagcagaaataaaggatgcttttagtcacctgagttgactgaattttgaacacgtagattaaaaaaagactgtgctttccaatggccaaagcaatttagaaaccattgaattatatagttatgatcttccagttgcaaggtgacaaaaattaattttctagggaaaaaagcttctctttaggaatttatcatgttttctttaaagtttagtgagtggcattgtgaggttttataaaagataaagtactagctttcaaatgtcatacattaaagataaaaattaaaattacagataagttaaactccaatgagggcagttttaaaagaggctctgataagaactttaagatttactttgtgatatccaattctcatcaaggatgaatggctattgaattcacttaatgtgaccattaaacagtgtattttaagcaccaaatgtcttaagtgacatattgtgaagtcagtgtaattacacactttaacatgtattctaaggtaggtattgcatcttgattaaagttagagtcctaaatttctttctttttattaataaaaaggaaattctttattgggggcatgacatgcacagaaagtatgtatttcttgaaaggtacttgaatcttttgtatcactctcttacataaattctggtgcagcaaacaaccttccaatatatagttgtttatgtgcaatgaatacaggttagaaaaacctccaacatagtaaaacaacagataaatagagttaatgtgaggcagaagaacaggcgtgagacttgtagtttggatactacctctgcagttttttgttttgagacacagtcttgctccgttgcccaggctggagtgcagtggcatgatttcggctcactgcagcctctgccttccaggttcaagtgattcttgtgcttcagcctccctagcggctgggatttcaggtgtgcaccactacgcctagctaattttttttttttttttgtatttttagtagagacagagtttcgccgtgtagaccaggctggtctcaaactcctggcctcaagtgatccaccagcctcagcctcccaaagtgctgggattacaagtgtgagccactgcacctgacctcctctgcagttttgaataagatgggtctaccaagaaaagcagggtggcagcttgggtgggacactcagcaagacctggatgtgtaataattacacagaagccaggcatggtggtgcctgcctgtagtcccagctactcaggagggtgacactggaggatcacttgagcccaggagttcaagggtacagtgagctatgacatgccactatgatgtgccactgcagtccagcctgggcaatggaggagaccccatcttttttaaaaaaatagaagagagactataactgagatttcaaatttccaaattcaattttgtcagtacatttcaaaccgagaaaatgtcctaaatgtaatgaactagcttacattttaaaaaaatatcacttacaaggatggattggataatttaaagatacctgtgaagtaaaattagtagtaatttgtgtgataatttagaactctaaatttcaaatagcagttacacggaaagcaagttggcattttatttatgagaatgaagggtctttaagagaccctttagtatttccatgtcctaaagacaactcacaaggtcatctcttctaatgctattaactcacaggggaggttagaggtcttgtccagagccccataactaattggtggctgcaccagaattcattgaactcaagtatctagagaagccaaagattccaacaaataaagaatttaaacactttatttgtcatccatgttatatgtactctgtatcacagagaatgggaatcttttaactctacactgaaacaaggaataagagctaagttggatggcagcagtgttgctcatatctcctgttggtttcaaataactactatttgacctttgttcctacctttttcaagcatgccagtgattccaagcctgaaacaacctacctacctagataactaataatatcacagagaaagagcaggagcttggagaaaaggctgggcattgattccattttgtttcataagacctgacacaatttctagctccagatataaatacaattcctacaccacaaaaacattccttatgatgggatttagtctggactttctaggaaatccagtaactgatcctgcctactttctaggactgattctattcttcctggtccttctgcacttctgtcccaggcttgcacactcatttccaaacccttaccttccccatgtgtaactgagattaaaagacttgttaacttcatcccttttgtcctgaattaactcatctgaaatgtgagcacttgaaacctaaactaaagttgtaggaggaacacctaggattgagctgaaagcctactggaattagactcacgatgatggggtttcatattccagctaatcacttgctagttgtgtgaccctacacaagttacgtaaccactctgggcctcaggatccatagttgttaactttgggaaaaatgacatagctcagaatataggtgaagaacagaaataatgcctacaaagtaccagccatgtcatagaagccaaatggtaacattaaacaaaaagtgggccacaatttttaatttatttttatttattcttttttttttttttttttttttgagacggagtcttgctctgtcacccaggctggagtgcagtgttgagatctcggctcactgcaagctctgcctcccgggttcatggcattctcccgcctcagcttcccgagtagctgggattacaggcacctgccaccatgcccggctaattttttttcttttcttttttttttttttttgtatttttagtagagatggggtttcaccgtgttagccaggatggtctcgatcttctgacctcatgatccgcctgcctcagactcccaaagtattgggattacaggtgtgagccactgcgcccagccaaagtgggccacaatttcacactcatatgtctttgacaaagttttcttttttgtttttggagttagggtcttactctgtagcctaggcagtctagtggtgcaatcacagctcactgcagccttgaactcctgggctcaggtgatcctactgcctcagcctcctgagtagctgagactacaggcatgcactatcacacccggctaattttttatttttttgtagagatggggtttcactatgttgcataggctggttttgaactccttggctcaagtgagaaactttcttaggacagttctacctacttttgctcatgagactagcatccttcttcatgaacctcagtcaacatatgattttagacaaaggaaaattatgaatgttgatatcacataagaaaaagggcaaaatgagaaatcccattggtaacaccctcctcctttttttggttgtcttctagacacactgaggctatgtcaaatctgacacagcagaattattattattattattattttttgagatggagtctcgctctgtcacccaggctggagtgcagtggtaagatctctgctcactgcaagctctgcctcccgggttcacgccattctcctgcctcagccttcctagtagctgggactacaggcacccgccaccacgcctggctaattttttgtattttaagtagagaggtggtttcaccgtgttagccaggatggtctccatctcctgacctcgtgatccacctgcctcggcctcccaaagtgctgggattacaggcatgagccaccgtgcctggccctagcagaatttttaactgcttaaattggattttcagatgacctaaggctaccacaaggattaagtaatgacaatttccccatagtaatgatgttcaataacagacgagatgctgaaaagtctcctgcttagaccagatttcacggcaatcccttgaaactcatttgaggtaccatttttattaagacttttagagtagattagccttcaggctgatagtcaagtgaattattgtccaggggaccactgagttgacagtattttatattaaataattgaggatattaatccacaaagcatgcatggatggactgatgacagaagcgtcctttaaactgaactagtatccatattggactggtgggctaaggtgacatgccctctacttatttatttagctggaactgggtcactttaatttgctgtgaaatgtagtgagtgtggacaggtcagcagcatgcaccagctgggcctcatgtagaatgtcttcccttgtactgtagaagattccactggcattcccgagatccaattatgtaacaggaagataggcacttctgaatcatcatctcacttggctttctttgaggctaaacttcaactctcctctaatccccttccttctagaagaacagaagtgaagtgtatgctgctattgtgctgaatatttagtttaggcaagccagaggatgggcaagatatgcttttccattgtcaaaatccaacgggccatgaagcaaaatccccatcagggctactgtaggactataatggccatcgacagagctcccatgtttcagtattggatggtatcttagagctagcctagtccaactctctccttttcctgatgatgaaaccaaaaatcagaagtgttaaattctttgccaagattatacagttggtaagagacagaaccaaaactgctggagtttttttttttttgagtcacttttgagtattctttcgttataaagatgccaatacatactatgtctgatatgcaaatggatatgtcaaaagtaaaacaatttcaggaaactctttaatgctggatatttaacattaggtaaaagaaagagggaggagtgtgttgacttcaaagaatgtcacaaattactaggcaggataagcctatgggtgcacctaggaaaacaaattcttccctttgttcttcagggaattgactggcatcctccccaaggaacttgtgcactggactataaggagacctaacaaatattaaggaaaaaaaaaaaacatttctatttcaagctgcggctccaatatccaaacaaatatctactatataatgtgcatgtctatgtatgcatgttttgtgtatctttgtctttgtatgtgtgtatgcctctgtgtacgtgcatacctgatttgtatgtgtgtgtctgtgttcgcacaatgcatgcatgtctctgcgtacctgtgtatacgtgtgttctacatgtgtgttcactcaggcctcatgcacagcaagcaagtgcacccttcatgctggagagactgttgggctgatttgttgcctggtactgccccttaacagttttgcttcttgagcaagtagttacattgtttttccaaacctcagtgttcttatttataaaatggtatgcatgataccatgaaagaaagaagttaaccagtgtgtttttagtcccatagctattttattaattaaattgaattaactgcatttgcacaaaatttgatcatattttattataggttctataatagaattgcctcccaaacaaccaactttggcgtttccatgtacagatggcctttgtgaaaatgcatacggtttaaattaattcttatggcagctctatgaataaagcagttatctctactttacatatgagcaaactgagattctgaggtgtgagcgaactgagatcttgaggtgtagtaatcttcctggagtcatccagggaggttttggaaggcagggacacaaacccacacctgtctccaaagccagccttgcaatcattctctcctttgcctcacctctgcccaaagctgttgtgaagaacaatatggtggttgtggaactggcactggcatcctggttccctttatccagctaatgtttgccctcttctctgacacacttgtttcccttgatacctcagctggcacacgattttttagagtcgactcaccattctgccctggtagaaggagagagatttgggaaaaactcaaactggacagggaatgctggcttcatggagaagggcatatgctggcacactttaacagcacctcgtggtcctggacttgccttgcaagttttgacagccattgaactgcagaacccactgttcctagtgttcaacccaggaagaaacagaaggagaactgccaggatgtaactgcttaatcgcttcctaatctctggattctcataaatcctttaactcttcaaatatggaattaaaagaactgggttggcagaatcattatggtcacaggaggcccaagtactgagctatgaaattcagaaaaagcagagggacaagaagattgccacagggttgactttgaaaccagtttgaatacagttactgagaaagaaaagcaaatccctatttacaaaattattatttttgtttagcgagatatattgagttaattttgcacagaaaattgcatagcaaagaaacctctcagtagagccctttaaaagcaatttaatatttgtaataaggcaaattgtactgactctcaactatttagccatgaaattttaaaatccaatgaaagtctgacttcaataaatgctgctttacaaattttattgcctgtgtaacagcctaagaatactgacattctttagacagttaaatttaatcataaagacaaatactcaacttttgaaactgcccttcatgtaattgcgtataatttggtgcttttaaaacatgggtttgactttctgatatgttgtttctcaaaattgtaaataaggtcaatttacccagcagcctgcgaatttctaagcaattgtgccttatttccaagcggtcatttagaaacataaagcacaatatattgtatgacaagaagacttgagaggtttcatatctcagttattaacaattcttcaaaagctctaggcaggagttagttccatcatgaaatgatgacaccatggccgcaggtaatgtgacgcggccagtctctctgtgagagtagggagcaattttcctcattttgaaatttccttcttctaaagggcagtagatagcacactggaccagtcttcattagatataggatctaaggtctgttctaaagacatgttgcctctctcagactcagattcttccttaattatcgtaagataacgataattataatattaaacacaacatatgaaagtgtttgcaagtcaaaatccacctcttttaagtaaggcagtattaacatctttatagttgtttctctgtatacctattctcaccagaatcaaacacatgacactggccttgttggcagcataatcccattcactgtttaaagctgcccttttctattgctatagactggtcatagaatgtttccttgttcttgagagtcataaaactatgtgaatgaaccaacgtaaaccactcctctgctagaaaagcaaatttggccttaataggtctattgatggggtcatctcggccatctctctgaaattgcagactctatacgtatttcctgttcccttccacagctttgctttcctctatgacaaacttatcatcataaatatactttactttaatgtatctgtctgatttactgtatcctccattagactgtaagctccacttgggcaggggtatttgttgcattcgctgtcatgtgccttgcaccaagaacaataattgacatagaaaaacgaaggaatgatggccagcttatggttgttatacaaatgctcatatacctgcagctaagaaaacagaaatgattagaaatggttcagtataaggcttaggatgcttttaatgttttaattctaatatgtcaaggcccataaaagagtttgttcatttttaatattttctactattggcttcgtcagcagtttcttattctagaaatttttgtctgcttagttgtgtctgtgaagagggagtatagctcatgcctcatatattaagcttagatttatagaaaaacataagaaataaaagagagtttacccctccttctattagagcttatatgcaaattccaaatccactctcctgagcagttacccaccatttaatgttcataaattcccactatatattcaattgcaaaaaaccaaagcaagattataaacacactaataataaacaggcataaaatttttactaccctctcttctcacagcacttgggagatgtgtcaaattaccctgtggcagactggaaaaagggatttggggtagaaatcatggcccaactgctagtgacgcagtttccaaattttacagcttgggaatcactacgtatttaggaaactctacctttgttaattcgttgcaactgtagaagatgagcctggagggatctttaaagagagccagtgtagatggagcagaagaacaggaaaaaaaatccaaggacggggttgctttcatgaatctttaagagggactttcctgtatcgttatacaatcacacaaagagtggacagggtttgacaatacaggaagagcacacctctctctctatttaattccctcatgtttctgactccgtgagtttgaaaaacacttcattttgtaggaacttcctaaataaaactctgtactttgcttgtgcaagaagaaacagaatgtaattctatttctatttctagagccagtgcaaacacgtatttgttgcatgttgttgaagagagtgtaaaatgatgcagatggttgtggtcaagtgtcttagtgtcttccctttccacctaggattttgctgctttttttcttgaccttgacttggccacctttgtgctgcttacagggaattttccagacaaagcctagtgattggctattcgtgaattagagacacaaaacgctttaaatttatcttgtctatttccagaaagatgcaatatagatggaggaaaatgtcatgtgtgaagacatttgcttcatctagatagtcaatttagtctttaaaatgtgcatacattaacaaataaacttatttctcccttaattttgccatggaagccctttggtgctttgccatagaccaagtagccacagtaggaaaactcagctcagattgggcaattttaatttataatatgcagagaaaggcactcaccagcactgacagtgatagcttcaatgaactgttctctccagctgttagtcccaaccacaagggccaggtttgtcttcttaatgagtttgtccacagtactctagaaatgttgaaaagaaaaatataaatgctgggttcgctaaggcctcaggaaatccaagaccttgttgattttgaaactccagagttatataaagggtagcagatgttaggctcaaaacaacagtattgacatcaaacactgttatgattatgcaaacaagcatggtccttagttggaaacattctgaaatggaaacttctttgtagcaaatacaagtctccttcactgactaatgaagaatagcctcagtgtttagaatagcagatgctgcaaaagcccatccatccccctgaatgctttgccaacttgcttctctgctggtttcatctgtagtgtttcgtctgcaagtgaattaacatatgccctattcagcactacatatctgcgaatagccggaagtgacagattatggaaccaaaaaatattgctattgtattttgtttatcaatgaaatgtagccagataatggagtctccaggttgcctgctgcatggtcatcaataaatggatttgtctctgggtactattttgtcagcctcttgcctcttagagaatctcatgctcaccctattcctattgcaaacaagaatacacaaaaatacaagaaaagttcagttcttatggtttagggcacgttgcagtttaccttgccctaaatctcccctgctttactggcactgtgctgcataccccttatttttctttggaactttttaagcaccttgttttgtacaatcagtactctctagctttctaaattcagttaatgtaacaacaagagcagccaaacattcacgagaaaactaagtaagcagatggactgaaagcactactgcaagtcatggcaactacagggagaaaagtcatttccaagacactaaggctgctcatcccaagaaactaccacagtgactagtctacgaaacatccacacttactgtcagagcatccttgaatttccactaattgcaaagaggcagaaaacacattatttgtcataggtcgaaatctgtatatgttttatgcaatgtacttgagtggactatggtttaagagagcacatttccaactaactgggagtaagcaaaatgctatctaaagggcttgtattaaaggccaaaaccaaatcataatatcaagcatgtttgctcaagaagagtcattggaacagacttgaaacattgagaagataataagcatgaaagggcccatctccaactggctcactctgtattcatgacattattcttgaaagaattgtatgtccttacggtgatgacctttcagcttccagctttgtgtctagaactgctggtgcccctgataacagctgtaaccatcactgctcttggccaccataacttgaagcacttgaccagcatccatctttcttttctcaactcagccacatctcatcaagtactctgaccatcctcactgctacaaattcaaagtgccttgtagaatgtaataagaaatgacctcgatttttcctaatgtagtggaaacttgggacagttctctccaaagaggcactctgtgctgaatccatgacagagtatcccatcacctgggaaataaacaattgaacagataaacttctctaacattgagcacagactttcctcaagaaatagctgctaaagaacaaatgtttaagataaactaaacttctgtgtgtaaaactcagggtagattttaaactgtagttcatgttaatcctgggggattatagtatagccagggttcttcctaggacttaattttcatatgtatccttccttgacctatgggaaaaatgggagtgaataaagatatagttcagacacctgaacttggacactgttgtctgtatttacctaggaggttcctaaatgcttgtgatcagtttttcactgcactagattttcaaaggcttgtgaaaacctcaccctcagcaatgggtgttagtaaaaccaggtcctcagtcacaccatagtaaataagaactcagtgggtaaagcagagtgggccattgaaaggtaccacccagatttgggtctctggtacagttctgggagctctgagtaagttctttaaaatacctatgttctagtaaaagagatttcttaaataatataaaatctaggctgatacgtaagggcagttctaaaacatgcccctaacgtgccttgtaggtattaatggtaactatactgatgaactttgaagagatgactggaaataatctatggaagctatcctacaaagataagtaccccaaacaactggtttcatgtagagacttggggcactttcaaatggtcagatcattatagtggttaccagaaagggctttggacccaagaaggctttgctgcctggaagactgtgcccggccttgcttaacttaatgcttcttatgggaagttactatgattgctcttcctgtcatgggtgcatggaaggggaaggtctgagatcatcccataagggagagaacacacaattccccaggagaacccaggcaaagggcaggggcaagcttgcttcaggaataccaacccatagactctctgctacagaaaatggcactcagctctctgattccaaatgaaaagagggtgaatgaggaagagggaggttgaacacacatggagaaaagatgagtagatgggtcaccagaaatggacagtctgagattccccgacttctggaattacagggaacttgtgcacattccaggcatggttgtgcaacaagccaagttctgtgtcatacaatgggggtctaatgatcggggtctgcctagaaagcattggttccactgtttacccccggaccccctcctcctatggaaatgtgtgaaagaagagttaacagacagattctcagtggcctaaaggaaaaagattaattgcatttttatcttaaaatattccactttaatttcaaagacattttgttttccacctgtctcctatcaggcacctccatttgtgaagtaaattaaaaaataattaatggatccagctaaaggaaaagaggggactattatgagaagtccagataaaatctgaaacttctaaattggtggtctgattctctcttttgaaaccttcattctggtgtttcaaacaggaacagtgtctgcttttgaaaagtaagcaggtaaaatactgctgtgctctgggtttgtaattctggaaagcaagagaggggatgcacatttcatatcccactgcagaactgaactgtttcttcccctgtggtcttcccagatgctagaaccatgtagggtagaagggatgggaggggacagagggagcagctaaggatcaacaggaaatttcacttcaaagtcttaagctccatccccaggcccacacattcaacttctgcaaaaatgacttttatcatctagagaactgagaatccaattttatcagctcaactgtaaactccggttgcaggcactctgcattcggtatattgactgtactaaaatgtccttggatctgaagaggatgattaaatataaatgagagcttgtcaatgggatgttccatagggagatattactatccccctgcaaaacaaaagcctcctaattttcagcagtgtgaatgccttgctctgacagatttattagcattttcaaatagaacttggtttcttccacacataacaatctcttaggattcacctttgcatgttccttgctgcccctcagattaaaccttccctttggggcacctctgaccttgtgcagtcatagatgtctcctgctgggccctggttcggatgctgtttggtttacaggactccttggttcctgattaactctataattccaatttggccccaaaggctctcaattcacaagccagttcctgaaattacatctactactctttccaggtggatcttaagctttggccaaccctatgaacagtttctgtcccaaggtgagactggctcctggtgggcagtgttggtgagcataccttgaattcataggattcttcaatgatcacttccaacttggtgtgctctcccaggatggggcgccccatttctgcaatgcgcctctcctcttcctctttgctggtcagtggctgcttgtcatcatattcgtctgtgaaacggaagtatcagagagtgagcactgtgttctgtttaatttggaaatccctggatcctgccataagaaagccaaggaggaaggaagccctaatgacctactaaagccccctgggtgagatcacgatgctggagggaagagccagacagacacttggcatgtaaggcagcatatcactgtgagagcaagtgattataacatctcacaatctaagctcatgcaaaagttcagttgaggaaaagtaatgtatggggcatatcactgagaaaagactctgcctgtacattgtctatggtaagggagtcacgcagctattccctgtgacgctggctcagttggctgtttgtacacattctttcagcacgtgaccaaagggaaacacaattgaaagtgctagagtgaccctcagagatggcggagtctggcctcttcctcttcactttctaggggcaacagaaaatgcctgaggcccaaagagatggggaacaggaaattctgactttagcctctctcttgccaagagaccctattgcaagttaaacagcaaaacatccattccatatttctgtgagacgcttgggctccagtgctgcttcagtctggtgcaaagccaaaatttgttaggaaaaccttggccatgttaatcttaaagtaaacagggagggcgagggtgaggcctttcgggagttaaaatactcactcaccatgtgagcacaattatttccagaactaccatgtagcttacagtccaggagaggacggtgggtgctgaggaaatgttaatggatccaagagcccattaatgaggggaagctcacagttggctctctctttgtgaaggtcattaggataaatcccagactgaaaaggccatgcatataagaagggcaaacactggtcctataattacccttatcctttaggcccagaatgctgaaacaagacaagctacttcttctcagatttaagtggaatgaacattgtctccaatgaaacattatctgatatggaaagacctcagccctgatggcctcatttctaggacctctggacaaagtgcctccaacagggggctgttgactaaaaagacatgcaataaaagggatgtttggtcctggcttcctgcctggtgcatttaaatattagcttctgtagaagtccatacctcccattacctccaaagacccatggcctcccccctgctgagggaccacgctatggtggctccattgttgctttggcagctgttgcagggaatgaatggttcctaggctagctgctcgttgtgagggcagggagtgaatgagctagaggcagtgccagcatttaatatttcaagggtcaaaaccaacaaaaggcaaaagcagaatgtagcatattgattaattctttagtatacattttatagtgtcatcctaaaagcccattttaaaatctgctttcctagcctcagagattacagggcaccaaataaattagttgcagactaaaaataaatgattttggactggccagaagctgctgaatgttagcagaggcaaaggagaggggcaaggagattaattttaactataaaagtggcaatattttttatagtaggattgggaagttatgacccaagggaaggcaaagagttctggttctccaagatttgtccttgcaaaattatgtatgtctagtcaagagaggtggctgagatacatgaagtgcaatttatccagcactgaaattaataatgttgattaccactgctttgtgatccttgaacccaggataatgttattagtagttttcatagcagtagtttatgctagcatctttgtttgaaactttggctgaacatggatgagttgaagacttacacagaacaagaatggttttctcagaagaaggaatattacaacttggacatctatttaaactgtgaagctattgggggagaatatttattatggccttctttttgtagtttacttataaatgacaagctgcttttaatgggactcaaggcaatctacctagaaaaaatagagaaattacaaaacaaagctgatgtggtagcattgttaagtgcagcatttcatgaaattaaactggttttgatcatggtattaaataactggacatggaataagcaaatgaagtcaaatcatacaatgagtgaaaaggttctttcttttccaaaaatccttcagtccttctgatcaggaagaaatgcttaattcggtgctgttaggtctgtaactagttcctagtatctcgacttttgtaccttttaagataggtagtcaaaatagttctcaggtgtagagcacttgccatcatctagctagaatttaataacttttttccattgtaaaaattttttaattttactttctatttgtggcaaacgatactagttttcctgtgttagtgacttaaagttttcttttaaaaacaaacttaataaagtataaacatgaggcaattttaaaaattacattaagtaaatagtatagttggtatgcaaccaaagcagtatgggaatgacaaaaattaagaaatatagtgttaacttatttcatactaacctaaaaaacagtaaggcacactgtttctatcatttgctacactcttgcttcaaagggacttagatttcttaattccacacttttatccctttatgtattcacctggacaagcttcacaattttcattttgttaaatcttatctttcaaaaccccacctcttctggcaggaaataactccctattgatgagtgagaaggtttatgaactaccactctaaccttatattaattccttaatattcgttgtgtgtatagaccatggacattttcatagactgtttttaaattttttaattatctttacatataaatatccagcacataaactcactgagatagaacaataagtttcattgtgctttgaaccatccttgtatcctctggcacctattacaatatatggaatatagtaggtgctcaataagcatttgctgtgtgactctccaactcactgttaataaagcctcttagttgctcaacccatacaaaacggatcattttttcattgagcacatctcattgtactccataccatgtcagcacttcctcctctactttccaggaacttatgatgtaatggggacaggactagacaatgggcaacttctaggcatgataaggactaggggaccagggttggggaacaactcagttggcctaaagggagtcagggaaggaagccttcctttcctgaaggaagcttcaggaaagaggagctatttgaagttggccttgaagcacatatagaagattgccgcccggtgaaggtgatggtaaggatagataggaggtggtggaatgcggaagttcattccaggcagagagaaatcaaagtacaatggtacagggtcatggaagggtcagggcagttttgacttaagtatcataaacttttatttatatgtaactgagaaatggcagctgtatagattctattattgctctacagttatactgataaattcacatttatggtctagatttttgactggcaaaaatgagagccaagtctaatttttaacaaaactgttttctgtctttagatactttctgttgaatacggaaatggtttaacagcatttttaaaattttaatcatctattttgtttccttttctcttggagcattggatcaaaagcagatcattttactatggttgaggtcagtttcatttctttacttctgcagagtgagataatatgctgtggttttagttttctcagatggaaaatatactctttctcctcctgagtgcacatgcacacttttaaaattcaccatattttattgagaagttgggaataaattacataacatcatagtcttaaccaatccaaacaacttaaagatcaaatgcataattaacagccactgctaaaatcaatattgacaggacataaaacagtcctggaatagaatcaccagtgggggatctcccttctcctgagtaattgattttgcaagcaatagcaaataataaaagctaataggtacctggcatctggggaaagcagcattttgagaaagctgtttctaacgctctctggttcaagctgtattttgaagcagagtcagtgtaagaggtgaagtgctgagagtgggaaaacaacacaacccataaggtccatctcattatcaagatctctacctcaggggacactgttgagagtcttcaatgtagtcacattttaaaactgtacaaacaacgtagaatttggagaggcggacaaggccagtggtgggacaatttgctccagatcattttgatcctccactcagaactatgctgacaagtcagaaagcagaggtctctcctgacaatttttagcatgtggctggcctctttgattggaggctaaagtgactgatacagacccaaatatcattagagatgatatttgggctctaaacctgtattagatctgggatagctgtgtaatcctctagtcaccctgtcaatgtcatttatttcccctgtggagaaaccccacagatgtactatcatctgggcatatctggctaacatcatgttgcctgggggcagcaagggcaggctctgggaagaaatacagctcagctttaaaagaaacttcatggttgggcaccatgactcattctggtaatcctaacacttggtgaggcagaggcgggtggactgcttgagcccaggagttccagaccagcctgggccacatggtgagaccccgtctctacaaaaagtacaaaaagtagctgggcatggtggtacacacctatagtcctagctactcaggaggctgaggtgtgaggatcccttgggctcaggaggttgaagctgcagtgagctgtgattgattccaccactgcactccagcttgagtgacagagagaatccccatctcaaataaaataaagaaacttcattacacttgggataaaaactgatgtgcgagaagaaatatttccaagaaatctggaatacattaaaactcaggaaagagaggccatgggatcagtcttctctgcaggctgggctggtccctactcagtgctccttttctgccctcacgtgcttgtgttttgttgtaatccaccgtaccactggctgccagagaagctgcagcattatttagcaatgttttacagaggagaggggctaaaatgcatgactgtaatgtctctaacattaaagaactctgggaggctgtggttttcaaggatcatgatgaaatgagtacctgcaatggtgattacagtagagagaatcggatgttctctagcatgaaccttcctgaagacaggttggcctagcaaaaggacaggcagaaaaatcagcagaatggattgcattgatttgctatcagagctttgtggaattagtaagctaaacatcacacccagatgcacacatcacaagcaacgttagtttggggattcaatgatcataggtcacccctaggtaggtcacagaagggagctctggtggaagttactgatggagatcactgctcagagatgagcgagtatttcatgagccaaacaagactgtgtcaacaaaccacaagccccatggtagtgagtacagccagattcctacaggtatcttaaatgatgtgtcaaggtccttcaaggtaccgcttgcagaagcatcatggaacaacaaaaggtatagtggcaggtgtcgtggttggcaagccagtcttcatgactgaattgaagtaataatgtttttaagtcaaccattatagaaatagtgtactagtgattgggaagcctattagtgccaacaatatagccttgtgtaggccatttctccagtttctccccatgtaaaatggtgataatagtacctgctctgtctaagacaggcagaatgttatgtacgcctgtaggttttgcagaggtaggccatcgtcacagcaactgtttggataacctagggttaacctaggcctagggggttctcattgaactcctggttcagctgacttccagattcacttgctatttgcctctaccaagagctacccataactgacctgggagtcatgagatttgggattcagtgccacctctgccatatgcttgtcatctaaacttgggcaaggtctttctcctctctgactctcaggcttctcagttataaagtgaagctgaatttgaacaggctttgttcctccagcctacagactgaagtgatgaaaacattttcaactgtcagaattttcatagtttggcttccttaaaaagtcttgtgtcttattaagtctattatgtgctgagcataataggattagaggagtaatattaaataggtatactgactgatttttaattagagaactctatatcttagaagttttggggatcaaacttacattcttctctccatagtgagccagaatacttaatttattaaattattcatgtttatatggtccagtttccccattctggggtacttctcacttttcacttaactggaagtcataatgatggaatttattagatacatgtgggttttgagtagaaaaggggttcaatgtataatttcaagatgcaggtagaaataagctagaggagaggaaacaggacagtgctgggattagaacagtcatcattaatttcttcaaaccttcatttcctcccctatgtgtgagaacaatgtcttactctataagattggtgataaagtgatatgatgaaaaagaaatatttacaaactctaatgagttataatatttagagtgttaccttgtcgtatgactggaaggtcaagggggaatgagatcataggcccaaacaagggcctttcaatgaggcaaggtctgggaacaataggtaaagatctgcagattccaaaagcacctccaacacttaatgtccatcactaatgagatctctgaaatattggtattaggctgtggatcagacgattttttcaatttccatatattctgcttcaaatttagattttcacactcagctgcgcaagtccatgtaaaagctgcaggcaaagtcccagggctagattaattcttcttactgcccctgcatctcaaagccttgactttaaagcctccaactgacttccaagaaaaaaagttctttagggcttgaagctgcttttcgctgtagacctaagttttagaactgtcctcaggagcatcagtagagagtggctcctaggcattctggtttgatttaggaaaagaagggtcatgtaaagtgagacgatttcttagaaagtaggaatggacaggccagtgtagaaattcccaagttttggaacattctcttgttctaactgcattaatttcaagtcttaggaagaggtgatggtaataggaaactgccatttcagattacagtttcagccataggaagaacttaatgaactaactacatgaaatgatagaaacctttgtaggaggtgattctgtcatcttggatgccagttgtggccgaggcaggaaaagttggatattatcagacagatattatagaatttgatgtaaagaagttctgagaaaagaaaactaggatcccattacctgagatattaaaagggaggacagttcaaatgacatagaaggaaggcccttaaaacaaaatttgggccaggtgcggtggctcacgcctgtaatcccagcactttgggaggccgaggtgggtggatcacgaggtcaggagattgagactctcctggccaacatggtgaaaccttgtctctactaaaaatacaaaaaattagctaggcgtggtggcacgtgcctgtagtcccagacactcgggaggctgaggcaggagaatcgcttgaaccctggaggtggaggttgcagtgagccgagatcgcgccactgtactccagcctggcaacagagtgagactccatctcaaaaaaaagtcctgacacattcagtaataaaacagaaagatattcaaacacgtcaatgtgtttttgacgtgtggctacagagcatcctagtagccacaagtttttagttagggtctctttatcagatttcacaggatggaaggtgctgttggatagtacactatttctataatggttgacttaaaaacattattacttcaattcagtcatgaagactggcttgccaaatttataccttcttcaaatctcccagggataactcatttatccttgggtgatagaattagagtgtttacaaggggacttcaagcagttaaaatgatggaatgagaaaaaggagataaaagtttaaaaaaaggagtataaattcctgcacttgacttaaaaaataacctttagtagtgcacagttggggacatctgacccagaagagcttcagatgaatcagatttaagaaatccaacacaaagacttgtcctgtttaacattcttatccctttcaacttctgtgtgtctcagagtctatgaatcattttgtcattaaatgccatgtctagagagaagcagtggagagcaacagcccatgtgaaacggcccacatgaaactgcacatatttagaaaattctacttcggacagaatcacattggaattgcttgttcatgagtttacactaacagtggattaagttcatcccaattcccaacatagtattttcatgatcagaaatttgaagtatattttcttctaaatatttttgttcagatctctgatttcaaaattttgatatctgcacaatatattggaaaattttgatattggcacaatatattggaagatgtcacatactgatatagaatgtaggccattaaagatatcttcaacctacagcttcagacagacctactgtttaaatatttatctctctaaatgtgcacagatgactctaaaagggtgagaagatatttagagacaacagaggatgctgtaaggaaatatctttgttttgtacacaagaatatagttttagagttgtgctaaataatgcaatcaacacaggctgagtaccattctaaatttaaatgtttgaaactttttaattttgacattttgagtttttatagaatactttgtaatatgcttcaagtggcagaaatattactcattaccatgttattaatactaaaacctaagtccccagagaaaccctcagattggtgtggtgggatgaggggaaggctctgctcaacatgatattatattatgtattataaattatatatttacatacataatttatgaattaaaatttatgtgttaaagtgatgtatttttacgtattttctcaacatgtatttttatgtattttctcaatatggcatttatgtgttattaggatcctgagcttggaccacggatccatcttggatgtcagcttctatgtttctctgaggctagcaattgtgtcaccttattctagagctctttggagcctctatcagggaactgtacatcattagcactatgtgaacatttgtaaattggtcagtgtcaaaatatgaacagttacagtttttccatatgaacagcttataaacacaacacacacacattattaatttgtaaaacgttaaatgtgtaaaaccagcaagagcacaccatgtgccacagttaaatattaatgcaagttacataagatgtaggtttggattgatggttaagggtatttggggaaaaataaggaacattaaaaaaataagtcttaccaaacaggtattttccttcattaaaagcaaataaaaatgagaaattttttttaatgtaataacatctggtgagaacagacagtaaaagttagatagcattagacttgaaaaattcatacctgttattgtgaagccacctaaaaaagaaaaaaacaacaacaaatgttataatttgacactctacataacaaataccagtgacatcagactgcctgacaacccacccaaggtacttgccaaattatatttacaattaagaagactaggaaaatgttcatgactgaatcactaatcgttcttttaagattatgagatttaatgcacaaatttaattcttgtgcatacctaagaaatcaccgatttttcaaaaggttgtactaaattaaaaatgcaatataaactatttgaccttgacaaaatgaggtcaatggccctaaacaacaatcttgctagcaagtcaagagaaataaaagtcacagagctactgtatcacctgacggaaatggaaaataatctagaaaaatggaaaggaaatgcaagaaatgaaatgcttaccaagctcattcaataacagggctgtgaaggaaacagacaaagacaaacacagaataagagaccagatgaataatgaaagtaagaggaatatcagcagaaagaaatccaggcagatctgattacagtggtagggagccactgctaaaaatgggtataccccaaagaaatatagtgatgggaatatttctgaataaacaatcccaactgaaatttctgaaaatgtgtgtgattgaatacatacgtatatgtgtgtgtgtgtgtgtatatgtatttcaccttatatataatttctttacatttaataagacattgctagtatatatgtttatacctagtatgtaaatctagtttaccaaatacagtggaaacattgtatgaaattcattcttaacttgatatgagtgaggcttcctcattaaatattgcctcggatttggtcaatccaacatatggaagtcttaaatcacccaggaactcaggtatcacaccttttattcagtaagtacaggtgaaacatcctgggacattccattttgggttccctgcctggaaagaaagtttagcccaaggtaaagcactatcttgggatgttctatttggatgatattttgtccaccaagaattgcttatgttttaaaatccttaaagcttaatagtcccaggaattaacacctacttgtgtccttatctgtgacttctgtacattattagataaccagaatccttctagtggacatatcatcccaggaaactgacagggcattgggttggggggagggggacgtataatttgtctttcagcttatgtgctttaagcccagaatgtactgtagcactttattttagtaaaagcaaccttgctaaatatatcaaattatttcctgagttgaagacgggaatgttacagttacttttttgggcccagttttctctctaatgatggtggcattagaggatactttctaaaaaaagtcagtaatttattaatagtgacaagaatccacttggcgggtgtgaaactggatagtgctattaaggaattttaatttgctgttacatgagagcatattttactaaaacggcaattgtaagagcagaatccaagatgctcctccttgagataaagttctttggaggaatacattgagaagaaagtgctttctcctgtatgttaatgaggcattttggatcccatcttttaagaaatcagcataattttctggtctctttttcttctgtctaccatctatggagcatattaaataggcttcattaaaataggccttgagtgctccttttcccatcactccaaatactccaaatactccatcttgaacttgattaacacagaaacatacgtgttttttccccaccagcggactgtgaggccacaaacatgggatgaacgtgggataaattttcctatgtgtctacatagcaattagtcctatatattttatttttccctctacttgtaaaagcataaatttcttacaaagtggcccatctcattatatcatactgctctcaccaattgtttgtatgcaactaataagagctattaatatgtggtctgctcattttacacaataagtaaatcaccagaattccttttaaaatggccaccattagaggataattatatgaagccctatgaacaattcagaataaaaaatcctctgtaaagctgatacaagattgctgtctttcctatgaaatatatgccatatattaataatcagcaaaatcggcataatctagttataaaggacactacttttattttttcttttttttatatgtgttaataatttactaattctgtaattatcaagagattttggagcataaagctaggtaggctttggtttcatagatatggtgccttttaaatgttgtatttgatgatataaaaatatgctaaaatgagcactagaatattgaaaatactactctttaaggatctttgttcttattaaatatttttaaactgtgttctccaaagaagcctaattatttgaattctgaagtttcctgttagttgccattagggtcatctactaatactaataggtattaagcagtttcttttttccagctttattgaggtatgattgatgaggtattaagtcgtctttatcactaaaattttagggaagatttaataattggagtgacattttagaataaaccgtgagtagtgaaaaactaaacacattcttttatgtaatcatttctgaattacagaaatccctttcagtgttattaaatctggttgcaatcaaggttagttggcatttcctgaagaaagtgggcgttgcctgttgcacttgtgaattagggaagggaaatgaaattgctaaagcttcaaaggcaatgaagtatagtacttggaagccgaggaagaggagagagttaagtgtgagagtagggagacacggagagagaagagtacaatttctcgctggtatgtctttgtttactctcacacctttcattcctcttcttatccattttggttcctcaagcacaagggagaaactgcactctttctcatattcctcacggtcaaatattctaatggtaatgatcttcctgtgggaacacaagacaaaggcaaaacaaatggttggagtcacacgctcatgctcttggtgtccaccaagctgaatgttactgtgatgttatggagggagaactggcagcacatgggcctcctgaagtatgtaaaagggcatcttgggtactcttggctggcccccattaagttttctttgctaatttatcactttcacgaattattcccgcttcagttagcagtcagtaggtaccccattttggggtattttggcatggcattgcatggcatctgcagcaactttcccagaaatggatgcttgattgactgccctgaaaattaatctctcagacgttaatgtgcagcgcacctaacgctggctgatgtagctacaggcctgcctactgtggctcagcatgagatctgtgccctgttacataggtggagggatgtgtgcattgtaagtcatgttctgaagagtgcaggcatccaggggtggcacaggccagcagaagctgttgggctcagccctggagcagctcccccacctttcttctcactcatctccaccaggcggggctctccaatctcaaggaagaaggtcttgtttttctcatactcctcatcatcaattaccttgactgatattgttttgctgaaacagagaatagaaattgacgaacaaggggaagaggaaagagaagagaaggaacatagagaagaggaaagcaaggttaaccagctgcactttcagacaaacagtaatcgagaaacttctgtactgtgagttttttcttcaagaatgggtatcagataggtatgaaagatcagagatttcacccaatgcatagctcccctgagcagggccacagaattattttaggcaaaatatagcattcagtattaataggtttgtcatcatcataaggaggaaaagcagaaaaacacagatcacaataataagaaaagaaaaacacattaatttagtaaatgccttaaccattggattgtctaagctatgccctggaactcactcctttagaacaagtcaaaaaatcccatcaagatattaatagaagttatctctgagcaattggcttacaggtcattttttttccttcactgtgctttattatagttccaaatatagtatttttatcataaattgttattaaaataataaatgaataaaaatatcacaaagaaaatatagtcaagttatttcaccccacccaatgtcttagaatcaaactcttattcaggttagtcagattctccagctagaccacagcaggaagttgttcacgttttgtttgtctttctaaagatggaagctgtggcctcacaacagctgttgtgaaagtggggtggcagcaggtgcgagtcatgatgttgtagttattttcattcttccaaagttgagttttaactttctatgaaacatgccatttacactactttcaaacatcaccgatacaccaaggtgttttgattagaattcttcctgtaatccaacctttaacagttcttgccttatggcgctatggctatgagtgactgacaggcaggtaggacaaatgcaaatattatgcaaatctcaactttccataagcattcttgatgactctgaaaataaaccaacctaatgttaccttataattaataagggcttaaacaattcatatactacaactaacttattagaagcctcttaaaccctgatttgtcttgaaaaaatgtttccagtaacattggccaagtacaattctgatcaatgtttttgaaacaatgagtgtttgtagacaacggaattttaacagcatggccattctttaattttggtggagttttttaggtcttctggaaggaaattggcttatgatcttgtttttattttatttatctgagccattaagtttcattagatctatgcatactaaagaatatcagtcttctttcctaatatgaaggagtcataggtagaagatgcttttaattctctgaatttcccagcgcctaatgccaaatgcttaagtcttgctttttggcttagcattgtagacctgagaccaaatgattggttctggttccctgaaacccaataacgtactctctgttcctcagctaaagaacattcttgaatgatactcacattccaatttctcactcctaaaaagctgcagctcatgaaactcctttctatctcatttctgtcctcaaatactgaaatatgaacacactagatgaacagctataagtgactaaagccacaatcatcttttaaagagtggttagatatttacaaaactaccaacagtatgataatgtccagttacatgtatactgtaaacagctccttcctgacttttagaattattttttaaatttgcatctttagtataaaaaattattctgctgtgactaaactagaatatttaatttttccctaatatccaaaaattataaaatattagagaaggcacaggaggatggatgtaaggaatgattgattatttgataattagaactgaatttgatgttgtaaaatagatcaaatttgctctacacaaaactgccaaatgtctgtcctctttgtcaacaaaacttacgcattttgggtattaatttccatctcacagtcttgcaatcttaaactttagtggtacatttctacaaaaacaaacagcatggtgagaccaagggtaggaaagtgttgatggacaataatagggccacgctactgttctctgcacttgatggcccaacatccattatcaagatgcttcattgtagggtacatcaaactgaaacccctcattgtgagagtcacgttgcaatattcttgttagcattacttaaaaacatctgacgttatatttctccatcttgtatttgcaacccaccctgcatctcatcacatattttattggattatagaagtaaagcacagtggggatggtagaagtagccttgctaatagggtgaatgtttgtgtagaaaaggtacctgtttcatgttcacaaagcaacttattcacaaataaataaatcaccaaacaacatattgtttctaatccttggtgaatatcataaatatttaaatcttttaatagctttattttctttctttttttttgttgagatggagtctcactcttattgcccaggctggagtgcagtggtgtgatctcggcttactgcaacctccgcctcccaggttcaagcgattcccctgcctcagcctcctgagtagctgggattacagatgcccatcaccatgcccagctaatttttgcatttttagtagagacagggtttcaccatgttggccaggctggtctggaactcctgacctcaggcgatccacccgccttggcctcccaaagtgctgggattacaggggtgagccaccacacctggcctattttctatactctaagtagctgatgggtgtgggaaacacagttatatagctccacacaatttgtttgcatataaaataagcatttatgatttatcactagcatatccctagtcataggatcacaattcttagaaaattttgaagtacttgataactatgatactggaaaaatcaaagatgaagaaaaagaaaaaagtacttttgtaggtgcctggcaaagacatctaaaacagatggaatttgcataatggcatatcatttcaaaatcattagtaatggaatcaataatgctcctgacaggaagagccactaaattatatattgatttcactcctcttgcacagtaaagctattaataggaaacttgattattaaaggacatttcagtggatctaaagtggcaggatgaagtcagtccttatgaattagccctttaaatcaacagaggcaaaaatcagaaggcactggtaatgttcaccttttgcttcagaacagaacaatttctccccttagcaaaggtagctgaggtgaaataaaccaatgtaatttttaaaggaacacatccttaggatgtctccttttcaccttccagagcctaatgcatgaaagatactgctaccacttcttccttcacaggggatagtatggggttggtttggtgaagatgtcgttattttggcttgataatcagcagaagcatgttcctcacagttctgcagtagaaagaatctcaaggactgacggaaccttgaatgtcctccagttggccccattgccacaccaatcccatgtccacaggacttttgcactgtcacaaggactccagctccctgagaacctacatccattttggctgttctgttctgtttaccaacgggaaacatagctgttgctacttcttttctttaaatagacaggttaacaaaatcaagactggaactgttgggtagacacagtccttcatccaaatataattcttgcatttttactgcactgataaagaacaaatagaaaaactggtatcatgcaactttcaactattataattattataaagacaggaaaactcacttcttttttacagcttttcaaatttgagcagtatactataaaaactgtggtttctggaaactagcaaagcagttacaaatcttacgatagcattgaaatatttcttaatatggccaaaatttttatggaagtacattttggttctatttctaaaaaaaagaaaaagaaaaaaacattcggttaagaaagatcaatttattcagtggaaaaatacagatcattccttttgaagttggcagtgccttttatttgatgataccaaaccaacatctatactttacttcccagtctctctcttatcttaggtgtctcaaaggacctgaacatcttcaaacagactaccaaggagttcttatatctggttttgactcaggcagacagtcagaaaagaaagaaagatgtggctttattaatgagggttgaaaaagaaagtctcttcaaaatatattttagtttctcattgttaagccaaagtggtaccacagtctctttttcaacttaagcctcaatttgtccttctatggtttcttttctttaagtctgcccttgatgttgggagaagatcaggaaaggatgaaatggaggattaaagagaagagactcctccattttagatccttacacaaaagattttagtgaggatttcacatatttagatgcttacagttgctttttgtcttttaaggtttaccctctccttagatattctcagaggccagtggaatgataggctctttgcatttcttaattcacagatcttcataacagccctagaagtaattcctactacctgcgattgacagggaaaacaatgactctcagagaagttggtaacttccaaggtcacaaagtgagtctcctgtgactggcttcaggaaccaaaacctttcaatcatatgactcaaaattagccactaggtcccttattcattcaactgtgcagtatttttatggccactttaaaggatctggatcattaataacgagttttattgtttcgtatttacattaacaaagaatgactgtatgaacaatgatagaatttcaattctgtttttaaaaggactgcagcacacgttatattccatgatggctgctttaaaaagttaaatcattgaggagataaaggtttaattaaaaagagcgatgagcatgcaatggctcaccaactctgaggactctgaatagttttaaccagctgtctcagcatcagcctcacctaaagtgggggacttgttagaattgcagaatcataggctccatccaggcccacagaatctgcattttaacaagatccccagatgactcttatgtatgctgaagtctgagaggcaccaatctagagtggacaatgggttcttgttattaagttggatgataaaccaataggctggtagtagttgggcttgtgttttggacccagctgcatattagaatcacctgtgggattttgcaaactagaaatacctaaacccactccagatcagttaaatcaaattctgcttgtgggagcccagcatgaatatatttaaaaagtttctggataagtgcagtggctcatgcctgtaatcctagcactttgagagatcgaggtgggaggatagcttgagtccaggagttttagagcagcctgggcaacaaagtgagaccctgtttctacgaaaaatcaaaaaaacaacacacatgcaaaaaaaaccagatgggtgtggtagtgcttgcctgcaccccagctacatgcgaggctgaggtgggaggatggcttgagcccaggaagttgaggctgcagtgagatgtgatcatgccactgcactccagaactgcgagacagagtgagacactgtctcaatcaatcaatcaaccaataaaaatgtttaaacattaaaagttttttaggtgcttctaatatgcagccagggcttgctttaaaaggatacattaaataataatatacataaaataaagaatatatagaattgtgagacagtaatagtccaaactaaattttagatctaattagcaaggtaggtggaaacatgggaagatcattttgttttgtcttttactcctgctcttttctggattataaaatgtacttaaagttgttttcccctctcaagaaatgacggtctctgcaggcaaccttaatagtataggtgagaaaacacctttagtattcaggcatcagcgtttacactcatgcacagtgatttccttctcaagaaagtgatgggagctctggcgatacgtttttacacaacagtgattatatctggaaagtagacaaactaagcatttcagttgccgcagaagacagtaatgcctcatgtccctgccacagagcctctgagccatgtcaatgaagggccatgtcgggaactggaactttcccacatgtaagccatcacaatcccagactccagaaagacctgacccaggactgaccacgcatgaacctggcaagttctctgaccacaaggagtttgaaatttaatccacagtacacttgatgttaaaagcttcaggataaactcctcttacagcttacaaagacaaactaaccaaaaacaaaaaaaaaaaaaaaaaaaaaggaaaagaaagaaaaaaagatgggcaaaggatctgaatggcatttctccacagaagataaacaaatggccaataagtacataaaaacatggtccacataattagctatcagggaaatggaaatcaaagcatctgggagataccatgtcacacccactaggaagactacgataaaaaagacagacaataacaagtcttggtgacaatgtagagaaattggaaccctcatatgctgctaataggaatgtaaaataatgcagccactttggagaagccctcaaaagtttaaaagtagaattaccatgtgaaccagcaattccactatatgccaaagagaattaaaaacatgtattcacacaaaaacttgtgcatgaattttcatcgcagcattattcataatagccaagaagtggaaacaacttaggttcatcggctgataaatggataaataatatgtggtgtatccacacaggggaatattattttgcaataaaaaggaatgatgtagtgatacatgctacaacatggatgaaccctgagaacatcattctaagtgaaagaacccagacacaaatggctacatgttgtgtgattacatgttataggaaaagtccagaataggcaaatccagagacagaaagcagattagtgattgcctcaagctggggacttagagataaaaggccgggtggggtggagggagttggtgactgctgatgggtatttggaataatgaaaatgttctaaaattgattgtagtgatggttgcacaattctgaggacatataaaaacccaactaattgtatattttaaatggttgaatcctatgttatgtaaattatgtcttaataaagctagcatttaaaaaaataagctttaggctaaattctagtctttagaaaaggctgtttccttgggtgagaaaaggttgtcagaatgtttggagttttcagtaaggagtttcaaattttgctagtacagccaaatagaaaactgtgatttccacagttttcatttacatgaaagctaagcgccactgctgtgtctgtctgtaccctactcctttcctcaggattttgcatagaatgctggttgccccctccaggatcaaggactaagttgtactttgacacactaagcagttctggtggctgttacctcaggctggcttccttgactcctttcttttccccaaaatataaggtattatgaaaatgtcagaagcagcttttcttgcattgtgtttactataaaagcaaaggaaatgattataatcataaggaggcctgctgcctttgcaaagtcagtagctctgttcatatcaccttgggcattctctagttcttttgttggcatttatttcttactacctacaggagatgatgagcttgccatgggttgcctttgtatcacttggtttaaattcctggtgcatttttaagcctttttttcctttcaaaagttgattggtgagttgcttactgatttggggttagggaaagggaggagcagtcagagaagatccatgcatatattatcattttctgtaagtgacccaaaccaactcctccatctagtaaacatttcaagtggaataaggacaggttgctattcatattatttctactaatatttttacatcatttttagattactggtgagatattttgggcatggattcatttggggggatagtcataaaaacaggactgaatcatgacttaaatctattgtttcctttctcgaaatcttgagagaattaatccagaagtcaacattacccaggtttgtaacttggctctgctactttctagccaaggtatttgggtcacttctggcatccttctaaacatcaatgttgtaaatctatcaaatgaagataatagaacttacttcacagtgattatgatgttcacagtgttgtgatgatcaaataatggttatcatcatttatcaaatatggataatgaaattcgcaggttattgcaaagattaaataatatattgcatgcaaaaattattttgtaaagagctaatgaaatgttaggtactattattcttattagttgaaaaggagtggtttgttttgcagttcttgcctgcctgtttacccagttactaaaaggagcaaattggcagatggtagagttgtgggtcaggaaatattcaatggagtaataagcaataccctcaaatccactctcatatataactttggatcaaatcccatataatggggcatccaagtccagaatccgaaactcaagaacgcagggagcacagctctgccaggttctcattcaccactagcaggatacgcacagggatctgaagtcatgcttttcctggagctcctgctatgaagcctagcctgacaaacggtggtggtgctattctgtaatttaaatagactccaaggacaagagttgctaaagtagctaaaccaaagtaattctccaggaggccttgttgtccgtgccctgatcttttggtattgtcaaatggttattgaaatcattgcttcaagcagagcaagagacagcgacagctaaaatcctgctgttcccagggagaccaagggagctttagagagttctggagttggggttttctaacataaccttgccctattttactttcctctgccaactatggaaacttaatggcaaccagttcattttgtcaaatgcaaaataagaataaatttagttctttagtctatgattttagcaatcaattgtcagtgtcagtgtccaaaaaacaaatatatgagctacttttctgtccctagaagacattctggttgactactcgaaagagatactacagggatccatagttattgtttttaataaataataggctagtctgtctagtatccccacaatgttctatgctattatggtaggtttcagagaagatcaggtgagtaagtttgctaagacaaaattacatgggtgtattaaaaattgaccataattttgtgatatataaaatgtataccttaccattgcctcactcttctgcagttgataaacttcagccttaaggagggtaaagcaataaggacctggggtctgttacctacacatgcctgctgagaccatttctctgctcagtgaaaattaaagtggatcaagcatagggtaccatgttgaaatatggcaaaatagatgcaaattgattttttattgcttaaaaatactggcattttgcaaattctatgagagggtcacatttaacaaaacgatggcagattcttggcatcgtcaaacttattagttaacattcttataagactacctatttttctataatctgagatcttaactgtactccttaaatgcagattctctagaaaataatattttaacaaaatgttcaaagtttaaggtaacgtttaaaatgatttgtggcaaagagcatcttttctagaaatgaaacacatcaacatctttgtctggttcagttttagaaagatcagttctccatttgccactgcctattacgagaatttagaatgacaatgaaattgatgctgctggatttcagactgctggttgcccaaccttttcaaaagctctcttcgtcctgaacattttaaacattcctggaaggtcatcagactcgttccagagattatttctacctttggtctttcttcctatgttacgtttcttttttcaaagtaaaaagtgtcaaggaaaactctggaaggacttcactcctggcatgttataggacagcagctagaatatgctgaaagcatctctgtcagaaagaggtcagctttaaaataagaacaccaggaaatgagctgggctttcttaagtcttaaaattcatattctctttctctgttttccctccttccctctctgtgtccctggccacaaaatgcacagtggcaaatcaatctctgtctgcatgtactcttgtaaaacattcttaaagatggatgccagatattttcttgaacatggctaaaagaaaccaataattagtgaattggtgctgatttttaaatttcacattttaattttatgtctaatattttattggtatttcacattagattaggagacaagagaataggaccttaggtattagtaaagctaatttactaatatcaaggggtagactagtagaaatcaataccagatttctttttttaaataaaatttttgatgtatccctttggctgttgcttttcctgataacctggataaaactaaacttgattctaaacagagttctgtccttgtctatatgaaacatcataaattgccagaaggaataatagtccgtattagccagtttatattccatgggttctttctcactaaatacaatgtggattgctttaggataatgtatattcttttaaagcatcttcctgcatattattatgtttattatcgagacggagtctcgctctgtcgcccagtctgtagtgcagtggtgcaatctcggctcactgtaacctctgcctctcaggttcaagtgattctcctgcctcaacctcctgagtagctgggactacagaagcatgccaccgcgcccgaataatttttgtatttttagtagagacagggtttcaccgtgttggccaggctggtctcgaactcaggtaataccacccaccccagcctcccaaagtgctgggattacaggcatgagcccctgtgcctggcccattttcctgcatattaaagtaatacttgctaattattgcaaatttgagaaatgcagaaatgaagaaaaagtcacccataatcctatcactagaaattaacattttaaaatgttttgttttagcttttaatgaagttgccaagaatattatgaatttttgatgttcttctatggatgagctacttgggcttagctcttttagaggccaaagtttattttcccgacaatcctcctcacatgcttgggccccactctggactcttaatgtagaaggtaacgttccccatcttctctttctattggcttgtatggaagttcttgtctgaattctgccatatggaaaatgttcacatacatttttaaaaggagaaattctctcctcggtcattactaaccttttggctggttttgctggaaaagttttcaggattcatctgccaatgttgtttccctagaaggccatcctggctacctcgctaagcatcttatttgttctgtaacaaaaaattcttcatgctaaatcactcgcaaatgccatgctgcttagcgcccttctgctaatcacccattcccaagtttgtcatcaaaatagcattagttattttccactcaacttcagccctcatcttcccaagccctccacttttcattctagaagcacaatctctcaatccttaatcacagaaatctccctgttcacttctcattatacacatacgcaaactgagactcagtgaaattaaccaatgcctcaaagctagtggatgccagaattaggattaaaactcatcttcagactccgaatccacatctgttatttgtttattctgccattatcctagtgtttttcttctcgatgctgctaaaatctaattcaccactcttcatagaaaacttttctttttctcctctctttttaattaagtaaaaaccgatgctgataacagaaagaaatgcatgattttctttggtaactcagtaccatttcatcattgtccatcacgctgagggatgccttataaattcaatggctcatgcaatgcaaacaaatacttcctttagtaaggatggctgtgttgaatcttggcctgaaagatctttgacctgaaacaaaactacaacatccacagaaacgctacataaagtgtacaggtaaaataatagtcaataaaaatcaacccctagtcttattattattctcaagtcttctgggcatcccacttagcagttgcctgtctctccactttttcttccttcttcaaacatagtcatggtatgcagcccctctctaccactagacgtggtcaataactgtgtgtgtgggtgtgtgtgtgtgttttccccttagaaaatctatttgcacttttaaaggaatattcattttctaattcaaaagggggtaattgtgaaaagaactggctttacaacaatgtggtaagcttgtaggcatagttgagtagtgtgcctctatatggtgaaatactccttgaatgtctaatcccaaacaagtaattaaatatagtataaactacaaagtaaaagtcactaccgacaaaatatcaagggcatcaatatgcctcctgttttctgctttctgctgctactttctactccttgcaaggtccagtgatgtacccactaactgtggactctcaccgaacttttcactatagcacttacttgaatgtttaaatcttttctgggtattccatttagcttaaaaaaacatcagttatcattttggagttcatattcttgatagaagggatccaaacactttataggtaagcatcacaagataaaatcagcaagacaatttagctatttactggtacttgcaatttaaagcttaaaatcaaaattaaccaaaaccagaacagactttattgggtttaaactaaaaatgtgttttgctttctttcccttttttgtttcttgtttatgatggaagtttccccagctagactttatagaaccagagcaggtttgcaaaatgcaaataatgacactgtttaacaaaattgaaccactggaccaaacagtgagaaagtacttgctgagcaattcctgggttaattacaggattctgatgagctacatttaatgtgcccattgattgtagacgaaaatctgtaagtaagctttgaaaatttttttaaattttattatggatcatgtgtagttcagttagggctcaaaaaagcgaatcttcacccctatttcagcttttgacccagacataatcttatagggaaacgttgttttgaggatttttattagtttgtaaattttgtaggaagtctgtgcttttgttcagagaatcatgtaggtagagaggacctacgggatctagatttgcatttgcaatagagttacagcttttagcagcattatttagtcacttaacatttcaatttaaatatacaataagacaaattatatgtaacccacaaggttaatatggaaaacaaataaaataatttatataagagatttttttcacactttaagcattttcacatgtgctttcattattattatctaacttaatcgcattcttgcaactgagcaaacttagatttcttgattccaacaatctttctagtaagctaaagcttcctcagctgtaattcaaaaatatatatggggcattaatatgaatattataatattcattttggaaaataagagttttctgtgtgaatgaaaaagcaatgatttctgacacctatccatggatctccttttagagttttttttacatttatataactaaagcctttcaaaattgtagcagcagatacaattgactgctagaacatgagcaaatactttattaaatatttatgacaatttcttattgaattttaacatttatattaactttaatcatggtacaattaagtttaacttacatagaatactaacgcaaatggagaaatacgggaaagctttgcagggcatctcaagggtgggtctatgtataatgaataaatcctattcaataaaatatacagttttactttttgtattatttaggccaggaaactcttagaagattattatggattttcccctacatattaacttgctgtcttggtgtaatatttgttggtcctgaatacttttttttattgagttatctttgagtttgtagaatcatcaaaatcctcttaatagatttaattaaattgctttcacaaagttagacttcctgagatagagattcaaagtttggtgagactggtaatggaacagaagagaatccatggaaatacaatcctgggtcttcagaccccctaagaatgtcagctcttcaggcagtactgtctgtattcaacagtaaccatccgccacgggataggacagcattaagtatgtgtgcattccccgtgacagtgagcacagtgctggcacatagtgtttgcgtaataaatggttttggttgactcactgtctgtacttgagtttgtgccaatcaatcaaggtatcttacatttcttagtaaaaggcagcttacatatgttttagataaaaagatagggttcttaatgttgatctcaccatgacagtaagcaaaatgaatggtgtgtaggtgattcaagctcatgacctggacatcatgaggaagggcaagatgaatttatcagccacgttttagattcctgcaatatgttattccattcagccattccacaaacctttactgagtatccaatttttgtgactggcccacattaggcattggggataaaaagaggagtacgaattcacagcttagagaagggataggcatgtaaaccaaagattatgcacctctatgtgtgttaattgtaaatatgggctctgtgctgtgtgagcacagtgggtggggaaataaacagagacttggaaaggcatggcatgtttaagaagcatcaggttctatctgacttatgtttatggtgtgcacatgtaagtggtagagggttgatgggaggtgagtcaagaaagagagcttggagacaggagaaatgctaaatcatgtgggcataattttgcaagaaggagccaatgggcctttttgattatggactgctattatccaatttaacttttagtacaatcactaactctagaataaagcttgtattgtagtgaaggagagggggcagggaagcagatgtggagaagatattatctcctggactggcagagcctaaagtccctgcctgaataattagccaggtacccctccagcagcatactttaaagaagtgtctggccccctatctccagtctagatctgtcaaagctgaataaataaagaaaagttgctttaattacttttctgaaatttctccttcctgaaaacttgtctgtgggttagagaaaacaagttgaaattgcatgaaatgctttctctgagttcctctgccaagatcaatttcttgtagcacgatggaggtagtaaaatacgaattctgctagagaaaacatcatgagattgtaaaactgacctgattttcatgaaaagaaaatctatctaccataaattcagatctgagcacatatttcattttatttttatcaaccgtgagtaggtttggcaagccttatgacaaaatgatatctgggcatatatgttaagtttttaaaggaaattatcaaaaactaaggtctcaggttaatgatttacatggaaaattgctatcacattacattatcttctacagtatttgcaggagaactggtgagagaattacaaccaagatgatataatgaaatgaaaatttacaagttgaggtgtgggaaagggtaaaaggataacactgagcgatcactaagaaaaatgactcaggttactcagtaagcaatgtgtgtgtgtgtgtgtgtgtgtgtgtgtgtgtgtgtgcgcgcgcaaagaaaacgagagggagaaggaaagagaaatttaaagacagagatagaataaaatgtcttgagttttatgataagaaatagccacttaatattggaggcaaatgaggtctaaaaagattggaggcattaataaaattaataacaccagttcctcgcccttctttgtgttaagcagataggagcagtgagaggttgaaggccaaggtgatagcaagggtttggtagcagcaattatgtcatatcctagggccagggcctaggaccacacaatgggatgagacagactggaagaggccaagactggaactcaacccgcccactggagtagtgcaggtagtaggatatcagggagtctgtacaaagccaccaaagatggaaggtccattccgaagaaacaaaacacagaacccagaaaatatggaaatctagattatacagaagccaggtaaaccactgggtgagatgggcaagaaagcatggagctgagtgatgtagaatggaggataaaacaggacagatggctgctcatagcatcatgtagcagagttctgtcattatctgttctccaaagggactgatcacaagaagaatgtgccttcatttaggatgaactgaagtcttgaaatcaacacagggaagcaaaaaccagttagaaagtcaaatatgactttcaggcagatttcaggaatctagtagtttactgcttttgtttctgagtatctggaagaacacatgtgatatgcagaaatttgatagtaaagtatctggtaaatgaaagactggacttttggaactggagaatagttcagagaccgatgatcaacaagcttattgggatgctgaggctcagaggagagctaggctcaggcttgtgaagttcctcctgcttaaggtcacggtggagtggggctgagaaaattggttgggatcagtccagacttgtggagaactggaggaaaggaatgaagctgagaaagaatttggagaaaaattgaaactttctacctgcttcctctcaaatctcttctgtatgactatatctttatgattatctataacttctattaattatttaagtaaatagtgtttgcaagggtccgaacatgggagaaagataataatatgggaggttaaggaatcttgtggggagaagataataaattcttatcttgatatatttaatccaagtcatgatgggaaatgtcttatagaatgtatattaacagcgtatttgtacataacagatctggagtgaagacgaagtatctggatggcaagactctctgtatatttgtcatgcattctgaagtggtaattgaaggcactgatgtgagctaatagacttttttccaaaggagtgaccttaaaagaaaaatcaaagaaatgtgaaatccaatattgtaataatatcactggtaagagtgtaaaagagtaaagggaggcggggagaaagggagaccgagaggggtgagttacaggaaggctgagaaatgctagggtccttgaagcttagggtaggatgtctttcaacttgaaggaggaagtgctaatatttaaaaatcaggagactaacaactttatgggggtggggggaagggtcacagtttgggctgagaggaggctattaaaaataaaaccaaatagctgacttgtgttgtgatttgaggaaggacaaggaaaaattttcaagttgtaatgttggtggtggtacgctcaaagagttttaatacaaaagaggagttgaatgaaatgacacatggtaggggcagttgtagtgagtggtgactttccagagaagttgtcctgagaaaactcaagcatgcattaaaacttaagaagtgaattctcagtaaatacaaggctcatttcaccttgagaaatgagcctctgaccttgtgaggtcctcagttttatggaaggaacataatattagaccagtgggtcctgagatccagctggctacttgcatttcctgtgaagctttagaaacgaagattccttgtcgttatcatcaaatcagagcctctgcatgcgtagatgaaaggtgagcatggggaatctatagtgctgaaaagctcccctaatatatctaatgcaatgatccatcaattggtgttagggaaatattctactagacctgcacctactcccaggttaagaggcttaacagcaaatatcattaagggccttaaaaaataacccttttctttcattatctgtctcactccccacatttaaaccgctcatgaaatttacacttttccatgacgctttcttagattgatcaggtgtcatattcaggggatgaaagcaaaaggtagttctttgtggctcttgtggattcttcacactgtattttaagagagaaattttctatcaagtctactctcagtgcattgattagtggtaaaagtccatttattatctcacagaattactaagtctgtagcatattctgcagagggggtgttctttatggtagatcgatttgttctgtaacttgtataattttccattagaagatgtcatggaagtgctcctgttcatatcccacacatcagtggctgcaaatcaaatgaagcctgttacttgttactgtagaattggaccaggtttgtctgatactattccatgccaagccatttgccccagttcccatttgggggccagatgaaattattttgagtgcatttcgatagtgatatccctcctgataaatttagcatttactgagggatccactttctacgcatgcatgtaactgctattttccctgagctcagagatcgttggcagaagtgacagctggtgcctcgggatggagctataattttatggtgcagtgtctacggctggaaatgcaactagcaaaccacaaatgccaaacacatcataaaggaaaatgttccttaggaagtacttgccaatttctgagcaattaattagtccctaacatacacactgacttgtatgaataaaacagcctaggaaattaatttaattaagcagacagttacgataaaattaggtgctttccccctttagcaaaagatctctctttcatacccacttctggcttgcatcctcactctctggtaggtctgcttccattttccaaactcttataaggactctaaaggaaattcagtattcttagaatgagaggaaactgactggttattccaagtgaaactgcttgtctcccagacattttcctgttgaaattttccccagcttgctacaccttttctccactttctatggaaccaagagagtggtagtatctgtgaggttcaagataggatctattgacaaagctccagagtggtagtatctgtgaggttcaagacaggatctattgacaaagctccagggaagaatgactgtccagaaatgctccttgggaatagcttttgtggaaagaaagcagtgcctccaccccacatctttagttctggcagctccctatagcgacaaagtgaatatagatcagaaggacaggagtgcatatcagaatggaccagatgaggaacagcagaggaacataagattcagggcagctccaaacttctagaaggacttgccaactctggtcagttgaaaaagtcattatatgaatatcttatttttctaaaatgaatgtgtgttagattaaatgaaagatataggaagggaacatgtgaacattggtaaaatatagggattagaagtaaaggagggattagtgttttggaagataacggtagcaaaaaacctcaaaacaattgtgtttgaaatcacatacacactggcctaattgactggacattcttacatggaatgctactaaccagagttcttgtttgcatttcccaagcctagaaagatgatatataattatcaccattatatatttatttagtgtgctctctgagatgcccaaaacacttggtgacatatttaattaattcatatcacttctataaaatatttcaggtatttaatttcagttgctataagaaaaatatttattgatttcttttttaaaaaagactgcagttggtaaaactgacccagagtataaatacagaatgaaacctgcagtgagaaatgaattccacagtaatacagataacaaggagaataaaacccaaagtcagagaccttgatatttgattatcttcagttgtttggaatgcatggtttgagcatgctcatgagaacactggcatgatactgggtaggttccctctttaaggcactaactactctggagagtgactccaaaatgtggtttcccactcctcattactatgacaaatttcacattaactcaattgtcagaccctttccctgctgatacagggttgaagggttggcttggtgatcaattctttgagctttcagagagattttgcagcttaatggaaagctaatttaaggaaaaaaaaaaaaagaagttgaactaggatttgctctagggaccataacatgaatgttctattgtaagcttcttgatggaaggcattatattttaaaatcctatagtaatacaattaataaatacagaaaatgccagctgatataatagaaaattgttcaagactccaaaaattaatctgatcccatttcaaagtgaagctaaaaagatgtccatgtttttagttgtggaatttagagtatgtgatggggcctacttggaatcctagtagacagaggaattaaataataaaatttgcattactcagatctatcatagtggtggaaatggacactgctcaccttgtgagccttgaatgaatcaatgttggatcactggcttgcaatggatgaagcttggcaggcgtggtcttcctgaagtggcactcctctagaccaacacatgatactcttattccatcataatcatactacagagaatagacccccataaggaccataaatattgtttgtctgtactgtactgcaggtgatcaaaactctggcaaccaataggatttattttctagaggacagatactactccaaaacaatactagatcaaaaaggaaggctttaaaaattacacagaagtgtttgtggcaaagatccctctttgtatgtgtaggactataggtattaagattcggaagcaagcagaacaagttctgctatactatttgccaggaatctatgtcctcaaaattcctctcctcatttagaaaaacacaattacaaaaactcagccatagagtttgcagtttgacatgttgctgattctacatgataattgatcacttcaaaactgacaggacttacattaggctcttgttcttagttttagttttaacaggggaaccaggaaagaaagaaagattgctcatcagtggccatatttggcaaaggcaagactctcttcccccaattcattcatcctgatagagattgacacagaccagatgttattccaatgttaaaattacattgttttcataacaaagtcagcttatattactcttcaagagatcacactaatgctcctttgtatactgttatgaggagggtgagttagatctttccagaggacttgccaagcacaaactataagaagagttaagattttctcaaggcattcactagctggcttacaatctacatatctatgtgtctctgcagcacatagaggatttcaagtcattgatatatatatatatatatttatatatatatataaatatatatatatttttttatatatatatataaatatatatatatatatatatatatatataacctcttttagtaatttctgatacttagaagaaattacaggtacttgttcttcaggtaggttgagagctagcgatttcattggctagagcttttttgttgcttattttctttgtcctttcctctcaggtcatggtgaccttaaattatgattccaatgcttaagagttttatgtgtgctatttttcccatgtaacatctggaacttggaaggtaaaaattccaaatcaagggccagaatccatatgggctcagcacatgtaaaccataattttggaagcttagtccctcttagcccccttatcattgctgcattcccacttactatatcacctctgtggccttgatggcaagtttgggaactgagaactcctgaaaatgccaacaagcagtcatcttcaggggattctaatagtaaaaggccaaatgaagacattccttgctgaccaagtcaccataactcttaaactattgccgtgagccagaagaaggaatttttttcttttagctttagagactttgtccttaattgacttcatgcttcttattactcacaatattcatttttatatagtcggtttatattgtagaaaacaacccacttaaatatttatatatgataaaactggtgagtatgagtgagattataaaacaagttaatatatttaatattacaaagaatgctaacatttctttatttccacacaacactctcttctcttcttttattctcttctctttttgcctttaagcaaaataaaaaagactcaaagtaagggcgagaattataatgccaaaatactcaggaatatcattcaaatcttgaacggagacccccactccctcaaaaaaaaaagaaaagaaaaaagttatccataaataatgtacttctccttcaagattactaggttatgtaagataaatgccaccattttctcctcatgctacttaatctaagaagtcttatgattttctgtttttcaatttcttatgttttcaatttcttgtgacttgtcaaaggtatgactggttgggttctaatcaatatttttctactcattcaacactatttggctctaaaaccaaaacaaaattcaatttacaaatatattatttttgtggtaaattttagattgtctattactccaaaccagagattttaatgctaatgtttgttttgaggagaaatgagaattaagcttgatcttgatgatcaaccacagcaaaattatctccagttaggaaacaccagtctaaattgaaggtatagtatgtctccactttccctgaatgactacatggtattttactaagctttgcctttgtaagtacacacagaagggttcttgactattctggcttgaagaacttatgctgaaatgagtcatgtaaaccatggcagagagtcacaaaactggaaacatggaaggctgtatggtcatagaaacaccttaccagtagagtaccctgaagaagacttcttgttagcatttgcatgagttcttggtccccaaacttaccatcaaggccacagaggtaataaagtcaatgggaaagcagcaatgataagggggtcaggaggtcataacacaaactattggaggagttaagattttctcagagcattctctagctggcttacaacctacatatctatgtgcctctttgcagcacatggaggatttcaacactgaacatttgaacattagatatataaaagcatgtgtatatgcatgcatgctggtgtgtgtacacatgctggtgtgtgtacacgtggaggtgtgtgcaccctagaccttttttgctatactatccttagaggatgtgtttccaaagattagatcagcaccatggagcaaagtgcaaggaatgaaaattaatccagtgttaacagctttatacagtaagaagagtaggtcaaaatgtttaaaattctcattgggatctatgaacaattttttatgctatcctctccacctcaaatgtcctacttccacatccttgcacgtccaaatcttgctcaatccttttagatatagctgttaggacaccccttcacaaagctatctgtgatttatcactcagaattacctcttttctgaatttaccatcagatttttttctgtaaattcacatggtatagatcacttcctgacttgtatggtgattatgtttctacctgattgttaatagtgaactataaacatcttcagaacaaaatccctgtctgcttcaactttgcatttctgaatagaaggggaaacaatcaagaaatatttactgaatcaaaatatataatggtggccatatattttatcctttttttctaagctaatagcatttctcccactcttaaaaggcatatgcagaaatcaccaagggtgatgtgacagcataacattagcaaagtttaaaagtacacaagagctaaactgtggatacccacacaaacagggagagacctacttcctggtgtcaatgaaattacagctctaaagagccaatatgtcatttaatttaaaagtcactgttcatgaattgcaattaccctctggcctgcaagcatgtgttcatagctaagaaattttctctatgcccaggtagaatatattgctggcttttccaggggaacctaatgccaaatagaatggcacctacataaccaacttgaggcatgctttaaaaagtgtccctgtgataagccacaagaaatgacagactatgttgaggaactcagtgactctacagccatgctaggcttggagcccactcagacaacaacatgggattgttgtttttaagccaattgctcacagtcgataaaacaaaaggattaaacttttgacagactttccctattctcaccaactggctaatgctagtgctgctttgctcaggcctccttaagcatgtttacttgcaattccttccaaatgtcacttactagaaactgcattcctgattctggaggtaataatcctggagacacagctttcatcagctaatgggtagtgactcagagtatatccagagacaaacaaattaaagagcatggaagattggagcaaacagctaaagaactttgttgtgatatatttagaaagcaggcattctgttccccaataacattgtgctaatattggtgctttccatttactggatttgattgccagcaaaacctaaacagaaatgttttacatccataaactactcccaaatcattggtctgaaaaaatgccattctgtaatatgcctactgctaacacttccattagttgctcaagagaaatgcaagaatagcttagaggagtcttagccaaaaatatataattctgacatatggagaaaaccaatgcaataatttacaaaagattaactgttaaagtgctgctaaaggttggggggattactttaatcaaatgcctgcattctaatatggtgagggttattttattttgagacagggtcttgttttgtcacccatgctagagtgcagtgacatgaccatggctcactgcagcctcaaccttctgggctcaaatgatcctctacctcatcctctggagtagctgggactacatgcatgaactaccacacctggctaattttttaattaaaaattttttttttgtagagatgaggtttcactatgttactcaagctggtctcaaactcttgggctcaagtgatcctctagccttggcctcccaaagtgctgggattataggtgtgagccaccgtgcccagctggtgaaggttgaaaacaattttacaaaccacatttaagtgaggaagaaaaacatgtagaaagatccctgtgttctttagatgacatttgaaaaatgcacacatgcttttaaaagccatttgttgcacttactcttcaggaggtatgcttaaatgtctgttcagaaaacatcttaaatttgggatacattgttctgtcttttaagattgctttagactgctacttactttaaaagaattgtgagattactctaggtgtatgtttataaaaaattcaaagttcagaaaattcctgtaagccccttaagagcattttaattgtagcatttttcctatgatcctttaagaaaatccgctacgggttttcagattatgtttccaccccagttgagagtaaccacaatgacaactatgtactgcaatttgcagcagaaatgactacacatttctgcccttagctgaaagaaaaacaaccatatggaccttgttcttagccagcgctccattagctaattaaatttacaaagcccaaccagtaagagaacatggattagccccattctaatgactctatccctttggcggagctaatgttgtcttgtttcagagcagactagagaaacttgacttactttgaataggtcagacaggttagtccaacagaaatacaatgcaagtcacatatatatgcaaaaagataaaggtgaaaatttaataataacttttatttactcaatatatccaacatatcataatcttaacatataattaatataaattttaagatttttatattctttttttcatactaaatctttgaaatctggtatttatggttactgcacttcttaatgtgggttagccacatgtcagtgatttaatagctacgtatgactagtggctaccatattgaatggtacaggattgagtggtgagatgtgccattccatcttctttccattgttcacactcataatctatttcaggagtacagtgcttcacttttcatacgtgcatatcagctgggcatatagtcattttaaattctgaattaacctgaagatgaaagaacagtggccaacttatttccttttaagaaaaactgtctctagttaaaaatacaacatgcataagtatgtgaggtaatgtataattattaatagctcaatttagcctttccataaggtatacctatttgaaaacatgttgtacatcataaatatatagttttcatcaatttaaaaataaataaaaacatcgtttataagtctaaaaagtgctaggggcaaaataaggccctctctctagcctattgacccattttgaagtaaatgattacagctgtggaatgcttcaaggaacttaaggtatgatgtgacagcttgagtttgaaagtcttctctcgttcttttttatgactgcatagtattccatggtgtatatgtaccacattttctttatccagtctatcactgactttgcagggacatggatggagctggaggccattatccatagcggactaacaaaggaacagaaaaccaaacaccgcaggttctcacttacaagagggagctaattgatgagaacacatggacacacagaggggaacaacacacactggggcctttcaaatggtggaaggtgggaggagagagaggatgaggaaaaataactaatgggtactaggcttaataactggatgatgagataatctgtacaataaatctccatgacacaagtttacctatgtagcaaacctgcgcttgtacatctgaacttagaagttgaaaaaatatcttgaaaaaaaaaaaaaaaagaaaaagtcttctcctaaatttaggcaacattctatttcagttgagctgtgtataactggcccatgggtgcagggatcacgttttcctacctagaaagggaaacatgatcttacaaaggaattatttgtccttgtatgatttggtgacacaaaaattctcattggggcatgaaaataaaatatatttaatgaaaagatttgattggaaaaagtaaagttacagaaaactaggttgttttcagagaattcaacaaacttagggtgaataaacactaaagttctacttcacaattataattgaatcaacaaatggatagaagctatgaagaaccaattaggttgtgtccttacctaatttctggaatgctagtgtgaataagcctgtgccatgacaaatatcagaactgtggacaattattgaattttagtcttaaaatcagggtactttcctcaacttctagaatcaaaagatgtcacttcatcatcttggaacatttattttaatctgtcctgaatgtaattatttgatcaagctattgtcacaaaatcctattaactcaaagagtgattgcattattcactccttactcatttcttgatttcagtgcttattaaatgaaagttttcaggcagccaaaatgaaggataaccttaaggattcttccttctttttaattttaggaattgtatactgtagtttatcataacaacatatctaggctgcagaaattcagggaaggcctgaaggttttaataaaaattaaaaacaagacccatcaaatgatccaaacacttcctttgcttatcttaaaacacaagaatcagaaccagcagaatgagctttaggcctgggaacaaaatgtcagagataaaattggtatactattttcacccctacgatctacatggttgagggggtttgaaggaagtgaagaatcagatatgtttctgaaccaggactcaaaaacaagttttataattgcaatatcttcttaagagctcggcgaaaatggttttcattttcttcttagattcttttaagaggtgccacattgtaaatgatcataatggcacaaaatgtgaattcatgtggaaaaaacaggcattaatgattctgaatacagaaaagctggattctgaagggaagaagtcttaactaatttacttcaaagtattttccttatgatgtatgaaaaagaatgataagataaaaatctatttaattaagaccaaaaacatctctgtaggtttaaaataaaatttgtacgtggtaagaaagcattgtgtcatggttacttatgggcattttttcttggttagtgatacataaaataatggtatatacaatcaatgctgtcttaggttcaattaaagatgatgtgactcctacatctactttatttcctagggcctttttttccaagtgatatgttccatccactgggagcaattttcagctggccagacaccttcccattatccccgaagcagtgtgattttatccttttacatgaacaatgcccttagggagaatgacaaagatactggctttctgaatggcaatatattggatggtcttatctataactttctcatttttcctatacaaatgttgggttctatttcttgaataagttctacagaactcatgattacagtttcataaaaaaaaagtgatccaaggtataataaaatatttttttaaccttgggttttcaatataactactcgaaatgactttaaatgctacacaaaatatatttttatattaaacaaatccacattaagaagatgaaaataatataaaatgattgcttaaaaaatatgggcataatgtccccatattacagattctggctccaagtttctaagtcatataatgggaatcatgtcttctggaatatttggtttaacggtgtgtagtgccagggctagaaaatgtgttaagttggtgaaacaactaccctttccctttttttagtatttctagagtgttaccctttggggctcccaccagtttggaacctgttttacttagagtgttttctaaaataaggcaccaaaatatgtgctagggctgcacatattcaaagtatgctgcagctctgggaagttgggcagattgaagtaaccttagggtccgtgaaccagacctccttcacagccacagcactgcaagagcttcctctcttcttgtaaaccaagctatcaaagataactgttacatacatgtatattcacctctgacacctacagccaaggaatgagatgagaacatgaaggaagaagttaggcgcaggaaaaataaagggtgttagtagtgtccagcttgtagaaagaactcaaattatgcctcagtccagtgagcactgaagaaaattcctcaagtttctctctgggcctcttgctttctagttccagctctctttccatagtcaaggttccaaaggcccacctcctctcctcatcaaatgctttttgcaaaaacagatctaaaatctcagatatacacatgacagataactgcttgaatttctcttaggaatcactaggtacttctaaatcactggagagtcaatctgaagtcagatgcatactccctgaatattagtctttcaggtatcactgggcaggaaggggagggaatggagagagattctgggccatgtgtgtaagagggagggcagcttgtctgagaatccaacaggaactcccttttttctaggcatcgtccagagattttggttacaatacttggaggtaaaattatatagagggtaatggttttctctttggcacatcaatcaactctgctctatgatcctataaacaggaaagagttgccaaatttgggcaccagaggaatccttggggctctcagcagtctcctcttcttaccacaatgcaaagcaaacaagagttgaaatgagaaaccagagggcaattagtgtcctttttttccttctcctctcatgtatccatttaggctttaatgcactttaaagaattcagaacactgagcaccaataaatgcttacttttcaagggaaaagaatccaagaatgtcaaatttggaggcctttgagatggtttagtccagatgtcagacatcattcatttagtaattatttacaaattcagtaattatttacaaataccaattatatgccagacactgttctgagaactagctacagatcagtgaaacaaaagaagaaaaaaaaaatccttgtcctgtccttgagatgagacaggtgcatgtaatatataataattaaagtatttagtatgctagatgtgctatggaaagagtacaggaaagctagggagatgaggagtaatgaggtgagagatggcagttgaaatctgaaataggatcatcaaggtaggcctttctgagaatgtgacatttgagaaaagagtgtgaggaaatgagcaagttagccatctggattatttgaaggggaggcaggggcaaagacagtccagacagtacacatatgtgctaagacaggagcgcctcacctgtgtaaggtttaaggacatttctatggctggagaaaaatgatcctggaggaaaggtgagagttaagagtagagtgaggggaagtggttggtggggccagatcacatgggccatgtagactcttgaaaggacttctgagggaaatagggagccactggaggattttgagcagagaagggatataacttgacttatactttacaggatcactctagctactctgtggagaacagattgtagagataagggtgctaccagggaggctactgtggttcccggcaaaggatgatggtgcctcaggacaggatagtaacacttaggaagacagagtatagagtgatagacgctggcccatgggtagatgtggtcatgggagtctgcggagagtctcttctgattgcttctattttctcagggagacaggaagcaaagcaagatcatcagctgacagtaagacacaggaggggaggcactggacatctgaatggggagaagaaggcttgactgaagtagctaagacagtggcagaggaaatggactagggaaatacagattgacttatgacatcatcaagtgcctactacttaatattgcctctgtatccacagctctcaaatctccaggcagcctctattgattgatctgagttggcagatgagttggcaggtgagagaatgtatatttgctagttctaatctaatctaattctgctttagtaaactgaggcctagacagtgccttttaaacatctatctatctttggggagggtttaaattatgaattaccaatcagctatggctccagtaaggaaaacatatacagtacctatttaaatatcatgtagcaagagggcctgacaactaatgctcttgggaattgatgctataagagaagggtatgaagagctgcagatgagtgcctgaaacaagagctttattaacacagcaggaagaagatacctgctggctggattttcactgaactcatagctctttgcatttgggctcaaggtcttaatcttctacaagtagtgacttcagtttctaaaggtttcaaggggatcatccagtgcttgtcttttgaatagactggcatgacttttaaacaggacccaaccaaatcacatttgatttcaagaaattgaagggataattaagaaagtgttagtcactactgaatgtagtgtatatgctttcttcggaattttaaggggggagaaaggcccattaagtcatcttaaaagggctcttgctgtaaaatgaaaggtggagaaggggtaaatctgaaatgcaaatgaatttcctgtttcaccagaaattcagtattatctaatgaatgctgagtaattgaagcacttattgtcatttctgcacccacactgggaaatggtttctgacctttagattccctactcttctgaattgcttctcatcagctctctctttattctcactcccactcagtttacttcttggaaggcctgttgacctttacctttttgtcatgtacagaatacagaatggttatgtatataaggtatcattaacatcataaggctacatgcaattataaaagaagatgagggataacttacacaggacatagtccttgctagattttatcaagaccctcattttctagtggtatatcacctttggaaaagccaggccattctgaagtaggtctttgtctttccagtctagaaataattgttatgtcaagttcagtgataaaatgaatggctgccattggctgaggacccactgtggggcatggagctagtgggcatctctccagtcatctcacaacaaccttgctcatctcttccttttaattattttactgtgcatactcatgagatctgaaactcatgtacgttggcacctttaacataactacactagttcttcctataaagttttctaatgatagtggaacttttaaattcagtttagtttttgacattttatttgtctttttgagaagccagtaggacttcaaaatgttgggcttttccaatagacagctaaaaatgtagacctgaagtttacaaaaatgattagagctaaaggtatagatgggaaagtcatcaatgctgaagtgatagtcattatgtggaaatttagcaaaggaaagatacttggaggcatgctaagtggttgaaaaaggcatcttggaagattttcatgtttaggtggtgggaagagaaacacaagccagaaaagaatccctcagggacaatgagaaaagcagagcagcagaccctgtgaagttatggaagtgaaatgaatggatcctgaaggtatttcaaatggtttggactatcagggccaaaaaagaacttctggaaatctggacttggacaaaatcagtcatccttaaggggctggattcagcaaagaggtagatgaaaaacccaggttctagggtcctcttttatttcatgggagtgatacagaatccggatcactttagaaataaagcaaaataatttttctgaagatgtgaacagtgaagtgatgtgtctgtcacacactaaaaacataaaagatgatgcatgaataaaatagggaacagcatcactagttaatgcccacataatatcataattctatacctaatccaaatttgatgaacaaaatatatttagagcataaataaaacattttcaattgttcataatatattctccaatgcactgtatttgtcttggtttgaaaaatccataaagattttatgtaatttaaataagcaatgaagagaggaagaggaggaaaaggatttcaatatggcccagagagagagacagagaaagagacataaatcccagttaatctaagggaagacttttaagtcatagttcctcattctggcgacttatctgttacttatttccaggtgctaaacagaagagatgcaatatcttttttttttttttttttcctgagacaagtctcgctttgtcgacaggctggaatgcagtggtgcgatcttggctcactgcaacctctgcctcccgggttcaagcgattctcctgcctcagcctcccatgtagctgggactacaggtgtatgccaccatacccagctaatttttgtatttttagtagagacggggcttcgccatgttggccaggatggtctgtatctcctgaccttgcaacgtgtctgtgtggtcctcccaaactcctgggattacagatgtgagccaccatgcctggccgagatgcaatatcttgaaggcatcagggatcctgttgtttctcttcagatctataaatctgctgccttctgaaggcattaggagcacctcaaagaaagcaagatggagcattaacaagtgaagactcttcttcttttcttttctttcttcttgcttgctcttttctctttctgcatcaacaatttcaaattcttgggcagagtattgcttgaactcagagttcctgtttgtgcaacagtgctgccttctgctatcagccacatgtagacttagttgaggagtcctatgtgtagattcataaatttagggcaacaaagcatgtgtgtgtaggggggttgggcaagagagctaaggctaagtcagggccagaagttgcctgtaagtagctctgtaaagcacccatgtctgatttgtggaggtgacatcatcattagctgcagatcaatactgaccagaatttaaggtactatgccatagctttaagtcttcataatttaaagatgactaagttgtctcttctctgtaggtctctactttgagttagatgacttcagaaatgatcacacatttcatgtcaaatttccaggcctcaaattcctgttcccagtgatatgagtacccacagataattcactggtaagatcaccgagtgacccaggaatgaaacctaccattgaagatgtttatttagagctgtatccactgtccacagccaagggaaatagccttttctagactggatatatttgaccagtagatggagtaagtggatcccagaaccaccaactaaccacccagaacctgctgatcaatgctgttgtctttcaatattctatcaaaaagggacaatgccatcaccagcaactaaatcttgagcttaaggtgcatcttcggcaggtgaatgtcatgtgtgacagttgctcatggatgaatgaataaccgaaaggggcaccagcagtagcaaagtactaagatactgaggaaacttggggtacttaaccaaagtcccttcatttcttcacaattatgcttaacaccaaccagcccagcatctgacaaacaatcccaaggacattttttcccccgtcatctcaaatattttttcaaaagtgatcattttactctgtgttttggtagaaggggcgaagtccactttgcagctggtacaacagaaactagagctgcatcaattctctcacactgccaagcctttcttctggcagaagcgctggggatattacactggggataattcatcaagcttgctttgggtgttccaaatttgcaagctgtggctaatttccagagacttcagggcaataatctctgctttcctaaaagaaaaacagtaaccacaccacctttcaattaaatgggtcatggaaaatgaatagccacagatgatcacagatattcagaaatcctcagaaaacctaagtgtgtagccagtggtagaaatgatgactgtgtggctgaagaagtcccatttgatgagggctaggaatctggcatctgcgtctgcctccacatttgtttctccccatacattttccatgtatgaatatgcacacacatgcacatgtgaagcctcacatgttcaagaccaaaacatattgctggatattaacaaaaggaattatagcctcttcagctatgaatcaggtgaagttttcctcacagtctctggagtctgctttgcccacagaaaagcagacttccttcccaggtcagtaagccatgctggagagttgccctcaaccccgcaactctccccaaatatatctgctgtcttttatgctttccaggccccgtgttcagaagttgtttagcagatcatttctttgtacactatctttttttttttttttcctcttttctgagatggagtcttacactgtctcctgggctggagtgcaatggcgcaatcttggctcactgcaacctccgcctcctaggttcaagtattctcctgcctccgcctcccgagtagctgggattacaggtgcccaacaccacacctggctaattttttttttttgtatttttagtagacacggggtttcgccaggctggtctcgaactcctgacttcctgatccgcctgccttggcctcccaaagtgctgggattacaggcgtgagccactgcatccggcctgtttgtttgtatattatcttaactcatataatggatcagtatttttttgagaatttccaggccaacattcagaagaataacatatggtaggcattttaagcaattaatggataaaggaagggatatttgagggctgtctcatcccaaactaccttagttttttactctggattttcctttctatggatatgtcaatgattttaccggatcaattctcatggagcagtggactagtttgggatggtccctactttcaatttcaggaacactgtaaagtcaaacagaaccttatgagttttatatttgctagttctttttgtgctatgtatttattatatgtgtaatttaatagtttcaattcttttctctgctaaagtatttatgagttgtagcacagagaaagagctcaatatatgctaattattattattaatattattatctttagagataggatcttactctgtctcaggctggggtgaagtggtgtgttcatggctcactgcaaccttgaactcctggactcaagctatcttcctgcttcagctttcctagtagccgggtctaaaggtacacactgctatgcccaactaattttttaaaaaatgttatgtagaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcacggtggcgggcgcctgtagtcccagctactcgggaggctgaggcaggagaatggcgtgaacccgggaagcggagcttgcagtgagccgagattgtgccactgcagtccgcagtccggcctgggcgacaaagcgagactccgtctcaaaaaaaaaaaaaaaaaaaaaaaaaaaagttatgtaaagacaaggtcttgctttgttgcccaggctggtcttgaactcctggcttcaagcaatcctcctgtatcaatgtagtgttggcattacaggtctgagccactgtgcttggcctatgttagctactattattattattaccttataattgctaaagccatctacctgaaaatctattccaatcattccatagttctcagctccaaaaccagtggagatttgttttttcataatcctaccaaactcctctgcactggtgtcatatctgacaaaatacccagaattaattgccaatgggtgatcatgggttgacatataagccttcccagtgtatgcttttttttttttacaattttttaaaaattttactttaaactctgggatacatgtgcagaacgtgcaagtttgttacataggtatacgtgtgccatggtggtttgctgcacctgttgacccatcctctaagtttcctcccctcaacacccacccaccgacaggccctggtgtgtggtgttccccctccctgtgtccatgtgttctcaatgttcaactcccccttatgagtgagaacatgtggtgtttggttttctgttcctgagttagtttgctgaagatgatggcttccagcttcatccatgtccttgcaaaggacatgatctcattcttttcatggttgcagagtattccatggtgtatatgtaccacattttctttatctagtctatcattgatgggcatttgtattggctccatgactgctattggaaatagtacttcaataaacatacatgtgcatgtgtctttatagtagaatgatttatattcctttgagtgtataccctgtaatgggattgcttgatcaaatggtatttctgattctagatccttgaggaatcgccacactgtcttccacaatggctgaactaatttaaattcccatcaacagtgtaaatgcattcctatttctccattgtgtcgccagtctctattgtttcttgactttttaataattgccactctgaatggcatgagatggaatctcactgtggttttgatttgcatttctctaatgaccagtgatgttgggcttcttttcatatttttgttggctgcatgaatgtcttctttaggaagtgtctgttcagatccttcgcccactttttgatggggttatttttttcttgtaaatttgtttacaatctttgtagattctggatattagatctttgtcagatggatggatcgcaaaaattttctcccattctgtaggttgcctgttcactctgaggatagtttcttttgctatgccgaagctttttagtttaattggatcccatttctcaattttgacttttgttgccattgcttttggtgttttcgtcatgaagtctttgcccatgcctagatattgcctaggttttcttttagggtttttatggtttggggttttacattaaagtcttgaatccatcttgagttgatttttgtataaggtgtaaggaagtggtccagtttcagttttctgcatatggctaaccagtttttctaccaccatttattgaataggatatcatttccccattgcttgtttctgtcaggtttgtcaaagatctgatggttgtagatgtgtggtgttatttctgaggtctctgttttgttccattggtttatatatctgttttggtaccagtaccatgctgttttgattactgtaggcttgtagtataatttgaagtcaggtgcatgttatttcttgacctgaatctttcctttgggcttcagtttttattaggcttttcctttgtcctgtatagtttcttggatgcttctcttctctacactcaaggttttctttctgttgttgttgtgtaggcaacacaatagatgtcatcttttgggaggcttcctaatgctgcttttggtgttcttgtgagctcagaggattcctactttagagtgaactgtaatgtcaacctctaccctagacaatgagtaggaaccatattcaatagaataagaaggtgaggctttgctaaaattatcccatctgtcagtctgtgaaaccagtagtttgaagattgtaatcacaacattgacacacataatgttaatttcaagcagttacataacttaattgataagtcaatctaaatcatacctgcatggcaacagaactagggttagaaagtgaaaaatattgttaagtaaccatatacttctcttagatttgatctggcagcagacatttctgtattctgagataaaatagctgtggtaaacagattgtgtgaaggcatgcatttgcatccaggcctacaggaccaatattaagagaaagggaacaattaatttgtctcagtggggtagtaaagagacacagccttcagagtactatgggaggttatatttcaacttcttacagttagtttgtaaatctaactgtaagactggcattgttattaatgaaagtttcagctaagaatgaattagatctaagttacactttatcagtatttattcttcctgctacctattaagggcacctgaactgctaggcttacataaaaatgtcccatttcctgttgctagctgtgctttcctttgataaactcattacaaattgcatgtaattactgtattgtgaagaagggagtggcaataaattaggcacagaatttttgaataaaactaggcagctagaaagactgtttctaaataacaaaaaatttgatatgaccaagtaggttaaaattaccattacatatttgattggtacaaaattaattgtggtttttacaattactttttaacattttgccgctacttttactattttgccattacttttaatatggcccatttttaatggcaaaatctgcaattaattttgcaccaacctaatattatcgtatatggaattttctgtatataaagcaaagggaaaaaaaaggaggcatatagaccttagcttatgtactttatgattataaatgattacatttatctagtgaccataatgctttatgaaagatgaaaacattcttctgggggaaaaaaaaaaaactaattaacatccttgcttgcagagattggtagacctgtttcttctattttagatttcagcaggacacctctatcgttggatgaaaaatgctgacttgcatgttctgggaatctgggctcaccccgaggctaatagcacagtgccctggctgtgtgcccaacgtttgtggcagggagttacccctgagtgctttttttaacttacactaaagttttgacttagaaagcaatattagctagtgcttcacaggaaactgggctttccctctgtaacactcaaagtcaaatcctatttcttggtctgatataatctccataatcataaagatctttgttggagaagttaagcagggaagactacatgtaggattctcctaatcttggggaacccaagttttgtgcccctttcaattgggatgctggagcggagttgggtcatggagattaatctttagaggtgtgtgttcatagaggagaaaccattgagaacaaggaaaaaggaaaagtggagaagcacagctcttgtttgaccttggaggctttttacatggaattaaaattcagaaactggctgaggttacaaggagtaattgtggcaattgcctcatccctactgtcagcacatggcaaagtttgctatggacagaattgcagggagttctttcaaaacagttcaaaatattgtcaagattttcttcaatttctcatcaacctttaagagctcattgaagacattagatattttgtgcccaactcaatgttgcagagaatttcagggcaagagaaatagaaatgaagttgaaatatacccatgtagtttccttcagcgatactatctggtatataagaaaacttacaaacattttttaagaggcctcaggcattacaattataagtttttttcttctcttcagacttttattctaataagttgttagccaatcaaacaagcaaaggtgttttaaaatacttcagtttatagcaataatgatttttaagtttgagaaatagaaaagaatcaaatcagtatcttaattagcaaaacctagttgatgagagagatgtgctttgtttgctatgcatgagattgcttgaaaaatgtgatttagctccaacagagcctccctactataggattttttttttttttttttttttttttttagaaaatcaatacatctttctgtcaaaatttggttagggcaaaatttgactaaaattgtgccaaataaataagatttttttcttatctgagattgatacatctctatttcttatgtataattttttatctcaggccaatgagcccaaagtttcttggctcttgttatatctttgaacctgtgacctttcaactggctagcaatgggcatgaaaaggagaataattgttgctgaaacaaaataggcttttttttttttttgaggaaaaagaagaaagagaaagagacaaaggaaaaggagaaagacaagagaggaagaagcaggaggaaaacagtggagagaagaagaaaaaagagaaaaaataaattacagctatctgggcttccatgggagtgccaactctgacagctgagacatctctgacttggctctttcacctcttgtgcaagggaagaacagcactatttttaaaggaggtcattagtgagtcatgtttaagctcaatgcttagccatcatcgccatttgggtgcttgttgggaaggtcctaaattgagcggcctttgggcacagatctctgtgcactttgtttgccacttgctggctagctgatctggagactagttgaattttgcagtttttctgttttattttcctgacaaagcagtcgttccattaagaaaaaagcactcagctattaatttctgctaactcctaacctggtcaatgaattataagaatgtgcagttttatgtctattttagggcatggatgtgggggtggtgaaaagtcttcttggcttggagctctctctatttgtctcgctctttctagttcttttttgttcatccttttcctgacaggctgcttgatgcttacagaatgatgcaagattgtaacagattcagactagatgaggaagagaaagagcttagtaaaagcccacttcttaatagttgaatttttttttcttcaaaaaaaaagtcctatcaaccaaaaaaaagctcaggaccagacagattcatagccaaattctgccagaggtacaaagaggagctggtaccatcacttctgaaactcttccaaacaacagaaaaagagggacttctccctaactcattttatgaggccagcatcatcctgataccaaaacctggcagagacacaacaacaacaaaaaagaaaatttcaggccaatatccctgatgaacatcgatgtgaaaatcctcaataaaatactggcaacctgaatccagcagcacatcaaaaaccttatccaccatgatcaagtgagcttcatccctgggatgcaagggtggttcaacatatgcaaatcaataaacataatacaacacataaacagaaccaatggcaaaaaccacatgattatctcaatagatgcagaaaaggccttcagtaaaattcaacaccccttcatgctaaaacctctcaataaactaggtattgatagaacgtatttcaaaataataagagctatctatgacaaacccacagccactatcatactgaatgggcaaaacctggaagcattccctttgaaaactggcacaagacaaggatgccctctctcaccactcctattcaacatagtattggaagttctggccagggcagtcaggcaagagaaagaaataaagggtatttgaataggaagagaggaagtcaatttgtctctgtttgcagatgacatgattgtatatttagaaaaccccaacgtttcatctccttaagctgataagcaacttcagcaaagtctctggatacaaaatcaatgtgcaaaaatcacaagtcttcctatacagcaataatagacaatcagagagccaaatcatgagtgaactcccattcacaattgctacaaagagaataaaatacctagaaatacagcttacaagggatgtgaaggacctcttcaaggagaactccactgctcaaggaaataagagaggacacaaacaaatggaaaagcattccatgctcatggataggaagaatcaatatcatttaaatggccatactgcccaaagtaatttatagattcaatgctatccccatcaagctaccattgactttcatcacagaattagaaaaagctactgtaaatttcatatggaactaaaaaagagcctgtgtagccaagacaatcctaagcagaaagaacaaagctggaggcatcacactacctgatttcaaactatagtacaaggctacagtaacaaaaacagcatggtactggtaccaaattagatatatatatatataccagtggaacagaacagaggcctcagaaataataccacatatctacaaccatctgatctttgacaaacctgaccaaaacaagcaatggggaaacgactccctacttaataaatggtgttgggaaaactggctagccatacgcagaaaactgaaactggaccacttccttataccttatacaaaaattaactcaagatggattaaagacttcagcataagacctaaaaccataaaaaccctagaagaaaacctaggcaataccattcaggacataggcatgggcaaagacttcatgactaaaacactaaaagcaatggcaacaaaagccaaaattgacaaatgggatctgattaaactgaaaagcttctgcacagcaaaagaaactatcagagtgaacaggcaacctagagaatgggaaaaataactgcaatctatccatctgacaaagggctaatatccagaatctacaaagaactttaacaaatttacaagaaaaaaacagccccatcaaaaagtgggcaaaggatatgaacagacacctcttaaagaaaacatttatgtggccaataaacatatgaaaaaaagctcatcatcacttgtcattagagaaatgcaaatcaaagccacaatgagataccatctcatgccagttagaatggtgatcattaaaaagtcagggaacaacagatgctagagaggatgtgaagaaataggaacccttttacacttttgttgggagtataaattagttcaaccattgtggaaaaaagtgtggcgattcctcaaggatctagaactagaaatgtcatttgacctagcaatcccattactggttatatatccaaaggattataaatcatgctactagaaagacacatgtacatgtatgtttattgcagcagtattcacaacagcagagttggaacgaacccaaatgcccatcaatgatagactggataaagaaaatgtggcacatatacaccatggaatactatgcagccataaaaaaggatgagttcatgttctttgcagggacatggatgaagttggaaaccaccattctcagcaaactaacacaggaacagaaaaccaaacaccacatgttctcactcataagtgggagttgaacaatgagaacacatggacacagggaggggaacatcacacaccagggcctgtcagggggtggggagctaaaggagggatagcagtaggaggcatacctaatgcagatgacgggttgatgggtacagcaaaccgtcatggcacgtgtattcctatgtaatgaacttgcactttctgcacatgtatcccagaacttaaagtatatattaaaaaaaagtctgagtgtcttaagtattagtcattgctatttggatggtttcttttccagggaaaatattaaaactgtcttgtacctctctattccttttctttctccctaggttttggaaatcactagtgggtaaaaaagaccaatttgcaactaggctctcatgctctgttgaaaactatgtcacaatatcacaatactagatgctgggctcaagacagcaaacagaaagcagtaagttacacatataaatgacaaatatctgattcacttcaattaagtaactatttttttttaatcacaagaactgctttttcccgaatctgttggattgtcagtgtattagaagtgagcatgttctaatttataataggagaagttggagaggatgagcaagaggtttgccccatttctgtaaccatcagagacaaagcaggaggagcctccaaaaattagagcagaccttgccctaaaatgacataagtagctatttaagtgatgtgggcccagcatggtatagccataaatacatccaccacaactgtattaaaaggcctggaatgttcgcttcgtagggactcatacatgatgttgctcggcagtgaaatgatagctaattgtctagtgcggtggattactgtagccaatcacttagcaccatactcttttaattgaatagcaaacgtataggcttgggatgagatgaggctgtctagtatgggttggcatcctggggaggtctgaaaagacagaggcccgattaaaaggcttcaggaggcagagtcagagaggccaacagtgtactttgtctctcataagatttgcttggaatctgctcaacgctaaaagcccctatttagaactggaggttcccaagagatacatttccatcattttgtgagaaaagaggcagaatacgagggagataacacagacgtcatagctggagaataagaatgatttaatgtgttcttggcactgtgctaagtggcttgaggttcacacacctcatctgatccatggttaccatggctgtgcagctccatcatccacggaaatgaaaaaaatacataattgcctacctgtttcaacccatcacccactagacaaactgattgcttaggctttgagttagagctaggcaagtgatatttttaaagctgcacaagtgattctgaattattatcaggcataaaatttgcttattttttacaactcctcaaacaggaatattgcctcatcttctgcagaagatgagttgcaatctatccatctgacaaaggtctaatatccagaatctacaaacaacttaaacaaatttacaaggaaaaaacaaccccatcaaaaagtgagtgaaggatatgaacagaaacttattaccaggcttgagatgtgcttaatttttacaactcctgaagtaggaatactgactcatcttctgcagaaggcgagagtaaagttcatgtttgactgatggagagctagaacctgggcctatcatttctggtttcttggtttttccatttaagacaacagcttccctgaaggtttgaagtcttaggttttgagtaggtaactataggacttccaactgtatcccactttatcctctgagtgattggtccaaaagaaaacaaggaatctacttactgtcagcaggatatacagaaaacagcataggaattcacataccagtggctttaattatggctagttgtgtgactgtgggcatacgaccttgctaagctttcatttccctatttgtatagtggaaatgataaaatgataaacagtatctcaaatttaatttgaatattcaataaggaagtatacataaggtatttaaaatagtatttggcacacagtgggtacccatctatgtgctagttcttgttaccatattaatggctactaatagttttctcttggctagacaatggcatttgtcctattctcttctttttttctttaaacaaaagaatgtggtgactggagagaaggcactagaggtgggacggagttaaagactataatgaatcttgcagaatctctcttgcacccagtaaaaggtgcctaatttctgtgtaaagggctcacgatggaaatcaggttaaaacaaggaacttaatcttaaagccgcgcttgcctatgtctgttaaatcctttattttttcttagacagtgttccagtgggagttggggtggctgatggagacagatggggaggtgaaagcccctcccaaagttgccttttggtgacaccacaacttaagcatcacactttaccttggcctcacttggataaacagattcctctggtgtaattttgtgagctgccagacacagacaagtatgtttatcacttgaatggcaagcttcagcgttagagttgctctatttatacactgctttgcagacaatcctgatgcttttacataattggtgagctccactagcttagcaggcaagtaaataagatggtaaacaatactcttttttctgcacaggcttgtgatgaattctcaagccagctttgcttgcaattagtctggataacttacatattttacattacatgagatgacagttggttttattgcttttcccctaaaagtcgggccttgctgtgacagctacttcacaagcacaggggagcctgctgggcaatgggaagggcaaaggatggcaaattggtctggttccattattgcaatgtaattactcaaacttagccttgctggatttgtgcaacttctctgtaattacataatgatccaaggctcaagagaggctggaggtttggatgcattgcatggcatgtatattcattgtgctgcaaacttccatgacttctagggtaggcattgtggtccgtaagaaattataatgaaggcttggaaatgtatagactgcatgcaggaatcatgcatctgccaaggcacagggaaagtctagaatgccaaggcacttgagaataatctggtttctgtacacagatcttgcctctaaatccttgctctacaaaggagtcaactacagtcactcaggattctggaaagggtctagattcttccaccttgcttccctccactctagaggcagaagagaagagccaacagtgtaggtattaagacagacttacattttgtttccttcagagatgaagtggaagcatctttgactaatgtgtacacacttgaatgtccataagagaagcaaatgcaggcatccaactgctaatgaatgatctaaaagattacttggtagcttttagtataatcctgaaattagttaatggaagtgccactaatgagcatctattaatagaaggcaagtgtagtaacactgctaatgtaatggcctggagctataataaaacatgtgaacaaaacacatctaatactgttctatgttaaaatagctctcttgaaaaacacagagctagaaaatgatcacaactaagagacattttaacaacagggacattacttgatgggactcaccatcaagttttaaatggggtagtggacagtaatacttccagaccctctttccccaggggattttcttgattattctggctgggtatcaaaagttctgatcttttcttagaactctttatataacaaggaactaatatttaaaattcaacatttaagtttgtacttctttatggttctttgttttgtgagttaatatagtctccacagcaaaattatttccaacctgaaaacaggggacctatctatctgtaatagaatatcttccctactgtttttctttctcaccactccagcttgagattgaatgagtaccacactctgtgatctcacagagtgttctgttttcctttctttataccctagtcatagcatatgcaaataaccacatcctttgcagggacacgggatagctggaggccattatccttagcaaactgacacaggaaccgaaaaccaaatacgacgtgttctgacttacaagtgggagctaaatgatgagaacacatgaacacagagggaaacaacacatactggggtcttttggagggtgggaagagggagagcatcaggaaaaaaattgatactaggcttaatacctaggtgatgaaataatctgtacaacaaacccccatgacacaagtttatctatgtaacaaacctgcatttgtacccctaaacttaaaagtttaataataataataataaatctccttgatgaggttctttggaattaggggttctgcctttttgtctctagtcatatgcccaggactaaggcactgaacaatgacagcacggtgctatatatgaccaacaagttagttgtgttgtttagattcagtttgttcctgtatcttaggagaaactcagagaataatgagctactccctgtcttcaaagggcttcaagtctagaaatggttattacccatgttttacatacgtaaaattcagatcatgctgatgaatgaatacccacaagtggaaatgtaatgagaatattcataacgtgggcttaaatttacttttctcttttctaatgcaattatttatttaattaaaaaaccatttgtcttgaggactgcctttcatcagtgcaagtgttgacaaattcctgttcactgctatggaatacagaatgatgaaagtcagtcatcccatatattttcattgcagtgtaaaggttacccaagctttgacatcatatacataatatttttccctgcctgcagcagacattagctgtaagtatgcctatgcaaagatcacatacacaccacaagaatcaaatatgcttatgtaagaattcttatacttaaagcagtatagatagatttagtcttcatgtttatggctacatgatgtggaaaaggctgcggaaatgctgctgtctacattggcatgacattggaattaaagccaactggaggcagctgcagctgtctacgaaacaaatctggggaattcaacagtagaagccaacggctgcagccaaaatcccacagtggaaaaagccctgctgtgggacctggcattggcagtcatgtgttggcatcactgaacttcatttaatgaaagacccccaggtcttcactgtgggccaactccattactgccatattctagtcctcattaaaggtttgggtggcagggagcttttctatgcagatatctgctgccatctatgttgaacgcagaaatggtaggcgagcctcaaagcagtttaaaatccacctgttttgatgcataaatagtcaagtaactagacttgatcaccaatccaaggtgaggtgtcaggggtggaggagggtggaaaaaagctatacctattgttagagaaatttgcagaatgttttgattatatggaagttattcactttacagttccttttgcaaattacatattttactaaattgtctccttttattaaccataagaaaggaaaagcaagcataatcttttcatatactcaagccatcattatggttaatttcataatggtttacatgcagtgccaaaatgttcacatgctagcaaattatttttattttatacataatctaataaccataaccataaagctgaaatgatttctagctttcattttgaccatgtccctaaaagctgtttacctggctgctgatcacatgtaaactgaattggttccttaacaaagggatgaaaattgagtggaagaggtatcaattagagaaactgaatggctcatgaccctactaagttgcaagaatactattttcacaattgtaatgataaaaaataaaaaaatgaaaatgccactgttcaacagaaatatattttcctataaataaatatatttgtaattacagataccaatcacaacttgggcattaattaaacagagaaaacacttaaaaaaaatctgttgttagagaatctccttaatttttttcaaagctgaatagaacttgtccttgcattaaactctcttctgtgttatctgtgcagctgcaaaactttattcattcagtcagtcaaaagttgatattgtttgcaagactctccaatggcaaatctcctaaataagtccttacagctcttcatattttcacaacaccacatcagtgtcattaatgtgcatcatctccacgttccatcctttcctggaaaggttcattatgatcctccaaacataacctaacaactatacttttctagagtgcttctggaactagccaggcaaaattcgtgtgctgtatcttatatcttactttttgccttcctgtattgtgtgcttggttctttaaaaaacagttatgcacatgtaaaaaaagtattaggcaaaagtatgcaggttaaagatatgtacacctaagtctagttactgatgattatagcaatagcaaaagataaataagttcatatcttttttgatggaatcacatatcttttatgttgttattgttctatgaaaaatcttagagatcaactaaaccaaaactcttattattcaaatttgaaactgtagtccagaaagaagaactgattggttacaagttccagagctggcatcatcagagctagggctgcaatccatctctagatccccacttgggagctttttcttaggctccacgctgaaagacaagccatcctatgataagtactgaattataggaaggtctcgctagtccagaaacattacaggttactctaaagattctagttttgctagatgtgtcttgtcttcccctacttttgtttatagaaatccttggctccaaataaagcctgtgacacataagcttcttgctgttatcacttttttcatccctttaacacttcctggaatgctgttaccttcactacctcattctaattccatcagtgcttctttataagcagcccacaggatggctttcattataacagccacacattgcaccttggctcaagtgagaaatgctgcttagatccacaaggtaaaacaaaataaacagttgccttcacctgtttcacaatcttcattctacatcaactcttaatcactataaaggatacacatgataggcgtgtgcaaattagaaatggttcaaagaataaaaatgctactatgtgatcagtttttctttaaaattataattaattatcatttagaattaatgaacatatatggatattcatgtaaaatttaatgcaaaatgttgtaagcaaatccagttctgctctataccatatttacttacagcttacaagaacaaaaaataaatgtactttcataaacagattactatgatggttctgttcactctacatttaaaacagccactttgtcattttttgaaaacttgcctcatatgggagggagttctccacatgcagatgtctgctgccatctatgtggaaagcagaaatagtgggtgtggtttgaaacaagtctcttttgtgtgatgcacaaatactcaagtgtccagactttatcatcaaaccgagtggtaagttggaaatgaagcccaatttttagtgacctgccacctctcctaggccttgcttgattctctgaacgggactcatagcttctacattctccctggcctgctttgccttagggcataagataaggaatgctcagtttccagaagactgagaaatgccacttctacaagagaggtgctggttcttggcacagttgctttctgagctgaaaaaaagtgccatgacatgtacagaactacaatggagttaaattctgaagagtgtaatatatgtatgcacatatattagacacgggaaatgtgcatatgtaagaaatggaaaatgttcattggacttatggcattcacatctaattggggatatacctgatccacatctacaggtctttagggttgctcaggatttcaaatcttcccatttaatctttataggtgatactttggagggtggctgcccatttctctctaaatggctatatctagtcccccacttttcacactcttttttttattttctttgagtctcagttgaactattcattcttgtcttccagaactcacttcaaatgggttttccatctatcatgagtctagtgttctcacctttgtcttacaattaattcttctgcagatcccctcacactgatctcctcccctgagctttggacaattatattctctcatctctttcacataaatcgcacttggaagacaaactcctcaggttaagctgccatctggtgtgtgtatttttcatcaagaactagcaacacccacatcaatagcatccacctttaccatcacctatataagcaacttactttgggaacctatttccttatttcagcattctcatttgaatcaatctagcctaggttagggacactggaaccaaacttggctgtccctggactggcctgggatacctataatataggagggactcgacgaggaactggaggtgtgagagcaaataggaataagatacagtttctgagatgaagaatctaataaaatccaatagaatggggctgtgtcctaagatgaagcaggccaggaagattttagcaggaaatgggtccagttcaaaaaatcaagcaaggcttgggagaggtggtagatcactgaaggtcaaagcacaaaggatcaggatctagtaaacgggctttggaaacggaaaaccttaggagaccctgaacatttcaaaaagacatttgtgctctaccttctttcaaactcttaactctgggcacctacactgtagagatgtaacagaaggcagaagaaatcaggggcatacaggtaggtgtgtcatcttttggttggcacatagatgttctgattacagacagattgtattattttaagagagatggggcatgtgaatatggtgcaagttattttttttttgtcttcagtttttttttcaagggatagcaaggtttatatagagtggtgtgcctttcgaatggcctctatttacacaaagagattggggattaggggaggatagggaagggaatttaaccttacatcctcacattgaatggcctttgtggaagcagtcctaataattttccattactgtccaactttgtattctgtttttttttttttttatatactttaagttttagggtacatgtgcacattgtgcaggttagttacatacgtatacatgtgccatgctggtgtgctgcacccactaactcgtcatctagcattaggtatatctcccagtgctatccctccccccccgccaccccacaacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatccttttttatggctgcatagtattccatggtgtatatgtgccacattttcttaatccagtctatcattgttggacatttgggttggttccaagtctttgctatcgtgaataatgctgcagtaaacatacgtgtgcatgtgtctttatagcagcatgatttatagtcctttgggtatatacccagtaatgggatggctgggtcaaatggtgtttccagttctagatccctgaggaatggccacactgacttccacaatggttgaactagtttacagtcccaccaacagtgtaaaagtgttcctatttctccacatcctctccagctcctgttgtttcctgactttttaatgatcaccattctaactggtgtgagatggtatctcatggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattctgtaggttgcctgttctctctgacggtagtttcttttcctgtgcagaagctctttattttaattagttcccatttgtcaattttggcttttgttgtcattgcttttggtgttttagacatgaagtctttgcccatgcctatgtcctgaatggtaatgcctaggttttcttctagggtttttatggttttaggtctaacgtttaagtctttaatccatcttgaactgatttttgtataaggtgtcaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtatcagtaccatgctgttttggttactgtagccttgtagtatatagtttgaagtcaggtagcgtgatgcctccagctttgttcttttggcttaggactgacttggtgatgcaggctcttttttggttccatatgaactttaaagtacttttttccaattctgtgaagagaggcattggtggcttgatggggatggcattgaatctgtaaattaccttgggcagtatggccattttcatgatattgattcttcctacccatgagcatggaatgttcttccatttgtttgtttcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtgtaagaatgcttgtgattttggtacattgattttgtatcctgagactttgctgaagttgcttatcagcttaaggagattttgggctgagacaatggggttttctagatatacaatcatgtcttctgcaaaaagggacaatttgacttcctcttttcctaattgaataccctttatttccttctcctgcctaattgccctggccagaacttccaacaatatgttgaataggagtggtgagagagggcatccctgtcttgtgccagttttcaaagggaatgcttccagtttttgcccattcagtatgatagtggctgtgggtttgtcatagatagctcttattattttgaaatacgtcccatcaatacctaatttattgagagttcttagcatgaagggttgttgaattttgtcaaaggctttttctgcatctattgagataatcatgtggtttttgtctttggctctgtttatatgctggattatatttattgatttgcgtatattgaaccagccttgcatcccagggatgaagcccacttgatcatggtggataagctttttgatgtgctgctggattcgttttgccagtattttattgaggatttttcatcaatgttcatcaaggatattggtctaaaattctcttttttggttgtgtctctgcttggctttggtatcagaatgatgctggcttcataaaatgagttagggaggattccctctttttctattgattggaatagtttcagaaggaatggtaccagttcctccttgtacctctggtagaatttggctgtgaatccatctggtcctggactctttttggttggtaagctattaattattgccacaatttcagatcctgttgttggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgcgtctatttgagtcttctctctttttttctttattagtcttgctagtggtctatcaattttgttgatcctttcaaaaaaccagctcctggattcattaattttttgaagggtttttggtgtctctatttccttcagttctgctctgattttagttatttcttgccttctgctagcttttgaatgtgtttgctcttgcttttctagttcttttaatggtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgaggggttttgagtgagattcttaatcctgagttctagtttgattgcactgtggtctgagagatagtttgttataatttctgttcttttacatttgctgaggagagctttacttccaagtatgtggtcaattttggaagaggtgtggtgtggtgctgaaaaaaatgtatattctgttgatttggggtggacagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgaaggtcactcaggacttgctttatgaatctgggtgctcctgtattgggtgcatatatatttaggatagttagctcttcttgttgaattgatctctttaccattatgtaatggccttctttgtctcttttgatctttgttggtttaaggtctgttttatcagagactaggattgcaaaccctgcctttttttgttttccatttgtttggcagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacaatttggcatgattttgcagccgctggtactggttgttccttcccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaacattggcccccactctcttctggcttgtagggtttctgccgagagatccgctgttagtctgatgggcttccctttgagggtaacccgacctttctctctggttgcccttaacattttttttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagcttgttttccaacttggttccattgtccccatcgctttcaggtacaccaatcagacgtagatttggtcttttcacatagtcccatatttcttggaggctttgctcatttctttttattcttttttctctaaacttcccttctcacttcatttcattcatttcatcttccattgctgacaccctttcttccagttgattgcatcagctcctgaggcttctgcattcttcacgtagttcttgagccttggttttcagctccatcagctactttaagcatttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttccgttgctggtgaggaactgtgttcctttggaggaggagaggcgctctgctttttagagtttccagtttttctgttctgttttttccccatctttgtggttttatctacttttggtctttgatgatggtgatgtacagatgggtttttggtgtggacgtcctttctgtttgttagttttccttctaacagacaggaccctcagctgcaggtctgttggaataccctgccatgggaggtgtcagtgtgcccctgctggggggtgcctcccagttaggctgctcgggggtcaggggtcagggacccacttggggaggcagtctgcccgttctcagatctccagctgcgtgctgggagaaccactgctctcttcaaagctgtcagacagggacatttaagtctgcaaaagttactgctgtctttttgtttgtctgtgccctgcccccagaggtggagcctacagaggcaggcaggcctccttgagctgtggtggactccacccagttcgagcttcccggctgctttgtttacctaatcaagcctgggcaatggcgggcgcccctcccccagcctcgctgccgccttgcagtttgatctcagactgctgtgctagcaatcagtgagactccgtgggcgtaggaccctcccagccaggtgcgggatataatctcgtggtgggccgttttttaagcccgttggaaaagcgcagtattcgggtgggagtgacccgattttccaggtgctgtccgtcacccctttctttgactcggaagggaaactccctgaccccttgcacttcccaagtgaggcaatgctcgccctgcttcggctcgcacacggtgcgcgcacccactgacctgtgcccactgtctggcactccctagtgagatgaacccagtacctcagatggaaatgcagaaatcgcccgtcttctgcgtcgctcacgctgggagctgtagaccggagctgttcctattcggccatcttggctcctcgatcgtcttctgtttcttactggcaatattccccaagctagagctatgcaatcagtcttctatattccttaaatctgtatagtctattgtaaagttaagtatgagtttctattatataaattaactcaagtattgttcagagattttacttatataaattttttttcatctggaggaaattaatgtatatcattatatatagaagccattttctcctgaaagtaacaatgtaggtactttgatgttatttgcagtgaaatttacctttacagggataactgcagtaaccttttaaatgaacatatgtatatatgtgaacttgcacctgttattgttgtcatggaaacagttccaaaacataagatacaattctattattgaggcagtatagttccccaaatgaattttaatgaaattgcagcagaaaaaaaaaaaagaattttatggaggcttctaaattatttagtaaagtttgccaactagaatctgactacatcataccatagtaatcttcacctaaaaaggaaacaacagtcagcaaatgtcaatcatgcaaaaaggggcataaagtaggtttatttaaaaagtgaacacagtaccccaattctagctttttagtgtctatctttaatattgcccaatcactactcctattgttgatggaagtatatttgaccattagctgtctgagtggcacacaccaagatcactgagttatctggatttttttcctagtttctgtcatctttgggctttctattgacatgaggtgaatagatttagggctagaatgttttaaatgctgagagacctaaaggacctctatttcaacccattgcattacagattagggaaccaatgcctaaaaaagttaggtgatttgtctgaggtacacaagtaaatgtggcagggctgcattaggggttgggtttctgactctcctcctcccatgcacagtcactgtgctgcctcgtgaaatacagccctctctgctgccagttacaactggtgcattctactccagcctgggcaacagagcaagactctgtctcaaaaaaacaaaaacaaaaacaaaaaaactggtgcattctttcataaaggaaagaaatcaaattctgaatgtgaatacctgaattttcattccccacttacattgttacaggagtgaagtacaatttgcttaatgaaataaaatttcagtatcctccttagtgtatgtatctcctcactaaatatgttgattgcatgtagattacttcttttacccatggaaaccgaacgaatatcttaatgtaagaagagtagttttctcaatttgtaaccactgcttcacctcttctgtaatccgaagtcatgtgaatgaaatgtcccaggctcataatgaagccaactgtgaaaccagcgcttacctccaagtcaagagcctgggaaacatctatggagcttagcttaaaactatctgatgatgaattgggactccagtatatcattttgtgcacacagttatggcataatatttgggggaaaggaagccttcacagttataaaatatgagtgggaaatgattatccctagatacagagagtacttattatgtaactgttgttaagggctgacgacatggcaggctctgtgccaagtcaagtctccgacggagcggaggactccccaggctctagaaggcccctgagacagtgtgtcatacagtgatgaggggtagaaaatactctaaccattcaggatgtgattgttttggcttcctctcggctgagcttttggcacttgaactggacccaatgcaacaccacagctgggaaatgacattatttggattggttaagaggagtttttgaagcaaaccccactgtagtattagagaaataaaaaaattcctgctatatccaacaagtcccagagaggctgtctctctattgttcacatgtttggacatgaatgtgcatttatgaacacttttttgtataaatacacagatatataagctatgcaaagccatataaatctgtactactagaataattcattccataaatatttcttgagcattcactacataccaagcacatttttctagtttaaaagtgaagtcgggcatggcagctcctgcctgtactcccagctacttaggagactgaggcaggaggattgcatgaacctaggagttcaaggctgcagtgaaccatgatcattgccattgcactactgcctggatgacagaatgataccccgactcaaaaaaaagtgacccacatgtgtatttgtcacttttaaaatagagacaataaatttcttccgtgatttttaaagaacttaaaacagaggtactattcaacccagcaatcccattattgggtatatacccaaaggaaaataaatcattctaccaaaaaggcacatggacttgcacgttcatcactatgccattcacaatagcaaaggcatggaatcaagtcaggtgcccatcaacagtggattggataaagctaatacggtatatatacaccatggaatattacacagccataaaaaagaacaaaatcatggtttttgcagtgatatggatgcaagtggaggccataatcctcagcgaattaacacagcaacagaaaaccaaataccacgtgttctcacttacaaatgggagataatcactgagcatacacggacataaacgtgggtataatagacactctggactacctggaatagggggcatgggttgaaaaactactttatcagtactgtactcagtacctgaatgacgagatccacaccccaaacttcagcatcacacaataaacccgcacatgtaccccctccgtcaaaaataaaagttgaaatttaaataataaattccttcctcacaggtattaaaaagcacaatgtgagtaaagtacctgatatgtgaccataaatacctgtccccctttgacctcttctttgccctcccctaaccttgaggtgtgattaaccttcctgccttttcaaattctgaagaccacaacagagtagggaaagaagagtgtgaaggtggtccatctaatcccaattcagagcctgggacagacacccatactgaatcctctactttagaaaagaactccacaggctttgagagtgacctgtcacttgtcatagcccctaaggactatgagctttttcaccataagcattgcctatttgttccaatctagtaagatcagatttatcaacagacagaaaaatagatatcagtttttttcttattctaaaaacaatatgtttatgttgttgaatactgggataaaatatagaaaatattaattattcataattcctaatccaagcagtgttccactcaataatttgatctatttcctatagtttgctactaacttcggggcagatctccagaaaataaatattgatggggctatgatgtctccattttgactaaatatattgttatataaagtggtaacgccttacaatttaagtgtgagaaggatgtgtgtgtgtgtgcgtgtgtgtgtgtgagagagagacagagaatatgaatatgaatatgacaatactttggagaaatgtgtccattagaattttaccacaagccagactgaaaacatcaaagatgtttaagtaaagcctgtttagttctttgtgaatgtaattttggaaaacaaactaaaacataaagataaaaggtccacatttcctttcatatttgcaaataaggcttatttcatgaatggtgaaatcgctttgtgtaatttgtaacctcattgttgtcctggattgcctgccatgctgcctgtgtttatgttgcttctccctatggcatgtgctctgagcagacaagggtataattataaatctccatccactaacaagaacaatggttgcatccagcaactcgactctccctttgtgaagctctacagggataccgtcttgaatgtcaaaggtctacaaatgtcatagaaacagctgccaccacttctttgcattaggcatctctttcaacatttactcatggtattgccttacccatctaggcagaagcaaaccaaaatccagagattttaaaatatggtatctataattacaagaaacaacaagaaaccaaagaggaatacaaatacaaccatgccttgtgtttcaagactttctagacttgcttagaaaaaaagagactaaatttttgtctctgggcaaagttagtcagacgagaaagacaaacttcacatgcaaggtatactttttgctgtctccatttttataaaagcaaagttaatgaggctttgatctttattccatagttattaagattattttcctaaatctgagatcattgcagagatatacaaggtagttctgccaaatcattcattcattccttcaccaaacgtggatacgagtgtctactgaatgtccagtaaaagcaggaatacagacattgaaggctcatttcattgcccttagtttctacatatcatagctgtgatgcatggaatattaaggaaacccctaaatctttaactgagttaattcacaacttaccagagctattttcaattcatgaaaataaaggccaggcgtgtaatcccagcactctgggaggccaaagtgggtggattgcttgagcctcaggagttcaagaccagcctgggcaacatgataaaaccctgcctctaccaaaaatacaaataaataaataaactgggcatggtagtgtctgcggtcccacctacttgagagctgagatgggaggatcacttgagcctaggaggtagatgttatagtgaccaagatcaccccactgtactccaaccttggtgacaaagtgagaccctgtctcaaaaaagagaaaaagaaaagaaagatttctcaagtctaagttcagtatttaagaaaaaataaaaagtaacatcatggctttgagcttgattttacctctgttttagactaagaagtctattcaaatggagcctatggccctgtaacctggctctgggaaaatgaacaaaggaatgcaacatcacatcagcactgtgtatttttggaagggtattgcatttttcctttgtggtggattggtccgtgcacttgaaaatacattcacagtgggaaggcaccaactctgctgcacatttatagttgaatctattttttttcctgacaaatattcaagtgggggaggaattccatgtgaatgctctagtgcctccttccctctgatgagtctaagtgctagataaacaaacattatttctaaaacctcaaggggaatacttgaaactggagcaacgtaagaggaaaagtgggcagaatggatagcttctagggagactgtgacatttctgagtaattactgaggggtctagggtctgggggacaacgctcccatcagcagcccttttgttattaaaaaaaatgaacatctgagcaatttaatggaaagtgctgtgaaaacacagctgcaagccttacattcttaccagatcacctcctctaagctttcctatgtagaaattttgaagctttcctggtatctcctcactagggggttaggaagtaagtaaatacactgcactcttggtttagtggtgggagatacattaggaaagcgtcagtgcacatgaagagacccacaggctaacagccatcatttactgagcatctactacgtgagtctccttctgagcgtttccacatctattatctctttaaatttcccaacaacactaaggtaatgacagcctttcctgctgacctatgaaggccaggctgggagttgtccgatgacttttcctgtataatgtcaccccaggggaagacgttactctgatttttccacctcatgtttttccctggcagttgctgtgagagaatgttgtttttggagctgagtaggcaagtggtgtgcatgatatgaaaaaccaaaaaaaaaaaaaaaaaaaaaatgcaccaaaccccacaaactttctgacagaaagcactcgtcaattttagcctgtctatgcaatgatcgaggccttttcctactgctggatatttctaagtgagaagatcctacctcagttttcagctgggctttagctctgcaagaagtgctgccccagtcagccttggggagatcagtagaggattagttagcagagcagccactggagggcactcctgaaatctagaggcttcttcctcccgaggaaagggttgctggagtccctgcctgagactgtgggtttaacaaagagaaggaatgtctgggggataagtcccagtgcactcattctctggaaaaggtctgctgtacatatttgccaagtgataaggaacctaggaaatcaaaaaccatttgacaatttacagtgttcaaaggtagcttcctgactcttgagttacataaatggctatgttaaaaataggcagccaatataattgagcaaccttaaatggcctaggatatgtaccatatgtgatagccatgaaaataatcaaaagaataattcagtataaattaggaatcattcccactccagtggactcagtcttatggaagtggcacataggagaaacttgggattctgtgatttgtgctgttcatgtacaggtctctctctccctagtgaaactcagctctttagtttgggagcctataccggatctctctgatatccctctccagctctaaacatatactacgtagtcacactgattgtccgttaaatacattcaagtcgttattttccttatgacaaaattcacagtgaaaggccacgtgtccaccagaagaataaggtgcaaatctaaagtgggttagtggcattttctcaggacagagtgcatgggaggacaacatagcaatcctggaagttgacagggtaaaacttttggacactctgactctgtgctgtatgtacctgtttgcttctgctttgaaaataactagtaatatacaagatccacttgaaccactgaatttagcaaaatcaggccaaaccagacgtctttgcattaatattgtcattttgttttatattacttaaaaagtcaaacttttttttttttaatcattccttctcttgactatctgctgctctcctgtgatgtatattgtgaaaaacacattttaaaaccaagacagatatctcaagatagacatcatgttcagtttctaagctacaattaaatctcgtagaatggtaagaggtttatatcagactgttgactgctttatatacattactttcattcgagactcatttcatggatgaggaaactgatgtttacataagtcaaggaacttgaccaaggttacatagttataagaagctgagctaggaccctacaggtccatctcagagacctatgatgttaatcattatgccatatgacctgtcttagactagtttaagaaatagcttctcaattaacctctcttcttttaaaagtgttcataggttttaattccttttttttctgcttaggcaatacttaatttttaaactgtgcacatagaagatgaaatggaaaaatgtattccagatgtaggttttatagttgcacatcttggatatggttggttacacatacactacaagcatgtggtacacatctatctcatttttactttagaaatacattctcaacaggggaaacttgaaatacgcaaactgtggtcctgattccacttcaaaacgtctgcttttattgggtttaccctgcaatcatgcaacttttggccagagtcaaatagggcaactaaatttttttcttgagttttacttggtatggttcactgtaaatgcttccaactagtcctaaagacagactttgttcatttgttcttctatgagttttattcagcagaaccttggataacagcagcttagccaaacactgtggggtaatcactctgctcaggactgattcctgtgcagtcagttcttctgcacatcttgccttcaaggtctgccagctgaatgcactgtgtttccaacattgccctccaaacagacctttcataaggaaaagtcactgctacttcattaattccagaagatggatggtgaagtcatattgctttgatatgctttcagactcaggctgttcatgggaagctagaactctctgaaacagaaaagtttttaaattctggctactttttcataggattctattatgacacctcagaggaattttttttatttaagtctgtcattttaaaggaaaatggttagatgtgactagggctgtgaaaacacagtagctaccagtgcctggcaaagtttgtactctaacatatttctgctaaaaaaaaaaagaatattttccattattgccttggattctttcatcttttcttacatgttaagaaacttaatatctgaagagtgagaaatagccattttagtgtgaaatcatgctggggtggaaaggccagcatatttcttatagattagtattataggagagtttggccattttcctgggcagaagcaaggagttggcaccttggaatcaactcttagccatctgaaggctttgagccttggtgagttttccaaccacagggcattagctttctgcagcctggaatggagcgatcactatccccagagagctgtcatgggtgcaggcagtgctcagcttggcttagttctaccatggtcctgaacagccaggctctaggttaagccaaatccagaagtatcttgttttatttcacttgccacgtgtttgagaaggattaatctcagaatatggcagaagccttagcaaagcaactttagaaaacagcatatatatgtgtgtgtgtgtgtgtgtgtggagagagagagacagatctgaggcatgggttttactaatgttattatttaaataaacccttccttatgctagagcaccagatggtgttacaaaaatgaggaaaaaaggctcagggcatataagtcacgtgtcacattagctgtattggcctatgttcaaataataaacattttaatcactgcagtttataactctattttaaattttttgttaatacattaacagtaactgcttacgtatacatagaattctaataaaaatgcataaataacttacaagaggaaagggacttagggattatccctggaagccctcatttcaaaggtgagacccagtagaaacccaatatgcacagaagttaagtgactttctgaaaggtcttgcaggtaattaattatagaacaggactccacgttcaatgctatgttcactattacctgaaatagacttggaggcaaaaataaacttatgtcagctatactcaatgctcagtaaagtggcagagcaatattttataagcgtgtgttccgtgaactcaaatgtgatgttaggtagtgattctgagtcccttaaaacagattgcttgatttatttaaggtatgttctctattacaccaaaaattgtttatggattttttaaaaactgcactccatggagtaagtaccaatttctacacttttgatgacattaagatatgttaagaggcctgaatgttctcaactatggattaaaaataaagtaccaattagttgggtcagttttctacagtgatttgaaattgatttctaagtttccctattgctaatggctgaatgtttatgttttcccaactccaaactcagaggttgaaatcctaactcccagggtgatgggatgagaaggtgggtacctttgggaagtgattaggtcactcttaagagtgaggttagtgcccttataaaagaggccctggacatctcccttgccctaccatcacaccacctgcaggcacagcgaaaagatggctgtctatgaatcaggaaattgtacttcaccagacactgactctgccagagcctagaccttggactttctagcctctggaactgtgggaaatacatttctgttgttataagccacctagtctatggttctttgttatagcagtccaaatgaactaagatatctattgaggctttattgggggaggtaataaaatatgtcatttttttctaggtttaacaacctatattcaattcccctttccgtgatctatagtatgggcataaatagactgtcatgtgtatccaaattaagatgatggtagccaggagaaagattgaaggtgggactactggctgttgatagccaagatctaattctgatctttagggatttaggttcgtttctggttggacggagttgtattatttatctatgcatagtgaagtaaccttgtgatcataatttcagaacaaacaaaaagtcttcacctcgtgatgtcttttaatttgattccacatcaccaggggcagaataagttttatttctagggacattcattgagaacaggatgacgtgctgagtttcagatgtgatcagcttgccaactgtccctgggtcctttgtgtcctgctgcaatatcttctaggaaacaaacacaatgacgtttgaagttcatcaagttcattgattaagctaagatctgcactactttgtcgaaatcttaaatagaacaaaaaatgtttgatgttatatctctcagagctgaaattaactgattaaagagtctctgttatgatgtctatcaatcaagtaaaaaaatagggttttgatctagaaatgcctatccgtttttgaggtatatactttcaaaaccttttgaaataaagagaacagtggttgcaaaacttttaagtatttttactttaaaaaaaggatagaaacaaagcaatgtgtcccattacatcagcatttttcaaaatttagtctctgtactttcatttgcataattttccactttctgtaatattttcataacccttagtgcttaaatgggtggagaggcctgtgccacagtctccaacaaggtgtcaagggagaggaggtgtttctcttctcccaattcacaccatatttagaagcactattctagatgattcctctaaaaatattcaagcttttaggatcttggctttgttttttgtaaattgtacttaaagtcagtgtgactattaccatcaatttgaataagtgcaatgtatttctcatgttgcaggtagtaaaaattgccaacgaatcacttaaatactgagaggactgacaagctataatttattacttggctcaaaatatgtctctactctgtattatctgcctagatcttacttaacacaggaagggtgtagacttcactgaaatgactaattgatgttcaatttgcagattttaattgaaaaaaatatattttgataagtagcagtacttgtttcaaaggaagataccgttatattaaaaagtaaacatccaaatctattggtctaggtctatactcaaaaccttccgggtgtatgtatgtgtgagatattttaaagtaattctaaccaagccattgttctgtaacctgacttaacaagctacagaacaattccttagcttaaattgttaaaggggacattgtgatgacaaataaataaaacgtgttagcagaataaaagttgtctggaaataagtaaatactattttataatttgggggaaagaaattcaatacagggtaaagagaacaggattttggaattaagctgagttaaaattcttgctctggacaacagacaaattacttaacatgtttgaatttcagttttttatctacaagttgggaataatatatgcattacgaagagattacaagtactaactggagaaaacaatctgagaccttggcaaataatagattatccaacttaattccaatattattaaaattagtgatcattagctggcactttacaacagaaatgatctgaataaattttcaacatatacatgctctgataccatgacaggaaaatgtaagtgcaagcgtgggggggcggtgtcaggagactcgtgtgtttataattctgatgcctatctctctgaagagtgactcttcgagttattcttttcaatagatgtacttatggaacataatttggtcatattgtagtgatctgctactaaagaaactttcgcctaactttctcctagccaaggatgtgagtctctcaataacccacatttacccatgagttatgttaaatgtgccttgtgttccactggtttagaatttggggtttggggaaaggcaaatgggatgttttcccagtgtactttagcacaatataggtgaaatcatacatgtatatgcaaaaaaagtacctgtaactgttctgtagttccaatgattgattggatcacaatactaaggagggtcagaatttgatgattattctggctttttgggtggccccaaactcccaccagctatcaaatgaaggcgtcgggggagaatatatacagtctacagaactcgggagagttaaagagtagcaagttccaatcaagaagaaatgttttattcagtaattactttgaagaatttttttaagagcccctgaaaatactggatttctgcaggggatattgcgaaaatactaaaatactaaggtgtgaaaatgattctcttttttgaattaaaaaaaaaatcaatagaaataattcagtgtgtgaggtagataagcttcagacaaagggaaaaaccaaacctgctagtcagagatagatataaaaaagagaaaaatcaacctctacgttatgttgccaaggagactgtgtaaacagacttacacaaagagaagtggctggctggcaatactgctaatgtggaaaatctcttcattgttgtgtggcatgcttcatctcagaagagcaggaaaaggtggcaggcagagagggagaaataacaagaatggaagagtcgttcttccaaaaagggccatctgtgaccctgagagataaacctggcagaccagggctcacatcttagtaaatcacctgtaaataaagcttgtaaggcctgtgcattgtctcatgattattttattaataatactttaacccttgcaatttgatacgctgtgcaaggtagtcttacaggggatcttttcattgagacgctcaacttgtttgttttgtgcttctcaggcaagggcagtgactggaagctgggagagagggtcaacagctgaatctcagcctgatggaggccaccatttaataagtaaatacatgcacggtaagcctcatatgactttcgtctctctattcttttagaagttggtctaatccaaccatatatacaaatgcaattatttctccttcaatattttcattcattcaatatacatcgggtattatgaataaagtccgtgtagatacaagtagtctcagttccccaaaatgtttagagtgtataataccaaaaaatgctattataaagtttagtgagaaaaaagtttgtttttatataaccatatatgcaatatgattacaaatctgctaaattgttgagcaaacaataaatggttaatcagtgttgatggatgagcaaactatgaattattttccctcttttaattttcatctccaaattttctataatgtggttgtatgaatttattcatatagagagaatttacaggtggctgaagtgaatctgggttcagatgttggacttcgcggtttattcttttacagagtttgagataagccagtgaagtctgacaaaatataaagcagctctttctgcatttgcaaatatgtgtgcagtttttttttttagatagtacatttgtattttgattgattgattgagatggagtcttgctctgtcacccaggctggagtgcagtggcatgatctcggctcactgcaacctctgcctactgagttcaactgattctcctgccccagcctcccaagtaactgggatgacaggcgcccgccaccaagcccaactaattttttgtgcctttagtagagacagggtttcaccatgttggccaggagggactcaaactcctgacctcaagtgatccacctgccttggcctcccaaagtgctgggatgacaggtgcacaggtgtgagcaatcacgcccggccaagatagtgcatttttaaatgtttctctccagacctgtcatcataaaagttgcttgcttagaagggggataaaataagatgcaaaccagctcttcttttattggagagtttcaatttaatcagaagctgaatgttagcacatatatatatgtgtgtgtatatatgtacatatacatatatatgtatatacatgtgtatacatatatgtatatatacacatttgattccaataatatatattttgagccaaattttatatgtatgtatatgtgtatatatacatacatgtatatgtatgtacatatatacatatgtgtgtatatgtatgtacatatatgtatctgtatatatgtatatacatatatatgtatctgtatatatgtatatacatatgtatcagtatatgtatatatgtacatgtatatactatatatgtgtataaatgtatatagtatatatacatatatacgtgtatacatatatacacgtatatatgtatatgtatatacatacatatatatgtatatacacacaaatatacatatatacacgtatatgtatacacatctatacatatttacatatacatacatgtgcgtatatacacatatgtatacatatatacatgtacatatgacgtatatatgtgtatatacacatatatacacatatatacacacacatatatgtgtatatatatacacacacaatggaatattgtccagccatagaaaataaaatcctgtcatttgcagcaacatggatggaactggaggacatatgctaatttgaaataagcaaggcacagaaagacaagtattatatgttctcactcatatgtgggagataaaaaagtggatttcatggaggtacagtagaatggtacttaaaagaggctaaagggcctggcgcggtggctcatgcctgtaatcccagcattttgggaggccgaggcaggcggatcacctgaggtcaggagttcgaggccagcctgaccaacatggtgaaaccctatctctactaaaaaatacaaaaagtagccaggcatggtggtgggcacttgtaatcccagctactcgggaggctgaggcaggagaatcacttaaacccaggaggtggaggttgcagtgagccgagatcatgccattgcactccagcctgtgcaacagagccaaactctgtctgtctccaaaaaaaaaaaaaaaaaaaaaaaaaggctaggaaggacagcaggagtgggggataaagaaacaaacgttggtttatggtacaagaatacagttagctaaaaagaataagttccagtgtttgatagcacaacagggtgactacagttaataataactgattttatatttcaaaatagctagaagaaaacttctgcatattcccaacacaaagaaatggtaaatgtttgtttgagatgacggatattctaattaccctgatttgatcattacacattttatgcatgtatcaaagcatcacacatactctactctagaaatatttataatcattatgtcaacaaaaaattaatataaaaaaagaaaataaaagctaattccaactgctaagtcattgataaattaaaaatagaaatgagattggggtcttaagtaatttccttacattaacggtcaaaatgaatgccacaccttgtgagacagcatgcaaaactcagtttcagagctggcatattgaattaataacatatcctttttctatcaaaatgctcttaagttgtaaatcatgcttttttgttttttttttttcaggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttctttctccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtcacatcaattagtcaagaaaatgtgattaccctgagcccaagaaacttccactaaaaagatggaaggaaagactacgtctggtgttctctggcaccatccttgagtccacatgtatttagaagtgaataactgaatttagggccatggtacagaggtgtcagtctgcaaactagaagagcaatgctgacaggccctgggactgttcctagtgctgtatgggaactcagaaatctaaccgaagccacaggatgggtaacgacaatgagactgtgacctggcaatatctgcataatcttgcaagaaatttctaaaaccataagacacacggcatttttacttgagtcctaaaatgaacatccggtgatattggaccttcccactcctaaccaaatgacgtcaacacactcttaaggacacatcacacactctgtggaagagggtaggagaggtgtggaatataaaattccttttttgagacggctgcctggattctaatggggttactctaatgtgttttaagaccaaggctcactggccaagatatactttcatgaattcaagaatgtatgatcattatgatgtatacatatacacatatatgcatttacatgacaaaaaaaatgccagaaggcatgtaaaagacagacagtcctcttttcaaagggtgcataatgggagtgattctatctttacgtctaaagtgttctactggacgcatttaatgttcttgtttcctctgtcttaaattattcgttcccttttggacacattattgctccataataatgctaagtagcttcattttgttgttgttgttttttaaatcacccaacctttcctaatgctaagccaggcaatggagggcaggaaaaaaaaatgtctttagagaaggctgtaggcctatcaccagattttgagctgggctttccccagaacacactttaggcctgcaggatgcctgaggccaagggtacttcctgcatccacagggttggggatgctgagtgcaatccctctattctgccacctgggacagccttttgcattactctctggctgccttcccttttctgaaacttgagaggggagaatgttgcttccctttagaacagtaggtgagcccatcagcaactcagccccaaaagtctctgcagtctcatctgacaaattataagattgagcctatcaagtaagtaaataaataaataaataaataaataaataaatgaataaaatgaatcataacaaatatacatatctgtgtatttattacatcttatcataattctcagcctgaatctaaatatacggtctactacaatctttttaattgggctttagctaaatgcatgatgaaaatcattttcagatcttagctcattggaaaaaagtaaagataaaaaataaataaataaaaagatcttagctcactgtcgtactctagtgccttcctaacacgcaagcatacttcccatgtcccattcacttgcaatcagctactggtggaaaattagatggtcccaaatcagaggaaaccgaagacatgataatgaaactcctgaaaaaatcaatgacgattatggaaattagctgtttaccaccttttttttttttgacctttcctttttttgaccctctaggcagcctagtttatggaaggaacatcatcagtgaggtcccagagaaaggaaaatgactgattacagagatagctattatttccagccactatatccaagagcgtatcagatcactcaaagcacattttatcaacactccccctgtgacaatctagtctttactggagttaattaaagcaattaattcccttccctttcaaagcagtgtgattacataaatagataatttcccaatccaaacccataaagcaagtgatttctctgcatgttcctcagtgtgcaaagcacctaactgaaccaaattgtcctttttctaaatttgaccttcatgaaattctccagtaactttttctgctctgtcttcctatctggttggatggcagaaccacatctccacatggacacaggactgcaagattaataaagcatttcccgcagcaaagatagataatgcctaaactgtaatcacaacgacaggagtagagtgaggaggaaaggagaatggcgggtgcctgctctgacaggcactacagttcccttcaacaatataccagcgtgggtgatgctgacaataattaagcaaacagaatgccaaacaattgtaagaaaagctgtcaaacattttgtgttattatcccctgcacaggcctgtaatttatcatcacagaaaaagcacataaagaaaaatctctaaacagtgacattttgttcaaattacaacccttggcttccctgactgcctacagactgacatctccaaggtcggatgtagtgctcagcaatttgttccttcattaagtgagcatgtctctgggatgggttctagccactgtgagtgctggcatgccaagagcaagaacaaagtacttcccaacgtgtgggaagccacttaccttcagacgtcaaaatgaaagaaagtaactgacattcgtatttccttctcagattggtcctaaagcttgaaatatgatctcctgcaccaaggctcctacctgtcatttcttcctccctctccacccaaaaccctgcttggggttctggacttggctaaagtgtaagggctttgatcttgttggtataaactcagtctttactggccgggcactggtggctcacacctgcaatcccagcattttgggaggctgaagacagtggatcacttgaagccaggagtttgagaccagcctggccaacatggtgaaacccccgtctctactaaaaatacaaaaattagccaggtgtggcggcaggcacctgtaaccctagctacatgaaaggatgacgcaggagaatcacttgaaccctggaggcagaggttgcagtgaggcaacattgcgccactgcacaccagcctgggcaacagagtgagactccatctcaaaaaaacaaaaaacaaacaaaaaacaacaaaaaacccaatcttcctgatgatatcccccaatggttgtaattgaaccagaaagaaaataaaaaaaaaaaaaggaaatacttttctcatccagtttctttagagtttagcacagttctatagattaattactataaattgtgagacataaagagacctcagagatgctgagccagtgagacaggtgtgagggtgtgaggtgttactattagtactttggagaaagtccataggcagtctccaacgtagatttctggatggctcagagttgaaatggaccctagaggtaatagaatcaatcttttcaagtaatgagagaaattctgtctgtgatattcctagctgatgttctgagctggaccacttccaaggatggagataatagaagccttccattacaaatacttggctgctgaaagacctaaacatttgagtcttcactgttttcaacagctccttccacacctgtccaacatagagatccacttaacagaagtcctaccctctagatattgccttatttgaaaaggtaatatcttttaatcccatttctttctatcccattgccagagctctttcccattgctttcttcactttcttcacaatcttttttcttttttaatttttaaaaatagggtctcattctgtgcccaggctggagcacagtgatgcaaccaagctcaccacaaccttgagctcttgggctcgaataatcctctggcctcagctaggactacaagcatgtgccaccatgccctgctaaccccatctcaatctttatacccataagagaaccttttcttagaagcctcttttcttagggtttggaggttgatttactattgccaatatagcaaatctttattttccttaggtttattttgattttttaaaacaatagtctttttactcaaactttggcaaagagtttgggctagtataccaagtaaataagctttaattttctcttggccatgtatcttctattagtttctgcataagaccctcagtgcttccatgtttactgctcgctgcacaggcacctctcactagatggcacttaggatatttttcaaccatctttctgaccaaaattgtatgtgttctatgtctcatccctaagaaagttgatagtgaactcaattggctgattacaagtacagtgtgaacaacttatacctgaacactttaaatatattgcaacctaacaaacacatttacatatcaacaatgactcatttccttagtccaagaaagtgaacacaggcttgattctctctcccaacaccctcccctccttttttctctctctttcattccttataatagacaaatgtgaattatcttcacaacctgttcatttaactctgtcaagctattcctcaaggacaaaccacaaaagggaaccagggaagggctgttcagagctcactgaaaatccagatcagctacagaggtccttagcccatagaagataggtctgtggtctcaacttggaatataaataacagcttctttaccaacctcaccaaatcgacttttaatacctttttttcccataggcttccaacctactctgattgacttaggctgatcagaaacaaaactttaacagtaacgtctaaaataagtgaactttgttttataagtcttccttcttgccaaagctgatgactaaataagttcaaagacatttaaattaatgtcagttatacccacagtcactggaggagaggtaataggaattcaagcttccagtaaagaaaaagaggaaatgagaaagaaaaagaggtgtctttcaactctagttgtgatatagtctgctgaattattgacctttcctttcaaagataagaaaatgtgtatgtggttttttttttttttaatttagacttcctacgtgtaactaaaatctctaaaacaaggtggcttattttacatatctgaagaaagtgaggcatgcaattttcccttcctcatagtccgacctaagagtgtgtggcaaactttgtagaattctaagtttccttcaagaacttttcatcttatttccatccacaaattaaaagggatggaattactcaatgtagccatagctaggaatacagtttagtgaagaacaggaagggagagagacagaaggactcctacagtttttctttacaatctaaatatgttaaatgcatgatggaagcaatggagccaggtcaaaatggcacttgctgtgttgtgaaaaatcctgactatgagaatcttctgtagtagaaaggcaggtcattctatcacaccaactggaaggccagtctggggcgtgcttgctggatgtgtggagatcaattacccacaagtccctgtggagtctcttccataagaaactggggaagcccaggccatcagtattctgcacacacactaacagcttgtgcttgcagaggcaatcatttttcagctcttttcagattctctttcttggttatttttccatcttggctaaaagggtttctcttttgtaccaagcaggggcaccaatctaacagaatttattagaaactgctcgattgggattttgctggagttctactgaggttgaaaatctcaaacaatatgtgatgaaaattttaggctgttttgggtgacttcaatcccaaggtctttcttggctgatttgagttccttctttcagagatttaggcaatgttagtttcagatgggaggtctggtagatcctaaaaatgaggtagctctatgtcagccattcagtggagaaagagcccatgctactctgtatgacaaaatactatgcctttatttgcatacaggtgtgaatgaattatttaaagagaaaaatgtgcgagtgggtactgcgtaagtgccacagtcgttgcactgtgcttttcagtaagtgtgaacattttccttcgcatgtctttttaagagaaagagaaaatgatgatgggaaggattttgggtaagacaagattacttttctactattcttatcaaaatttactattttgtcttcctttgtgtagtacctgtgtaatatttgctccacaattgtaagctccttgaagacatgaaatgtgtcttttcactttttttttttttttgagacagaatctcactctgtggccaggccggagtgcagtggtgtgatcttggctcactgcagccactgcctcctgggttcaagcaattctcctgtctcagcctccttagtagctgggactacaggcacgcgccatcacgcccagctaatttttgtgtttttagtagagacggggtttcaccatgttggccaggatggtctcgatctcctgaccttgtgatccgcccacctcagcctcccaaagtgctgggattacaggcatgagccaccgcacccggccctctcttcactattatattgccaatatttatgatagcttttggtttactgcaagaaacaatgagtaagtagtttgtctctttaaaccaatgctttccattcttctccaggtgagaggttggtatagatttttatgaggctttatcataactaaacccagtggtggactgaataagatcagctggtaaatatagtctttgatccactggaaaatccagcaatatctaacttaaacaacaaatgagcgaaattctaacatttctagtatatttgatctattggtttgtaaaccatcttgaagccatgatatagaaacactaactctgtatttttataaaaataaaacataagggtatgcatttattcattcaagaaacatttcttgagtccctaattgcactaggaactgttcttgattcatgatagaatgtgacagacaggttgttcatggagattttgctcgagtaatgcatatatggttggaactggtgggcacggagtccaaaatagcaattctaggccagcttgccctaaacaaatgatacagatattatatgagagagttgctaaaatttggatcatatttagctctcctcccacctctttcaaacacttactaagtttagggagaaatgtgggaacataggatgaagtggccacagaggtacccaagaatcagtacagtaacaatgtccttagcaaatggccctcccgtaattcctaagaaggtaaaatattttagcattgaaataacttcatgacatggctatgccaactctaaaatggtttcatcatgtaaacagtccttcagcgaatgacttacattttgaaaaacctacagagcagagtgaaaagcatgggctgagcagtcagctgatgaggatgactgaagccatgctccaccatttgctggttgattcaagaggaagtcacttaacctttccaagcctcagcttcacctgcagaatggcaataataatggccaacttgtagagttgttgtgaatacaaaaataatgcagtgcatttttagcatgatacataacatataatagcaacacagtgctagctgtaattcaattggaaaaaactactttaaagttcatatggaaccaaaaaagagcccacattgccaagtcaaccccaagccaaaagaacaaagctggaggcatcacgctacatgacttcaaactatgctacaaggctacagcaaccaaaacagcatggtactggtaccaaaacagagatatagaccaatggaacagaacagagccctcagaaataatgccacagatctacaaccatctgatctttgacaaacctgacaaaaacaagaaaaggggaaaggactccctgtttcataaatggtgctagccatttatggaaaactggctagccatatgtagaaagctgaaactggatcccttcctgacaccttatacaaaaattaattcaagatggattaaagacctaaaaccataaaaaccctaggagaaaacctaggcaataccattcaggacataggcatgggcaaggacttcatgtctaaaacacaaaaagcaatgataacaaaagccaaaattgacaaatgggatctaattaaactaaagagcttgtgcacagcaaaagaaactaccatcagagtgaacaggcaacctacagaatggcagaaaattttcacaacctactcatctgacaaagggctaatatccagaatctacaatgaactcaaacaaatttacaagaaaaaaacaaacaaccccatcaaaaagtaggtgaaggacatcaacagacacttcttgcaagaagacatttatgcagccagaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccgttactgggtatatacccaaaggattataaatcatgctgctataaagacacatgcacacgtatgtttattgcggcactattcacaatagcaaagacttggaaccaacccaaatgtccaacaatgatagactggattaagaagatgtggcacatatacaccatggaatactatgcagccataaaaaatgatgagttcatgtcctttgtagggacacggatgaagctggaaaccatcattctcagcaaactatcacaaggacaaaaaaccaaacaccgcgtgttctcactcataggtgggaattgaacaatgagaacacacggacacaggaaggggaacatcacactctgaggactgttgtggggtggggtgagggagagggatagcattaggagatatacctaatgttaaatgacgagttaatgggtgcagcacaccaacatggcacatgtatacatatgtaacaaacctgcacgttgtgcacatgtaccctaaaacttaaagtataaaaaaaaaatagagcacacatgtcattaatgaccattaattatagcaacacccagaggacagcagtactgtatcattttgcaggtaagaaaactgaggcttagagggtgtttatgagcacaggggaagatacacttcacctttctcttgaagttattatgttgccatgacttgctttggctaatgaaatgtaaatgacagaggaatgtgttgcttcttggtgaaaatcttcaagtcatcttctcttcactgtgccacaatgaattatgtttcagaaggcggattgtccaggatcctgtatcctgaattaaggacaatgtagagtagacgatgggcatgcagcatgagtaagaaatagatctttattattttaggtcactgcaatgtttacagttgtccattacagcaggataacatagcttattctaactttccaaagatgagaaactattaagatctagcattcaaactcaggtcttatggtattaaggccaatgcttttgtactaccttacagtacactgcttattagaaataaaacaccctgtgaatgtaccttccacttcgaagaaaatggacttttctgttgctctttgacttaaaaaaaattaaaaattctctgagcaaaggtcaatggaaaggtagcgaaaaagttggtagaggtgggcagataataaaactgatgagaaagatccattagtttagcagaaccctttatttcccataggttcatgacctgaagattacataggatggagggaggcccttatcataagcctgcaattctgtggctaacaaaatcaatttttaaatgatttatgtgatgtttttcaggaccaaaagagcagtaattcatttcccatgtggtacttggagctgctgcttagatgttgaaaaatgattaatctttatttacagcatggctcccttcatatattactggaaacaagatttgagagtgcaacacttctatagcatgcaattatttgctgaaggaagttccaggcataaagaaaaaaaaaatctactagcagccaaggatatctggacatgcactgaagtaaccactgtgaaaaccttccaaggccaaatgcttccaatctattcagtttgacccacttaacataaaaaagccacattaatttcccaaggggagccactcttctatcaaatcatactaactcctaacttcaacaatgggagaatgaagaattcagaattcttaggtttttgttcccccagaagactgagtttaaaaattttctagaaattggtgcacatagcttacttcaacttaagttgaaatatgtgtgcatttttaaaaattgctataaggatgccttttctgggccaccatatgtagacattcctttcttttaaaactacagaagtaccatattctcaggtctcctattctccatcttgccagcctgagcctaacaggtccaatcacatctaaggaacagtttcacctagggtaaagttcacatttttatgactagctatatcactctgaagcccctagtttagggcccacaataatttgataaggacaggtaaatttccatgtcccttgcatcttgtgatcattaaggttggggtaaagaccttggatatcaaggagatagagtagagactattcttagaccattggaatgagctctgcccattgcttctggacactagaatgttagagggctgtggagaatgatgcgtaatgatgcctgctgttttctctcctatcattttctaggacagattttcccaaggaaacagttaagagagccagactagtcagttacgcactccatactggagaccactcatatgcacattgtgtacctcatccttctccatggatcattgctcactttctctttattgggctaatggtattggttaaactgtaggctgatgactatggaccactattttctgtatcattaaacatggccatatcccttcaagtgggttgtgaataaaattggcactctgcttccaccccaagttggattatttaacaggcatgactggcttattaggaaatagcttgaactggtatgactgaggatgaaacatcttgtcaatacaggttatttgttaggtcccatagaactggatgtacaggtaaatgagggggtgagggctttccctcctgtttgtagtttgtatgtggggttcatcagcaaacttatgaagcccagtttattaagtttcttgggcaaaagagtaggcaaagctgttctaaatagagtaggaataaaagagggctggtaccacaataatggtgaggcaatttcattaactagagtataaacaagaaaacaaagtaacaaggagtttgttgatgtattagcaggatcctggatctttacttgcctgagttatctggatgagtcttttgtctctgggtaacttcagtcataacccttatcatttataagtaacacagggacctgtgctgggaaaatatggaccaatatcctagaaagttagtaacatatacttagtgagtaagcttgtaacacatacgagtgaccaatgttttcattaatattttcctgtcatgccaccattctgtgtactatgcttttcttcttgagtcctgtagttgcctctaagaatgacagtcctgggaaagatgctaattactcaacagagtatttaattgcttgtttgcctcaactcagttgtaagctttgtgaaagcaggaaatatgtgtattgactgtctatcccagcaataattgccatgcctggtatgcagtaactatttgtggaatgaatgaatgaatgggaaaaaattatagattctgtcatttattaatcccctactacagagtatgacaggttgagtgttgtgctacgtgtttcactaaccgtatttttgaatcctcataattctacaaggtagatattattttcctgatattataggagaataaagagcttcagtgagtttcaggtgtgcatcgagcacacaaggaactgttttgcagagagtcccttctctgtgacagtcagggcccctcccacatatttccttgagtagctccctcactgggtatgcaggatgacatgagggagatttgctgacagccacccttttctgttgagcacttatctctcggacagtgggatgagaagaagaaggaaaacacaattgttgaattacgatgggcattttacacattttatcacatttaatcctgaaaagaaatctctcatgctgacacaattcttttaataaaatgagtaatcaaaagttaggagatataaagtgactttctccacagtgaagagccagaattccaattccactccattgtgtgtgtgtttgtgtgtttctttcccctccagtgtcctttgagtgtagtaccattaaaaacttagaatgcttgataatggcagggaccaggtgattcctggtccctacaccatactcactaaagtgaaattcctgaaaatggctctaggaatctccattttcaacaattcactaagtgggtctaatgcaaagtaaagtttgagaaacattgaactaggtagagttgcctctaacatttttcatgcacttggataatactaggagccagaaggtctacaaatggaagaaatcaccctgtaccaagcactggtggtgcatttgcagctcaggatatggggaatgccttggtaccccccattaatgttaataggaatcatgtggataattctctatattccacgctgaaaagtgttccctttaggaccaggagaggctatatttaatcaaaccatctgaaatcctatgtacgtgtataagggcagaaaataggtcacagttggtaggctactttctgggaattattccattgtatcagcaaactccaaagtcctcaaagggctcctgctctcctggctctcagtgagtgacagcccaagaactaagagaggtcagagaaagtccaacacttaaggaaaaaaagttccaatcacaataaaacacataaaacaaattatccccaaaggacaaagtgtggaataaacttgttaaaagctattaacctctcaaaataacacatttctactccagagtaacctcagttgcagcttggagagcagcatgaaattaaggaacacaattcagagaacataaggactccaaatatgaactcatgatgtccaagggttttacaggcactcatgctcctatgaaaaccacgaagatgatgggtctatgagacctgagagagtcagataatctggtgttaaaaagtagtgagtgttcataaggcttccagaactcaactctattatagactaagaactttacttcgtcaatcaatccaggtttttgtctttattatagaaattataggactgttagcttattttaactttataataacatagcttattctaactttccaaagatgaacaactattaagatctagcattcaaactcaggtcttatggtattaaggccaatgcttttgtactatcttacagtacactgcttattagaaataaaacaccgtgtgaatgtaccttccacttcgaagaaaatggatttttctgttgctctttgacttagaaaaaaattaaaaattctctgagcaaaggtcaatggaaaggtagcgaaaaagttagtagaggtgggcagacaataaaactgatcagaaagatccattagtttagcagaaccctttatttcccataggttcatgacctgaagattacataggatggaacattacatgatgaatcttaaagcaagaagaggatatatttgggttaatctggatttgaaccttggtcacgtcttggaggaggaagccactgattgtaagggagcatgaagtgaccacacagaggtggtcactgtgctcagcagcatttcaccttgttactccccaccgctgtgttgcctttctcatggatcactgtgactgttgctgttttttttttctattttattattattatactttaagttttagggtacacgtgcacaatgtgcaggttagttacatatgtatatagcacaaagtaagcagagatatagaaaggtggagaactaaagtcttcaagggcatatggcatgcagggtgaatggcatattttacactatttgctttttggtatgtctgagatcctgatagctccttaattaagataatcaaaatccctagtctagagtgggcaactgtacaaaattcttacaataaatggtcagtaggtcttcaagctagctctcatgtaagctatgctatccctgaggcataaggaagggcataaagccccagaatgactaccactgtgtctatgagacaattcaaaagtccagttttttatgccaggatactttcaatttctccatcataggatcagggaccttccagccctagcttcagatccacagtggtgccagaagcactaccaaggaggatggtgtaggaaggtatattccttttctaatgctgctgtaacaaattttcacaattggtgcaaaacaatgcaaatttatcatcttctagtttgtatgtcagaagtctgacacaggtcttactaggctaacattgaggtgccagcagggctgtgttccttttcggacaatctagaggagaatctgtttccttgccttttccaccttctacagatcacctgcattccctggcctttggccctttcctctatcttcacagtcagcaacattgcatctctctgactgtccttccatagttgcatttccctctgactctacccaggaaaagcattctgcttttaaggacccatgtgattagattggaaccactgaaaaatccagaacaatctcctcatctcaaggacttaatcacaccttaaaagtccccttcgccaagtcaggtgacagatacacaggttctgggaattagaacatggacatcttgggtgggagcattacattattccacttaccacaggtggtaagaggtggtgaggagggaggtttccagagactgaaaagatctaagataagaagctggcagcaggagggagtgaggcttcaggctagagctgtctttccaggacccttgagggagttccggctggttttcctaacgccctctttcattttatcaccttcactgccaccatcgtcatcctggcctatgccctctctcctgaggtataccctaatcttcctcactggtccactgtggtctcatgtactaaactgcttctcctcaggctattttccacacagtagccagagttatccttaaaaacacaatcacagtatgccactcccgtattcaaaactctctaatggctttctgtcacttagaacaagacccccaagcccccctcatatggctgacagagcgtgacatgatctggctcactactcctctctcacgtcccctcccactcctctcccacctcccctcccactcctctcccaggtgttatcaggctccagccacatggcccccttgctgtttctcaaactctccaaaccagcttgtgtctcggctcctgtttctccctctgcatggaagggttgaccccggatctttgcatggttaatttcttcccttcttttcaggcccagatgaaataccacctcctcagagaatttctctgaccacgctcactaaaataccaaccctttctttcactctctaccccctcactgaacctatttttcacagtccttaccacgacctgacattacattatacattgatttgtttgcctattttccacgttgattatttgtctctgccactagaatgcagaagaaaaagtttctttagggcaaggaactccctgggagccaagaacagtgacttgcacattggaggtattcaaataactgttgaatgaataaattcaatgtatatttgatgagcccttttaagtgaaagacaccgtgatataaacagtgaaaagacagacatggtctacccttctttccccagtgtcccacggattgactcattttctttccggagtcaacttttactgatgaccaaagtttatttttattattttatttatttatttttttttagagtcagggtctcactctgttgcccgggctggaatgcagtggaaccgtcatagctcactgcagcctcgatgtcttgggctcaagcaatcctcccaccttagcctgctgagtagctgggactacaggcatgtaccaccatgcctggctatttttttggtattatttatagagatggggtctcactgtattgccctggctggcccggaacgcctggtcgcaaatgctcctcccacctcagcctcccaaagtgctgagattacaacatgagccactgcacctggccaaaacttattttttaattcccaattccatctcatgtctctcctttgttcttattcatttattcattaatccattcaacacatgcttattgagaacttaagctaggtccataatagatcgcagtccctaaaacaagaacatgatcagtttgggagggttcttttcctgatggccattatgtgaagggagataaggagggagaaaggttctacccacactcccactactctctccctcctaccctacagacctcctcttttttccatctgaattcatttgcagacaaggatgaaagccccttagagtaataacagaagctccttaggtaaacaaaatatttcagtaatctaggagtccatagggggctaacactgcagagcctgtgctctgaggactgggtcaggtccctgcacctgtgcagagcctgccttatctgttgagaagctcgcatgagctcaccactaaccaagtcacaacaagcacacagttcgagttcccaggcaggctgagctggcagtgcatcaggcaatgcccttttaacatttttcacttcttgttcaccgctgttcttgcaattctatgttttacttaaagaagatatgctaaataaatggttctaaattagcctgagctaatttcagccttgagctcactctgctgccacagactctggcaagtacgatttggagcactgacacatggcctgtgtacatgacaagatgtcttatgcaaagttagtttgggctatatgtagggacatgcacacactccaaatattcttttgttttgtttttgagatggagtctcactctgtcacccaggctggagtgcattggcaggatctaggctcactgcaacctccacctcccaggttcaagtgattctcctgcctcagcctcctgagtagctgggattacaggcgcgcgccaccaagtccggctaatttttggatttttagtagagacggggtttcaccatgttggtcaggctggtctcgaactcctgacctcatgatccgcctgtcttggcctcccaaagtgctgggattacaggcatgaaccaccatgcctggccctccaaatactcttttttttttttgtatttttagtagagacggggtttcttcatgttggtcaggctggtctccaactcctgaccttaggtgatccacccgcctcggcttcccaaagcgctgggattacaggcactagccaccatgcccagccccaaatactcttaataaactttaataaactaagaagtctaagatgaagcttcctacgaatggatgagtcaagaaaaagctacacaaagttcacatatcctagtgctgctcattaatttgggagaaaaaagcttgatgtgaggagcttgatttgaaggacaaccagtatggaaagccccaaggtactttataggatgtccaagattagatgctatttattaggtataatagggcttttttaaaacaaactcatacctctccacgttttaaaagtgtggcccattaatcagcaattaactaaaataaggttgttaaatgacactacagtaattctaggtcagtctgattttatcctctttctggcttaatgcctcagatagagtgaaactcccgataaggcactcactaaggggcacttgcacaataaagaggagaagcaggaacgaggaaaacatagttaatatgccaagtcctttttttttttttttttccattttagttgagatgtgctgtcagcctctctcttgaccagggagaggtgcttctacttcaccagggggctctgtcccccaaggctgcggcatgtcggtgtttatgcaagggactgtgcccctctctccacagccccagctgcagcctgtctgtcgccttataaaaaaggcatcgagcactgcttttagatcatttcatcatatttgctcatttccttggctgaagagtctggagtcagagggccctcagaagatgtggaacagcccttgtggatggaatagactgggcactgttgctttctagctgtttgttctccatgatcacatttgcatactagatttctaccaaggaaacctgggtacagcatcttatcatatttgtagccccacataaatgtattgagtaatccgaacttgcttattttgtaaataaacacataatttctgggattaaaaataatctaataacagcaaaactaggctgtccagccccacactgaagggcaatggaagttgtgctctaaaattttccagcagtatcagatgaaaagccatggaatggggctgtctctggaaaatgagcatgccagagaaaccgtttaacgcttgtgtgtaggatggggatctgcctgtgtacacttatgcaactcttttgatcatttgctctaaatgctcattaacagacattttgcaaaagatcagatgatgatacaagcatatcaacaggcttccgtttttactgtagggaacccagaaatgaggattgttgttattttctttagaaaattcatttaactgctgatagtaaatcaaaattctacattgccacttctgtaaatataagtgacaagaagttatatatctcccctagagaaagaacagtaaacatttctaaaatttccaagtgctcctacatataatctggttgttacaagtggaggcggcttgtcagaaggtctctctctgtaaatggataaggattgaagctgtgtcgtgtatcactcatgttgtttatcctttatattaaatggaagctatatatagatacaaaattataatggcacagactgcccatttcctaccagcagtaggttgactaggaaaatataagtaatttactgcaaaagtgcatcaaagttgaagcatttttagctaaaatgcaaagctaatcaaattagtattaaaacaattgacaaatggttaaattttcctattcaatttgaagtgaatagaattgtatgctcacattttataattgagttgaagctgttgtattgcagtttttattattatggaacaagcaacagaagtatagacagatgactgagtaatctgtatatacctttgcaggtaagtaactaattatgaccatgaggcacctacaggacagagaggccataagactcaaatttttgttattatctgaccaaaggagagaacttatgttcttaacttatccttaacttatgttaaggatccaaagagttagctgttaactacaagtgtcacttgaaccttaaatgagtatattacttttttcaaacaaactgctctacctatgaagaacaactctgaggtttatctccaaaagcaaagagcaacatattgtgtggtccttagggtagagcctgcgctcatcacattagcaggttgtccgggaggaacgctgggttgaaagctgaaagggctgggtctgatgatgtttttttctttacgtgggttttacatgagcttgagtaacccacaggcctctctgtagtctgagtttccctggctttaaaatgaaggtcatttaaaaatgatcctcgtcctgtctacctggcagagctgttgtgaacatcacatgggataattatgtgaaaggtgctttgtaaactgaaaaatactataatgaggcagggcacaaggcagcactgactcttgaggctgaatgctctgctggaggtcaggctggatggatgttgttggtgaagtggggcatggtggtttcctattccaggcttgagggctgactctcctgcaagtgggacccccgtacccacagacttcacttagtctccttgaaggattcatttgccacagctcctgagtactccatcagtagagttgactaaacaccaaagatgtttatattctaactttcaaaaagtggtatgcagctacttgtaaaaatgaaacatgtgaaatctacttgtctatctaaattttgccagtttgattggcatatttggcaagcttttgagaagactgggaaattgggcaatcatttgggaaaactggaatttgagatctaatgatcagctgctttgccttcttctttcccctgttacaaagccagggcaagaagacaagacagaggaccttctgatgtgctgcctgatctccactggcttcttttggtgaccacatgttccttaactgagtgtctttataagggaggtattgttgaagtatgtggtgacggactgagaaaacaagcagtgagattgttagcattcatatctcacaggcttaatgagaacaacaagcaagccccaaagggtgttaaatagatttggtatattttcctcatttcagagaatgtctattcctaatgcattattctctagccaacagaagaaaagtgcccagcttattccttcttcatggaaactacaggtttaaaggacagagactctcatctatcaaagcaactgagtgacttctacttaaatcaaggccagcaaagtagatgatagaaatattaagggaggttgcagtcaagggcagtactcttctttccttgacttatttggtgtgtttatggtttcaggaaactatcacctctttaatctttcaaaatacatttttaaagaggccattctttttattggacatttttattttaggttgcaagaattctttatttctctgcttttaaaaatctatacttgacattatccatggccaaaatgatttacatttgttgtggacgctgacaaggcccaacttacattctatgagaattttgtggaaaaaacttcaccttttgtgatggttcaacttagaaaggcttgagtcgaatgaccaaggttagaaagtctaaacagaaggacaatgagattctatgtatcagcctaaagatattcatctgaaaaatatgccatatgtaaattaaaaacaatgatggaatcctgctgcatgaatatcacagttcaaggtgcaagaatagaggaagagaaagttactataataaaaaccataatatatggtttatacttataataacacatatttacatggtatggttataacacttgctttgtcagtttgtcactctgacaagttacttgccctctctatgcctgttttttttttatttttaaaacagagatagtgctgggcacggtagctcacgcctataatcccagcactttgggaggccaaggcgggcgatcacttgaggccaggagtttgagaccagcctggccaacctggtgaaaaaccgtctccactaaaaacacaaaaattagccaggcgtggtggtgggtgcctgtaatcccagctattcaggaggctgaggcaggagaatcacttgaacctcggaggcagaggttgcagtgagctgagatacgaccactgccctccagcctgggcaacagagtgagactctgtctcaagaaaaaaaaccaaaacagataataataaaataatagcaaaagtagctaccttataaggttttcataaaaattaggtggaataatcactgcaaagaccttagcccagcatctgaaatgtcataaacagtcaacaaataatggctgtaataaaatcaataatacttatcatttgactacataaataaaccaaaaactaggaacaaaagcaatatacgtacatataaacatatgtataaatatatatatatgtgtgtatatatatatatatatatatatatatatatatatatttgtaacatatggttgcttactatgtgcagggcactgtcctaaggatataaaagctttacatctaaaatgtatttaattttaacaccaacatcataacataaatatgttgttatccccattttacatacagagaaaccaaggcaaagtaacttatgtaagtctacatgatagaactaggatttgaccaggttatctgtaggtatctcagtatttcctgaagtgactgaataatttttttgtttttataaccttgtttatcacatcactggtttttacacttttaatatacaatggttatttttgtagacattaactctataatttatttacctgtatctctaaaaaagggcatcacaggctgggtgcaggggctcacacctgtaatcccagcactttgggaggccgaggcgtgtggatcatgaggtcaagagatagagaccatcctggccaacatggtggaaccccatctctactaaaaatacaaaaattagctgggcatggtggtgcgcacctgtaatcccagctacttgggaggctgaggaggaagaattgcttgaacctgggaagcggaggtggcagtgagccaagatcgcgccactgcactccagcctggcgacagagcgagactctgtctcaaacaaaacaaaacaaaacaaaacaaaacaaaacaaaaagaaagaaaagccatcacaaaatgataaggggagagtagagtaactttgcatattattcattcacatgtgcaaataaaaggatctaatgccaaatgtgggcaaagcgacatacctcagtgtgagagagtaagtgctggaggctaagggcattgtggtctctccttcattttctcttatgaggcacactgatggggtacgtggacttaggacaagatggcacttcatctcgcttttctttctgcataccttgctcttagtcttctactaatgccacaatgaaaaaaacagaaacccccacttgacatctaaactctttaaaaacatgtaaaatttaaatcagtattatttattaaaaggttttttttaaattattatttggtaatgatttaccctaaaattttttgacttctcttcaaagcccagatgcttaaatattgcttactttgggtcttaatggttattccagagccatggaattttaaatttgatctcagatttttaagatgtgacagcttgattattttacaaggccaaaaccctgattcaagcctgcaattttaagaatcaaaactgttttcccattgatgaagacattttgaaatgtgtggtccatagctatttatgagtagtttacagctgttgtctctttgtgcccaagaccatggagaatccaggagccgatctgatcctcctgggactgctattaatatcactttcactttagacagctttgccttcaactagcaattttctggctcccttatactacattgtagcctcacagcattcaagcaggcacagggcacttggacaatttagcaataatctataatacagatttttgaaagaagcgatttgttcaaatgctgctaaaacagaaagtggctcttgaataccaaagtgggtgccagaaactgagaaaaaattccttaaactaggatctttagtataaggagaagtgattagaataatatcaatttggggcactgtgacatctgaaacataatggaacaattcctaattgttattgaggaagaaagcaagacctattaaggcaaaccaaccaactttcattgcacagggacataatttcggagatgctatatttgattccatgtttgatagggtctggcatatctcttcccaagtgtgctctggaaatcctatttcagtccttcttttaggggaagaagtcattacatcagccttgtaaagtacactggcatgcaaagtaaaatctgttactagggtgaaaagttggtacattctgtttttttgaggggaggtgagctctcacgtgcccccaacatgcacagttcactaaaaatctgtagctcaccaatctcctattgtatgcatttgttatttagtcttcagctctcctacattttctttgtttctttatctattaaacttttaaaaattgttccctgcctcttttccattctgattttaaaaattctgattaatatacaattgcatctgtattggcagaccatgtagatacagcatttgtaaattgcaagctatggagtacactgaataccatattaaggagttagtgaaaatgaaaagaactttaaaccctagccttttagatagatttctgcttttaaagattatctctggattgcaaaaacagacatgaatattgatagtgtaaacctgactaaaatatgactctaaaatatgaatgtctgccattataaaagaatctaatgataaaacctgaggaaataaacactaaaaaaaaaaaaaaaaaaaaaaggttgttttctcttccttaaaagtcctgaaatttaattttaccattctgtcacaggataaaacatctgtcctaatggaaaagtaacaaaaacccattttctgaaaagccccacagataatttttcacatgagtacatggaaatatctattccatttttggataactattctttcttgatgtaaaacactggtggtcaaaatatacaaatatcacatttgccttcaatcataaaactctgataagcacacaaattgcaataccatcatgctaaattaactaattcatttattaatcattttctttgaaagcagagtgacattcaggcactgggaatgctgaaataaaagattgaatccctgccttctggggtcttacacttcagcaaagaggtcacacatcaataattaatatatgatgtcacagatataaatacagaaatgaagtaaaaagagacaatgaatccagaccaaaagtttcaagaaaggctcctaagaagaggtgacatctgaatggagtctttgaagaccctgtaacaatagccaggcaaaggtgctctaggcaggaagaatgttttgtgcaaaagcagaggtgggtaaaacatgacttcagttctctcaaatagaattaatcaatctctttatacagtaactcagcacgttgtctgtacttctgttagcatgaatagaatgaatttttattgcttatctttcctggtggactgtagcctactagaagcaggctgatacatctttgtacctcccatttgtcttgcacttataacttgcctgcttagttttgatggaatgagccaatgaatgacagtaagatttcacaagagtcacctgtgaaacatacttcaccaaagcacccatggtagcacttattaacaaacggagtttaccagggatggggcagaagaaagtcttagcttttcaaagaatttcattcctgagacatttttgtggtcatgtatttaaaaaaaaagggttgggggggtgctctgagaaatgtgctctcagatggcacagctggaatgagagaaatgggaactgttttccattttacatagtttctggaaagggcaataagaacaaaaaaagcaacactgttggtcagcattctcagtgcctgagttgaaaggtgctataaacagagaaaagtctcataggccaactctatgcaggctatgtgccaagaatagctacaaagtggcaagttaaatcagccagggcttgtgagctgtctcaggacttgagtcccaacttgcactcgtgaaagttatgctgcaaagggagctacctttccccagcactgcctggggccttggcaagtctaatggagaatgagtttgatttcaagccctgctcccttcaggcaacttacaaagaaaagctgttaagtctgtggagctgggaatgtctggaaagagtgaagacccatcatttaaaactgatttctttttaaggaagtagagcagagagcagtgattacttcaacacccattctcaggggaatttctgtaagccggaatcagctaatgatggttaataaaggtaaatgttccctgattctcaggaagtgattcttcatcctggggctttttgaagactctgtcttcacttgaattttgggtggaataaagccctcctggatttatcctaatctaatactcaaagttggtagttcacaggagtctgtttattcttctagaaaagtataacagtggattagctactggcttctatcccttcagcacagctcccccacacaagagcgtacctttaatgactgatgctggtgtatcaaattgtgtcctctccttctaataacaaaataatgaaatacagtaaaatgccactttttctgactttttttttcttctaggacatgtatgtttcttacctcattcagaggcatgctgggaaatttaactaaatctgaaagaaaaacattctgtaaatccttaagactggattagtaataaggagtaatttctgatctggaataaaatccagaattcagcttgctcaccccagacacaaaacacaataaaaagaatggttgttacagttactaaacgaaggatcttttcacactcagcaagggtaaagactgtctcttctgtatctctgtattacccaagacattgagcatccatcttactgatacaaaggatgtctagtttgaaagtttgcctatgtacatttgtttacgcactcaggcatatacagactgccaactttattattacccaagattaaaaataaaaaatagaccttgctctcaagagatttcctttccgttaactgcaatgctaagtgagatgcatcagtttcatttttgcacgctcctttgctccgtttagtaccgaaataaaaacatgacgtagcttttggggccggggaggaatctcattcttgcaggaaataattgccaggaattttaaagagtgtcatcattttctctgtgtccagtcctgcccagtaacagagaacagctattaaaagtatccaaatgctggctgcaaggagaagttgaactctgaaccactataaacccaatcagatgcagacattcttcccatcccataccccggactcccagtgaatcttgaagaccctggggttagccttatcatttattcgtctgtatagtgatggcctgtgctaatgcccaaatgatcctgacttattaaaggttcttcctgaaaagacatgatttttattagttcaccacaacttattctcaaaaaagcatttattctttatcaagccacaaattttacttaattaactattctactagattccaagacgatttagaagctattgaggttgtaacaggataagagaacaactagtccactctgttaaaataaaataaaatccaaaaacattaaatgttttcctttttgttctctaatgagaggtagaggatgtgaaagtgaagatacagtaaggctagtgtttccaatgatttcatgacttctcttccagctatgctggtgtcatagtaagagcctgatgctattattatctctgattatttgataaacctgaaaaacaagttcaacaaatggtaaaacatctggatctttgacagacaatggcttataaaagagaataacgaacagttatttggagagtattaagacccagatggttcatcagggatcactttaaaggtgtttgttagatcctccctctcaaagacacctacacaagagtcatcagctgccaatagcactgagaagattttcacatacccagcactgtttttgtgacaaccctttccaaaattacgaaagaaaacaaaaacaaaggcaaagcacaaagaggaaaaatgaacattgcttaattttttcttgcacccagtgcttgaaacgcatcaaagtcagagctccatgctctttatctcagctcactgcagctgtcctttctgccaaaagcaaaacaactcattctctagaagaatctgaatgcccactatatccttgacagcgttcctaacaatagacgccgaagatagaacacggttagactttcattgacaagaaaggctggagaatagagaattgtgatcaggcagaagaaaaataaaaactggaacagtcagtggtctggcatatctactaccccccaccttttatttttctgaaaagcaaagctgtattttggcagagtccagaaaaactaggcttgtaattgttaatgtagttctagtggtttaggagaagcagtgggcttggccgtattatggaatgactctgcaaatatagctcagaccctaaggaggttaatttaaaaaacctatttcttatctgtataaagtcttgcacacgaattacattgtttccattttctccaaaagtgtgctttctctctctctagatatctgtatctatagatatagctatctataccaatatatctctataagttgtttatatctatatgccaatatctataacatatttctctctatatataaatatatagagacatctctgatctcgctatatatttagagaaatgttatagatattgacatatatatagatctctctatataaatatatatagatatatacatatatttatgtatgatatatgatatatacatacacatatatttatatagagagatctatatatctatatatctatatataaatgtatatctatagatatatatctatagatatgtatgtatacatacatatctagccaacaatatatatagacaacaatatctataacatctctatttatatatatgttgttatatatattgttatatatctatatatagatattttgttattacattatatatataaattaaattgaaagcttttggggaaaaacatatataaatataaatataaatatatatatacacacacacaatttctcattttttgttgcttggtcttattctaaattcctaagtgtagtctgccactctaatctcttttcccatgaagtttgtcttagaaatgtcatccgtgcaaacaacggctcaccaaggacaagtgctggtttatgcaattgagcagtagaggatgctgtatccacttcttcaagaggtaaaaggagctgatttctgcactcccagggatgagcaagcttcatattcatctgatggttatctgagcaggcactctcatgcattttgatactctagttttataaccagagaatgtcagagtcaataacatgattataagccttataagtcatagaatacagcctctcacacaatcatctttgaaaaatggtcagctggactccaggaacagagagatggcagcattgcttccttcaagagacatttattaagcttctggtagcaactctgtgaattgggtattattgtcctcattttacagatgaggaaatagaaacctgagaagatcgcagttagagacagacaaagtgggatttttaacctagggctgattccaaagcctttattttttgatcactacaatatacatctgacagacgttctctttaaccctttcaagactataagataagggttctttgtaaggacagacccatgctttcagtagtaaacactgtgtaaaagacaagagcatcataaactatggggctgatttaggcagccaatttctagtgttttctttttttgttgtttgtctggttctttcacattctctctctctttctcccatagtatagcaacaattggtctaaatattaagctttatctatgtcaccccacaaatgctgagtgtgattcatccaagtctataacaatggtagagtggcccattaccacagacagacaagaagaagatagcagtgtttacacatgagataatttggcttttctgctaagccttgtgtgccaagttaattactctcttggtgaaacaaggtattttgctcatataaggtagggaaacttgcagtgcttttggttttgttcatttctcttcactagtcattcataatgtggtttttaacaacaaaataattagttaactgagatagaaatgaaaatcacactggtccctgtgcataaaaaatatatattatagatagaactttgtgcttgccatttctttctttcatgttgtttaataacagagtattttgcctgaagttccttatatgatcttctgattagagaataactgccaaaatgatgtttgaaatgcaagtagtatggcagaaaactcttaagaggaaaatgttaggaccagggcaagtgctccctaggagccagagttcagaactctgggctggttctctgtgctagttactgctcagtacccagtgcctagaatagtgtctagtacacgacagacagtagtagctaatagatgtctgtccagtcaatgaatataattccctactctggtgcctgctgcagcttccagaggtggactctttcattcaaactatttttactccattttatcttcaagagaagaggcttcactatagggataaccccaggttcacaggaaggcatcttctgttcagctgttccttattcaagcttccatactgtcatctatacaacaaatcagaccaggatatgaaagacagagggcacctcctctaggttgccattgccttaagaccatttattttgagaggtaaccatgcttgagacatgcttatgttaagactactacatgaattttatttaaaatgcaatccctgattgtagaagacagttttgtgaccagtgaactccgtggatcagcctttgatggacaaagagaaaagacttggcttcaccttaacgactggtctgtaagataggaagtttaagttctaaggcaactggactaaaggccagcttaagaaacaaagcaaaccccttacactggtgtttctgttccactgatgactttctccatggtccggagctgatggacagctatattcacacacactcttcacaaccattctgaaagtaattttcagctgcaaccaaacaaccagggacctactgtgtgacacatggagcaattgataataccagtgctctatggatcatgttgtcttatacatcacatgtgcttgattggtctgatcaaagttatgattgaaccagctctgcacctgtattcgtccttgcacgttcaagtgaaagatgatgcaaccacgacaggctggaatcaggcctttgggccatctgagtgcaatttgagacatggagttaggctttaagaatgactttgagggttctcaagtaatatccaccctctttcacaggagtaacaggtcacctacctcccatgaaaggaatttaaaacaatttggaactcagtaagcaatgttacactcagcttgtctgtctggcagagaacactaaaaaaatatgtaagactcatcatgttaccagtctgtcagtaaatatttaccaccttgagacaaaagtataatattcagcatttgatgtctaaattagtagaaaagacaaacacaaatataataattagagaacaatacaagcaagtttaggtgtagaattcagtggctggttgagatgtcagtgaatcaacagcttagaaaacagctgtgtttccaaaatatgttggcagcagtctatacgtgttctcagtgatgtaataggagtcaggcactcacagaagctgacattatccataatgaccctgaatcatagacttcagcatgcaaactcatgatgttctattgttccaataagaataatatctgggatgccagacatacacctgcccaaagctccctgcagaaggcaatccaattcctcattctttcagcggacttggcagaggaatgatgtgtgtgtgtgtgtgtgtgtgtgtgtgtgtgtgtgtgcatgcagggacaagggggcatcttagctcaagcttaccatactgggaggacagggccatgaaggctggagtgaggaacaggggaggatgagggatagggactcagggatgggaaactggcatggggctctgcaagcagtgataatgaagagacatcctggtcctagagggcagagaggaagcgtgggaactgaaggcatttttccctttgctctgctgcttgtcactcacaacaccctgcctcaccaaaccccagctctgatcagggctcctgcagggattctggaaagaggaagaacacgcacgttatgagactttgatgggtattgtcctgaagcaaccaggaaaataaaaagaagtaaattttagtgtgaaagcagctcctggtcctttggcttggaaaccacttctgctttccccttctgctgtcctgatcctcactgcttccctgcagactctgcaaaccttgcatactgcttcaggcaagagggtctgttctggtaatacaagtgccttggggtttgcattcatgatagtgttttcatgaattttcatctaaaaacaaataatagaccccctcaagaattgttcctaggatttcacacatatgacctgaaactttaaaatcaacttttcacctgctgtttttatttagcagaatcacattttaggaaagctaatcatttgctatttaaaaatctgaaatagagataaggttttacaataggcttcagagggaatacttgctcaactaaaggaaaagagaaatggcaggagttccaccagggatgatctggcttcagtgcaacctcatcagtgtgagatattcttgctggtcatggcttggctaatattctccccagcccctactcctctcccctccacttctacctcagctgaaacacccaagttgaggaaaacttcacagggagaataacccctgtgttgtgctgcagccagttcatcctgggagtcagttatgtatacctctccccagttctgtgtttagtgacttcatgttggtggctagaaatcatccgcatagtatttacatcatgggtataggcaagtgctacaaatcaggacttttccttggggatggatgtttggagctagtttaccagcacaccagtgggtaaaagtgaacaaatacttttttgatcccacagaatcttaaaaaatactttacttcgaaaatgtctctactaagtaatcatatatatatatatatatgtatatatatgatttttttttttttttggtagagatgggatctcataatgttgcctgggctggtctcaatctcctagcctcaagtgatcctcccaacttggcctcccaaaatgtcagtatgttgggattaggcgtgagccactgggccaaaatgaccatatcttttgactggacaatattatcctatgttctataaaccatattagtttcagaactaaatgtaatgctaaaatacgatgactgattcttttttttttcagtcaaatgtattataaaacttttacgcaatatcattttccccctttggggaaagtagagggatataagctacaaaagaataaaaaagtaggtagattaaccaaatcctgttttttttaaaaaataagttactttgacagagtctgctgaaaaatattgttaaactatttgtaataatatttctggtctggttagaaaatttattagtttatagtacaatgcaaagggaaaaaatccaacttctctattcaggttacaaatgtgatttcacatttgggagttgtgagagaaacgaaaagaaaccttaacaactttcttgccagattgctttgaatccctaaatgccttattttgtagccagccattggaattgagctactgtctccagacaatcccattaaatatatattggttccctagaaaggtaacaaaaaaaagttattaaaaaaagaggaaacagcccagtgcagtggctcatggctgtaatcccaacactttgggaggctgaggcgggcagatcacttgaggtcaggagttggagaccagcctggccaacatggtgaaaccctgtctctactaaaattataaaaattagaggggcttggtggtgcttggtggtgcatgcctgtaatcccagctactcaggaggggaggaagggagaattgcttgaacttaggaggtggaggttgcagtgagccgagatcgtgccactgcattccagcttaggcgacagagcgagactcagtctcaaaaattaaattaaattaaattaaattaaattaaaaaataaggaggaaaaaatgatgagattagcagacaggaatgggagatgaggaagtagattagaagacaaacatattttttaggtagttggtgctaggagaagtcttgagcaagtgtttcattggataattaaaaggcctgtaatagtgaacttaaaatgacataagtcaatttggcagggaaaggaaggaggaggagtttttgcttattatttagtctcaggttggactgccacctaaactgttggttccattaagtcaaggagaccccatatcctcttcattactgtgccttgcaaggtgcctggatgaaatgaaagtgaaagaatgggaaacgcagtacgaaaggcaaataactgcagctgaaaaaaaaaaaaggtttctttgtttctttgtttttatcttggtttagtagtttcaggcaaattctgtatcttctagttgacccatatatagcactgattctcacaaagttcggagatagcattagattttaaacttcattttctttgcacaacaatttattcatccccttctatagaatatatgcttctagagaagcaggtgcattgtctcaaagaaaaagacggcagcagagtctgggccagatttaccataatgtgcgtcctgggagatcttgctgctgtcacatttgcctggttaactatccataagtccatgttaaatactcaaaaagagaattacagtgaagaaaaatggatattttaaaaacagtggtatctttttttggatccagaaaacaaaaagtattttatttgccagaggtaattttatgtgttagtcaacaggatttgaaggatcctaaaatacccattactacagctataataatgagtaataacaactttcttctctttatttcttagatgtttggaagtcctatatgcatatcccatatggatatttcagtctatataggtatatccctgtcttcccttttgatacataccagttaaaaaactgaacagaaagtttcaagcaaattggttaaactctaatggattcctctggcaactttgatgaaaaggtttatgcctatgacagaaaagtcccatcagtgggcaaactttctagacataaaaattcaatgtaatctacagcaggtaaattttatgtcaattgaacatcaggattggaatttctggtaggtgtctagtgatcatagtacaaactatagttttatttataagggaactggatgtaggcgacttctttcagtcttcttatcacaatctttctaagaagacccttcttttcagtcatgaagaagctttgtgctgttgattattaggagtattttctcaaacaaactttccagtctaaaatgtcaagccacagatgaatattgagaaggcttgtccaaagtgttcaatcagtgattttgagtttatggaagtcactggtatgatgacacagctttatagctgagtttctcactgtgttcataaaataaacaatttaaaaagtaaatcaatgctttgcatcaacaatagaaagataagttcccctgctcatattccgaaagtttcctaggtttcaagctgggagttccttgaaaaagcccagggcgccaacagcatgatgtgatccgctcccatttttagatgagtcactaggacagttttactcaaagaggcaggggtttgtggaaagaggagtggacctctataaatggcataatttgaatgtgcattttgaaaatgccacatgagcaaacttgcccacctgccagtccagagaagtactgctaaaatcacctctgaaagaaccacatgatctcaaatatttaaagaataacttccaatgtctctcaatgcaccttttgttattttatgttagtgcatttatccattggatttttcagttaatataaacatttttatcatattttcattagatgagctaaaatggatgtactcttaaatttcactgcgaggttgaagtcatattcagtcacaacaccctgagtgctggacaagacatctttactttttttttttttttttaacaccacgagctctaaatccttccaagatacaaaccattaaaagcacctttataatcaacgtatgtcagagatctaacatcatattaacttctagcacatgcaggtagctaattattattttatttctagtctttacaagtacatggtcagttaaatagaaaccacataaagagtattacaagtggtacagtggaaagaaattttaaaaagagggaggaaaaactaaaccatgagaccaatatacagggttcttctctttctatgacatatgtgctctcattagggcattgacaaaagaaaatatatttttcagaacttttgtacccctgatgctaatgtacacaagagaagccatcaaaagcctactgctgacaagtcagactattgatccatcctgtctctcatgatttcccctgcctcataatttgatggccttttggaggcgtggacaatgaaactgccaaacaaacagggactctcacatagagctttgggctttgtctccagtgtctaagctagatttttgggttatgctgctgtggaacagctgcttccagagtcacccctctagagacatacttggtcacctgccaggatttacatgattatccatcatggggacaaatctatcccaggaaggctcatttcagaatataatacagtgtggattgaagacctaatggagagaagtgcacccacaggagtgactgtgatctattaaatcagtaagaccttggaagccttctgtcaactgacttcagaaaataatggttcccctctcaacacaccactgtacttttttatttgtcttttgttaagtcatcctgaggaaaaggctgctggactgggagatttaagactttgaatagtgctaacagaatagaaaaggaaagttaaattacgctgcctattctcttaccaaactctgtaataacaacatctattccttcatctagtgaactgtcaggtagggcatagagaatacgcatttggaaattgatctcaactgcctttgagaaaccatagatcatgggaaaagaggacctgtgtgcctttccatcttaactctggatcactctgctcctcatttcagaggccttctttcccttcttagagtagatcttattttgttgttgttgttttctgccagaaaatctttacacatgctgtttcttcttccttggaatgcttttcctccactgttcatttgcctgaacacctaagttaactcaggatcctcctattcaatgtctattgacctcgttaatttttatagcattttctcacaatctgcatttgtacttttggttcatctaaaagtctcacaaaggcatgaaagcctcacaaaggcagggaacatggatgctaacatgaagtaggagttacataaatatttgtcatattaaagaattttaaaaaataaaagtaaataaatgaagactgcaaaaaattgacagccataactctggattgtaaataaagttgtatattgatgctgctgtgtccagttaaataaaccttaatctaaacttggagctttagagtttgtatactagtcactggaagtttcaatcattcatgttttaaatcacatttttctcaataggagcatatcctttaggtaaaatttaaacattgctctcttcccttaatatgagggacttaatatctagctttacagggctttttaagagcaaggaaaatcactctattgatgctaagtgaagggcagagaaagcaactctattaagcttttgacctagtttctctctggttacttcaaggcaattgaaaagtcctcgattaggtgcaatttgctagtgactattctactgctatcagtgcagaggcatatagatggaatagggtatgtagacttatctatggtatattcatttacataattttatgtcataaaaaacaaaaaaaatcaaacttgtaacattactgagtcagtcgtaaaacagagtatccagatgttattttagaaacagcattgattgggcgcaaagatcaaggtgtatatggcagctttagtgagtttggagtatagaaagtgttgggatcaacagaatccatagcaatcagtttaaagttttcaataaagctatgaatggtaagagggaaaccaactagaatttgctgctcattcacctcaaactgcactgagatatctttatgctcaaaatggacaaggagactattatgtgtattctttgatgcagcaatgctacttctaagagtttatcttacagataaagtttcacaagtgcataaagatttttaatgcagcatcatttttttaagttggaaacaacttaatgtccatcatttgaggttccttttttcctatcatattgattatttgctatctgccaggaactgttctaaagcacttttcacataataactcaatttgtcttcaaaacaacaacaatcttcagttactttccctactttaaagataaggtaaagtaagttgtaggggaccacagaggtatttagtggctaagctagggtttgaattcagacagccattaaaaaatgaagtagacccaaacttactgataaaacacctagggcatatttttaggttgaataaaaaagcaagttgcatatatatatatggggagagagagggagagagagagggatacattccttacaaaggtctagaagaatctgttcaaccaagcgtagtcacctcttgcttataagcagatgcttgaagagaactttccccttttactctttaaaaaacatctcaatcattttaattttatatccttaaatgttaaaaagttatgtatgcctggttttataaaataaagttaaatgcaatttcacccccactttaaaaacaataactaaaaaggtatagcgcttactgttcataattttgtttcctaacaattaaaacatgttattaaggaattcaatttaatatggtctatagtcacatgtacgtataatctgtatgtagcacatataaagttctgaatagatggcttccaccggggtgacaaaaggaacagaaaaaagttatactatgttaagttcagaactttacccaaatatctttagacacacagcataatacatgagaaaaatgataactacagataatccataaagttgtttaataaagaatggattgaaaagttatttaagaaacaattattattttttttttttgatgcaaggtctcactctgtcactcaggctagagtgcagtggtgcaatcatggctcactgcagtctcaaactcttgggctcaagtgatcctccagcctcagcctctggagtagctgggactacaggcataagccaccatgcccagctaattttaaaaaattattttgtagagcctgggtcttgctatgtttcccaggctagtttcaaactcctgggctcaacagatccttccgcctcagcctcccacagtgttgagattataggagtgagccaccatgccctgccaaaaaagtaacatattgaatgtaaaaatcataataaaagttataatgatttggtgtatactatgtcattctaaaataatttgtgcatttccttctaaatatctatctataaacattagtaaagaagtgggaaatttttttgtcctgaaattcattttacttaattagcatcatacagaaagtcatttatgtgccagatgctaaaagggaggattacgatccagcagatattgatcataagaatgaaatgaggcacaagaaacacctgtgaatcatgaagtattgacgctggattttattaactcctatatagtgataatgtgattgaaagattatgaatcctataaaggaaatatatttaacaagtccctactaacaccaactcttgactctcagaccatccacaaataatctacaattagaattcattatgtctaaagacagctatcattaaaactgaaggccaaaatcgccctttctgcgtacttctgaaagagcttgcctttgtgagcaggaggagaagggaagagagacagtgtacccaaggaaaggagggtgttggtggtatagagagaaaggcatttctagcgcccaggcaccacaatgagaatttgagaattgtgtttattgtctatagagcttgttattgctcttgggtttttggctacaaaacctaataatttactcagttttgcaaggaaataagaaatgggcctcaattcactctccttaattcatttagttggatctgatttgcaatgtatgttagtactccttctgtagcaactgaaacatattaaaaatgactctagaaaaaatacatgctagaaagtgcttcggttactttttccttaactaggagaccccaagagggaaatgactaggtctcaaaatttctaggaatgacatttccttcttctgagcaacttgaaggtgctacagaccaatggaatataagggattcattatttaatgtacaaaattcaggctgctgctttagggcaaacagaaaaaagtcaaaatttgcctctatatagaaggctaaaaacacttttaagaaataaagtaagtcatagggaactgggcataattgaagttcccaaagccaaaattttcccttttttatttgtaatccaatttgtggtacaattttcctaaatcctacttctgattatttttaaatttttctttataccaaataaaacaaagttaaagacagaactctgctaaaattttcaatgtaaataaaaattaaatcatttaataaattatattagttgtcatgctatattttatgtttactcttgttatgttttatttattttatgtttgactaatcccccatcctgtgggaaacgtttgttgatgctgaaattgccatgagctatctttgctctatttcctttacttatgtcatcatcaagttcaccaattaacctatattttcacccaggtagttgacaaagcattggatgcacctagccaaggactgttctatggctctccactagaaactccctctagaccaggctgatgtcaagccatacacattaatgataatggtaatgagctacataatccagccctccttgacctcatatttctacatctgggtcatgtgactataattaattttttttttcttacatgtcttggtgaactgaaggcacatgatactcatggtattctcctgatcttaccactaggcactgtgtcaaaagacatagaaattgaaactgggttccttgagagcagacattatatcctattcatcccttaattctgtttcaaaaccagtgactgcaagacacagaaatacatgttcaataataaatatgtaatacataaatacatgttcataaactattgggagagtctcaggattttgaaaaagttgttttgtagtcctagctatgccactttcttgctctgtgactctggacacatttcatagtctccaagaacctgagttctaaatctgaaacaaaaatgtactgacacattttaagattctctttcaggcataaaatcctacctagatttatcatttccactgtgtaacaaagtgggacgatgacccattttttgtaactcagtagttttctggaaaaaatttaaaatgcattttttcagtacatcaatacatcttgagataaaacattgtatagtctctactttgtgtaaagcaaacattttcattacttatctaaagacttaaccttctttataccaatcatctgtaagtttggaaaaacaatgcaattgaatttttcatccagctgtttaccatacataacttagaaatcctaaaatgccttattgaaagtgcagtgattttagcattggtagagtaacagtctcaagaaatgaatgaagctttaatgactcatcttcaattcaagaggaggggctactattataaaatgttaagctgaaaaattccaaacacaactgagatgaagttacatgatttaacaatctgttttttgtttttttgaaataaagtctcactgtgtcgcccaggctggagtgcagtggtgcgatctcggctcactgcaacctccatctcctgcgttcaaaccgttcttctgcctcagactcctgagtagctaggattacaggtgtgcaccaccactcctggcaattttttttgtgattttagtagagacagaatttcaccatcttggccaggctggtctcgaactcctgaactcagatgattcacccacctcagcctcccaaagtgttgggattacaggtgtgagccaccatgcctggtctgtacatcctaaaaaaccccagtgttctttctgctgactgaggctaattagtgtgggtgataaaaattgggcacacatatcaaacacaaattggctactttgtccagcaaactgcttccaccaaaactccggctagcaatcacattacaatgactacttggctcttttctttccctaaatggatttggttatagaattggaaaaccgggtatactttgttttcaacagattaaatgtaatgggttttatgaagacagtctttatattttcctataaaaaaggtaattagttaagggattttgggggtaggagaatgaggcacacaggggagtactcatttcaggaaaaataatacgtaacaaaatattcacaaatattctgctgtccctcaagctgatgaattaatcttctcgattagttccagataaatcctaccatttaatctattttgaaagaaattagaaggctatggttttaacactatgttcaagttttcgctaacttgtaaaatggtaacatacgtgctgtaaggatgacataagagatggtaaaggaaagcatgcagaaaactgtaaaagcttataggattttaaatataattgtacagtaactaatgatggtgaaataaaatagatgttccttgatttagaacttatggatgtttctgaagactacatagaataaacaatttagatgttcacactctggccttggccttatcaattcgccttcccctccttgctgaccccacccctttaatctaactccccccaaaagtggccacatactgggagtaaagagagtggcaatgaacctggatctacttggggaggaggcctcggctattcaaagagtaagaaaaacacaatgttccaggctcctgattctcaagcaacacagttacttggggtatttctcaccaagtgacctggatttgaggttggcaagtgtcgcacaccccacctttctgggtggcagagccatgtgaggctgttgggctgcacctaccagctaatggctctgtgactctgtgtcacaaaccatttgtttctacatctcctggcatcaggatccaggaaagatgtccacactcattatccataaagggagttgattgcctaagtgatctgcctgcattctacagagtggagaaaaacttattaaagataggtttagtcacaagattgcactgtcagcagtcagactctcctcctttcttgacttttctttccctcatgctctaatagaattgtggctgaactcatctcctacttggattatttgtcttgagttgaaggagccctggaagatctgttctgaaactggatgtgacgttaggaaggcaaaggagatttaaagtgacaaattgctggctcaattctcaggaagaggtgctgcagaggtgatgtgcaaacatttggacttgtaagggtgatgatccaggaatctggggactgggttctttgcctaaatcctcccccaccttcaatgccattgctctatgctacacctgcaacagcttcccatctgcctctgcccaaatagcctccaaagtggaaatgcagttcggtgaaagagagtttcagcataataatccctgggcctttttctatacttaggacagaaacaaagtgaattgccaaggagcagacctctctccctactaatcggtttagagttgtgttgacaaaatagtggcaaaatctccagaagaatctccctatgagcctccctgagcctcccaaactcctgcatcccatgcatgcatagatatctctatcacattcctggcttttgggaaaggaattgcgcatacagcaccaatacttccaaagtatttagaccttcaggctatcactgtcctcaaagtttcaggttccttatccataaaattctgaaactgggccacaggatcttctaagtctgccaacccagccctgagggcccatgaagatctatgctgcttgctttggtgacaaaaataaaaataaaaaacaacagttggggcttgattccccatattaaatatatgccaagtatatactaagtatatgttaagtacaatgctaagtattatcttgttccattcttactgcaatcctataaagtcattcttgttatcacacccatctgacagatgagaaagcagatctagacaggtcacatacctaatacaaggtcatgtgactagcaaactgtggagccaggatgtgcttcactgctttagaagttcgagtgtttaaaatccagaatgttccattccataaaaaaaaagacattctacatttcttatttgtttcgtaggctggcccacaaaaacaaagtattgtttcgtgcctcagcgtaagtctgaaacaagacatgcatggtaaactagtttcttgagccccactgtgcccttctgaccccaggaattctccacagttcaaacctcagactcatgctctgaggcttcaatttcaccacagactagaacttgagctcagattttggagaccagaaacctagcccttctggccctaagaatgacaagcctctccaggagcaaagtcaggaaaaggctgaagacaccagcagccgttgagaaattaatcgagctgcagcagtcattttgctttatagggtatcttttttggcagaatgatcttaaaaatccaggacaaagtatttaaccaaatatgtagagcaaagaactgtgatgagttaccaacacatttctcacactagtaggttaagatgatttacttgatatttagtaataatctatacgtaattgtcctttttatgaggatagggatatttcaaggtgaaaagaggtaagaaaatgtggttgatccctacaattttttggatatagaggaagaaaaacgttcaaggaagttcagagggctgaagataggtggtcttcagctttgcatcttgatttttgcactaactagctccatgacctgggataaaaacaatgataaaaatagtgataataaccttcattcactgaattctatgtgctgagaatttgctaagtgctctatatgtattatttcctttaagatttaaaacaacactataaactggatgttataagtcccatcttagacataaagaaactgaagttgaagttgtgataacttgtccaaggccacaaagctgttagtggctaagttagtattagaacataaatatgaatccaaaacttatcccaactgaatctgaactgattaccttcaggctataactgtcttcaaagtttcaggtttggaaaagcctggagggaactggagactattattctaagggaagtaactcaggaatagaaaaccaaagatcatatgttctcactcataaatgggagctaagctatgaggatgcaaaggcataaaaatgatacaatggattttggggacttggagggaagggtgggagggaagtgagggataaaagactacaaattggggctgggtgcggtggcttacgcctataatcccagcacattgggaggctaaggcaggtggatcacttgaggtccagatatggaaagttccttatccataaaattcttttttaaatttttcatttccataggttttggggaaaacaggtggtacttggtttcatgagtaagttctttagtggtgatttgtgagattttggtgtgcccatcacccaagcagtatatatactgaaccccaatttttttttgagatggagtcttgctctattgcccacgctggagtgcagtggcacaatcgcagctcactgcaacctctgactcctgggttcaagcaattctcctgcctcagcctgcaaagtagctggtattacaggcacctgccaccacaccgggctaatctgtgtgtgtgtgtgtgtgtgtgtgtgtgtgtgtgtgtgtgtgtttagtagagaaggggtttcgccgtgatggccaggctagtcttgaactcctgatctcaagtgatccacctgccttagcctcccagtgtgctgggattacaggtgtgagccactgcacccagccccaatttgtagtcttttatccctcacttccctcctacccttccctccaagtccctaaaatccattgtatcatttttatgcctttgcatcctcatagcttagctcccatttatgagtgagaacatatgatctttggttttctattcctgagttacttcccttagaataatagtctccagttccctccaggttgctgcaaatgccattaattcattcctttttatggctgggtagtattccattgtgtgtgtgtgtgtgtgtgtgtgtgtgtatacacacatatatatgatacatatatatcatatatgtgtgtgtatacatatataacatatatatttacacacatatcatatatatgtatatatatctgtataacatatatatcatatatatacatatgtatgatatatatatatataaaacaatttctttatgcacttgttgactgagggcatttgggctgattctatgtttttgcagttgcaaattgtgctgctataaacatgcatgtgcaagtatcttttttctgtaatgacttcttttcctctgggaaaatacccaggagtggaattactggatcaaatggtagttccacttttagttatttaaggaatctccacactgttttccacagtggttgtactcatacattccccccagcagtgaagaagtgttcccttccaaaccacaatgtgataccaccttactcctgcaagaatggccttatccataacattctaaaactaggccacaggatcttgtaagtctgtcaagcaagccctgggagcccatggagatctaaacatttagaagagggaaaaccaatgagacattttcaattcttcctttcttgtagactgtaagcactagcaaaatgaattgaatctgtatacagttactacacactgccaaaatctgattcattttggataagtgatgatttccagaagtacaattctcagctgaccatacgctgctatgttcattcaatttaaaaaccttgagccattctaggttttgaagtccctcaccctgccttgccacacccctgtagcaggaaagaagctttcccaaagaggaggagattttacttcaagagttattacccgcttagttgcacacacattcatcacattctgagcctgattggtggctagagttctcagggggccagcactggctggggaaagtggaaggaagagatatattttaggcacccattgatagctttgctacaaaatgcactacccgggcacaacacactgagttctggcaagtacagcccatgttaaagacaaaatactccactaacttgactttgtctttcttggaccatctcaaatttggggaacctctaggtatctgattgcatatgttcctgtgtgctcctaaaggtgccaggggaagagaaaaacacatggcaatcagttgacttgcaaggcctagttataagccgaaataaagttttaggtacaatccagatgtataatttgctataaaaatggactcggaggaatccttggtgatttcccacaagactgagccactgtcctcctttcaatacgagggggattctgggttttccagacctcactttcttcaggtctgagataagcctgagacatacacaattgctgaaggtaacgtgaagcaggaaaaggaaggccagttgctctattaaaggagcttgtgttttcctctaaccaccacagtctgggcagcagacaattctcctttttctttcagagcaagtaaaatgttctaggtcatgtttaggttgtgacaggcacccggatcaacaagacgtcatttaccaagataagctggaggtcaacatctccttatgaaagggctccaggagctgttgcataaatgcaaaataacagatgcacaatatttgagtcctttagtatatctcataaactttaataatgtgataatattcaaacacatggtagtgttttaatggtaactacagaagagcccctggaaaatctgacaaatgctgtcataactggcccttcagagatgtccttccagctagtccatatttgcccttttaattagagttttagtccacttgttccttcttgaaggaaataaggaggctgttggaatagcaattttcaatatccagattccagacacatcaccctgttatagacagaactcaaatccaaggcatttctggaatccctatgttaattaccacattatcaagtcctggaaggactgtcgcataaggattctgagtaacttgattctcctaatgaacctgagccacccagacgatggaatgaacagcctgtagccagtctgggctgctgcctctcacccccgcagtctcagagctttggcctctcctgggtttggcacatggcctgtcctttcccattgtcagcctccttttcagcgcggtttggcatcctcttcaacatgaactgcctagagtctcgtcgtgccccttttcttgacccagccactgcctcatgtgctgccgtgtctgctcactgatcacctccactgtcttctaatctgttggtactgcattgttttacctgggtttgcaactggggctctgagatccccaacgctagctgttttctgggctcagcgatgctcacctagacctcatgcgcccgccagagatgaacccaggtggaatccctttgcctatttttgtcaggtgaacatggacttccgcttttgagaatcttccacctacccaccccatccatttgacactaacatgtttaggtcagtgcttctaaactttagagtgcatctgcatcacttaagaattttgttaaaatgaggattctgactcagtaggtctggtgtggggcttcaaattctgcatttctaacaacttcccaggtgatagccattctgctggtccatggattgcatttgagtagcaaggctctaggaaacagccttgtcctattcatctttgctggcctgcaatttccacagcagtttcactgccaccacttgggaagccccttctagtggtgtgaagcagtgaagacagaaggatgaccatgacacagtccctgctccccagggttcatagcctggagcagttttcgagttcagcactggatgttgagggctgataatatttagttgtgagggaagtcaggtgaaatgtaggttatttagcagcatccctaacctctacccactaggtatcaatagcatcttcccagttttgacaatcaaaagtgtctctagacattgccagatagttaagaatcaccggtatagggagggagacaaatatataaattaataactgagaggatggatcaagttatagaagctatgtatacactattcaggaaaagggattattaatatttcagaggctgtgataagcatttgacacagtgtgtgctcaataagtttgttagatacacaaatgcactgtgatgtccccacacttcctataacagtttacctttctgactgtctaatagaaaagacagttttacattccaaagattagcatctacttcactgacataattcactttcatggacatgtttgccaagtgtattacaagagaaagaagcctccttattttttaggataatgaagatagagtatagacatttgtaagaaaataagacacttaaaataaatatattttgtgaaacagaccgtttgtactgcttttttgacattatatgcacattcctatcagacaacaactaagaggagcattgtacatattacttggtaaatgaattcaagcaggatggtgcattttgttgcttggcacatcttaaatgcatgctcctaagcagctgtttcttttcccttacaggttttgggaggatgaatgtatttccaaggaactgtctattctgggatgctcatgctcttatacagatgcatttgacatctcaccatgcatacatagaaaggcaaaccagtaagcagataagcttggggaacccaaataagaggaaaaccagtgagcatccacatttatgaaatggaaaggagatgaggaatgctcatgtcgagcagcagctctaaatctcagccccaaatggcagagctgagaaaagaaataatgtcagcattggacttacataacaagatggcaagttgaagattttttggttatttatcttaatatagaggcaggaattgagaagggtctgactttgaggcagaacaaaagggctgtgagaatactgaaggtgtaagggcatttaaggataaataaaaaaaggaatggttgtgggggggggcatagcgtggaatatttcagtgcaaactttcagacatgtacttggtaaatgttattatcccttaacattttataaatggaatccaaaataggccaatgggaaacattcttggaaatatataccaactggacaagaatattcacagttgccaaaggaaagtgtgacacttggttctcgtgccaaagtcaacaagcctttgcccaaataatggcaaatcttttcgtttggaacacagtttcttaattaagccccaatgtcaattactgcacgtaagtagaaatcagcagatctgaagtcaaggccaggctccacggctggttggccaggtgaagtaacatttgtgctccaattttcctatccagggaatggggaaggtaatactttccaccaatctatgctgaaggaatattgtgatgagtcagagaataaatctctgattttttttgtttgcttaatgaagagtatcactgcatttactatagtaaaggcttgttctgttttagtccataagttgaaaaaaatcaatatatagcattcatatatccaaaatattcacaagaaaggtcttcaagaaatatttgctcatccatgttcatagcagcactgtccacaatagccaagaggtgaaagcaaacaagtgtcagtaaacagataaacagatgactggctaaagaaaatgtgatatacacacacacacacacacacacacaaacacatacacacacacacaccaatataacagaatgttattcagccttaaaaaaggaagaaatccctgtcacatggtacacggttgaactttggagacattgtgctaagtgaaacatagtagtcacataaaggcaagtatgattgcatgatatgaagtatctgaagtagtaaaattaatagaaagcaaaatggtagttatcaggggctgggagaaggggaaaaggggagttgtttaatgggtacagtgttttaattttgtaagacaaaaaagttctggagatctgttccgcaatgatgtgaatatacttaacactattgaactgtacacttaagatggtcaggatagtaaattttatattttttactacaatgaagtttttaaaaagatataaataattcagcgaaaggaaacaaaagcctcaaaataacatcccattttggttttagcattagaatttggctaaaggggtacagtctctgatgagacttctttacataagtagccaagctcctggttaccagaggtgtgtctggtcagtaacacactttgttcacagacaggaaccaagagtgcaagtgtcccccattctatctagtttgtgcctttcaatggcataggatagcagcaaaggcatcataaccttccagggggaaatggatagttagtacttaattctatgtaggctgccctatacaggaagcactgatttttgatcatgtaacattctaaatagccacaaatgaaaataattgccagttctgcatcatgaagagcaggagaagaagacctgctaaaagagtcagaaaaataaataaataaatgaaatactgagataatatgaaatggaatgaaataaaataatataaataaaagtaaacaaacacttttcaagcaagttttgtttctcaagcctaagaaaccccattttggcccaatatacagactactagagaatttcttgtccttaaagcaccaagtgcttagtgtggcatctgctttttgctaatttctgaggagaaggtgcctcatgattcgtggcagtgacattatctttcctattatgaataaaaaaccttgaatcaaattggagtgatataaacttaataggatagagccttcagatctgcattctcagccaatcactactttactgggttatcctgggcaaaactgtacttcatttgttttttctgcaaaggtagacacttttcagatctgattcgagggacagcaaaggtggagtagaaaggtcactggatatgctgatacaacatgctacagaaagtaaccaaagacttcgtggtttgagggaacctgggccatttctgctaggcagtaaatgacaggaagaagcttggaaggttttctcttaagtgatgtttaaggctctgagctaccaagacttctgggaatcaccaccaatatcatagtgctatactttactcagtaagcagaaggaatttctctgttggaaaaaaaaatcaaacaaaataaaaacaaacctctaaaggtgtattgggctcgcagttatttccaataggggctcagtcctatgggggaaagggagtcaggtagacgccatggagatcagacacctggctgattagctccactgagaacgctgcaaagggcaaaactttgtcatcccatctctttgtagaagcatcttctctggaggcttttaaaaataggacttgctctcagcatttagagaagacagagcataaatcttcctggggaggagtggaagaaataaccttgcaaaatatttgggggactgggtcctgtggacagttggtctccatagttaactggagatgttgaaattgcattcatgcaacctaaaatgcttagacatggtgaaataactagttgaaccaattattttgcagtgaaaaaaaaagcttcaccagtgaaatccaacctgttttgttattgttgatgtttcattatttttactgcatttagcttttgaggggacacataccaaggtgacagtgctttaggtaaattttgtttattccttatttatcttcttattcaagaggtatttctaatattttaggcaggagctgcattttcaacacaggaataaagtttgtagatatttattgcagcttcctgttgctgctatctctacagtaatcatcatagcttcttccctagggaaagagtgcttcaggctttggaaggcgcacagataaaaaggatacgtgtttttggctggagctacctgattctatgatctccctaaaattggttactgaaatattctcaaatgtctaagcaggtcatattgtgtaaatgaatgatctcctgaatattttacttttttttttttttttttttgtgagacggagtctcgctctgttgcccaggctggagtgcaatggtgcaatcttggctgaccataatttctgctcccaggttcaagagattctcctgcctcaccctcccaagtagctgggactacaggtgtgtgccaccatgcccagctaatttttgtattttcagtagagacagggtttcactatgttggccaggctggtctcaaactcctgacctcatgatccgcccgccttggcctcccaaagtgctgggattacaggcgtgagctatcgttcccatcctaaccattttttattgatatataatttacatataataaaatccaacatgtttaaagtgtataattcagtggtttttagtatattcataaggttgtgcaaccatcaccattctctaattccagaacattgtattcagccccaaaagaaaccctgtaccaataaccattcactcctgctttcccttcccctcagcccctggcaatcactagcctactttttatttctgattatttcatataaatggaatcatacaatatgtcaccttttgtgtttggcttctttcacccagcagaatgttttcaagtttattcatgtcatacatgtatctgtactaacatcttccaagtaattactgtgtccaaggtaatgaggtgttgaagcttttcttttcttccagatgtatggagttggtgcagacccagtccagtcttatgacgagccttggatgccatggtcacaggcagcacatttacggtgtagccctaagggttatgggaaacccaagtagttgggttaacccagtgagacatgaaaaactgcccagaacacaagcaagaaacaggtcataattgagaattgaggaaagaaagtgcaagacaaaggtgttcagatacacagttaagatctgagtcctgggtcaggacagaatcaattaagagagaaagaacagtgggtgagaagaggtcagtggccagggatgtacaccaagcagccaaggatctgtagtactcgggtctgtagcagctgccctgactcaggccatgtgacttcagagttctctgtcacagaagcatagaatatttgcactggagaaaaatttagagctatattctttagcaccatggttttgaagatgaacaatctgagctctagaggggctaagagacctcccctcaagctcaccaaccttagtgatcacttccttcatctccctccactcagtagaatacattttccacaatagctcactgccatgggaccacggcatgggatcccaacagatggatctggtcatatgttagtgccaaaatgcagtttagcaaccatttactcacatacccttatactatgtgacaatcagcagaaggtcttagatatttttatattagcttaaaagaaaagtttgatgttctttgacctaatttttattggtttaattgtctaaatacctggagttcctttacattttaaataaatttaatagtatcaatctataggtttagaaactgagagaaataatttttattggttaattgtctaaacacctggggttcctttacattttaagtacattaatagattagtatcaatctataggtttaagaactgaaagaaatgaatgaggtccccaacacgtcagtcaatgggaattagaacagtgatgcccaaaatatgcacataaatatcacgtgatgaccactaaaaaacacttggtgttcaacagaattgtaaaattagtaggtcaaaaggaatgactccaaaacccttcatcatttaacattcaaagctgtaacttttaaatcagtttcttctagcatcattgtatagaaaaaaatcattttttcttcagaaaaaaaattaaaaataaataaattttaaaaatagccttcagattagtcaaaaaattttgatgcattcatatgagaaaatcgaaggcattaatatggcggtatgatgtatgtctactgaactcaaaagtttagtaacatgttgagtgaaataaaaactatagaagaacatttaaaatttgatgtctttatatatcttacaagtgtgtttatttatatttgtgtgtatatacaaagaatatatctggaaggacatccataaagtattgacaattgtatccccaagtagtggaattatataaggatttagtttctataattttttgttgttttgttctctttatcttctatttttttttctggaatgaacatggattacttgcataattaaaatattaaaaatagactttgttttgaatattgtgtttgcaagactggttcattatcagtttctacaacaaatatcattttagaatcgataacaaaaataaaagcaagttgtccttatcatctccacaaactcagaaaatagttctacatcaaatataaaccagtacaaagaggcacttgtgaaaggaaacaaatgtttggggacttgacctactccccttccctcctcccttgcgtctcaaagaggtacagctcattctcactccttttgatttattaaatcaccatcttctccctaggctagacaaaaaattcatggttaggatttaccctcaagcttcaggctgactacattgtatttgaaacaagcaagtcatctctgtcttgttgcaaagtttacaggaacatcacctcaataagcacacttgctgagcttattgttatccacctttacctcataggaaagccctactagtaatggactttgaatcaccttctttgtttattcatgaagttgaaagctacaatagatcatgattattttccaataaaacaaactaccagggtcatcgtgatgcgcaactgtgaggggtactattttcatcataggttatattaatggtgccactttgctcatcacacatctgctaacagtggtccaggaaacttcatcctgtaacattttaatcaaattctgcttttctattcagtatttgactctgaagggcattttctccacaaattataaaagtataaagggttttagataagtacaagtataaatataaataaaatatacaggtataaatatgtatatggaagcaaatttttctatatatcctgtatatttcataagtttctataaggatggacttctgattctaaaccaatgggtcacatacattggaaaatacaagataagattgcataccaagttaatcacataaatagaagcagaagttcctacttttagatttggaaccatggtgtgccagatataatgccaaactttatcaactgtagaaaactatagattagttttaaattgtatattcttttcacagttactcccatgttctagagatcgattgttccagttttttaacagctttatttgatgtatcactgacatataataaactgaacataaagtgttcaatgcgataaatctaatgggttttgaaatacatacacacatatgtatatgtgtgtataaaatatatgtatacatatgctgcatatactacgtatatacacacacacacatatatatgtacctttgccataatcaaggtaataaacgtatccattaccccccaaagttctcttctctagctattccctctccaagtaatcaataattttattgtcactgtggattagtatgaatctccaataattttacacaaatagaataatccattatgtactttggggaggggaaggaggagagtcaggctttcactcagcctaattattttaagagtcatccatgttgtgtgatatataaatagttcattcctttttattgctgagtagtattgctgtgtatggaaatggtataatttgattacttattcacttgctaatagatatctaggttgttttgagttgtacaagtctttgtatagctatatgctttcttttctgttgggtagataccaaggtgtagaatggctggattatatgataagtgtatgtttaacttttaaaaaaacggtctcctaaggtagtcgtaccattttacattccaaccagcagtgtagttgagtttgggttcctccatgtatttataaatatttggtgtggtcaatttttttttaatgagacaggttcttcctatattgcccagactggtcttgaactgctgggttcaagcgaacctcccacctcggcctcccaaaatgttgggattacaggcgtgagtcacagtacctggatatggtcaatttttaattgtagctactctattcagtgtgcattactatttcattggggttaatttacatttccctagtgagtaaatgatgttgagcatatttccatgtgcttatttgttaacatatattttctttagtgaaatatctgctcaaatatttgaccaattttttgctgtgttttcttaattgttaaattttgagcattaattaaatattctgatataaatattttgttagatatactatttgccagtattttctttcagtctagcctgtcttttccttcactgaacaacatatttcagagtaaaaggtttaaatgttatcaatttttaaaaatagataatgttttggataaagaatctaggaaatctttgcctaacctaagttctcaaagactttcttcaccgttttttgaaaaaaatataattgaggttttttattaggtttcagatacatttggaatttgtgcatatagtgtgaagtaatagatcaaaattcattttttatttgctgcatatacaatatttcgggaagcatttgttctgcacagaattgccttgtatttttgttagaataacaacaacaacaaaatccaaaaccagtttattcatatatgtgtggatctatttccatagtttattccattctaatcacttatttctatttttatgccactaccacactagcttggtacctgaaacaataaaataaatcttgaaatcaagtagtgttatccttttgttctttttttccagtggtattttagctattttaggtcctctgtatttatacatgaactttagaaaaagcttgaaaaatttacaccaaaaaaaaaatgcttattgggattttcactggaattacattgaatctctagatcaatttgggaagaacgattatcttaaaaatatgatgttttctgacctgtgaaaggcatatctgtctatttatttaggttttctttaattactctcaggaatgtttttaattttcagtgtacaagtcttgcccatcttttggtcagatttatccccaagtattttatatttttgatgacattgtaaatggtactgtttttctaatatcagtttgcatttgtttctcgtatttagaaatacaattaatttctgcatattaatcttgtaccctgcaaacttgttaaactcccttactagttttagtggttttacagatttttatcagatttttatataaataatcatgttgtctacgaatacagaggttcatttctgtctttccaatctggatgtaattttttttcttgctttattgcactggctagcacctccagtacaacgttgaataaaagtggtgagagccaagacatccttgctttattcccaatattaggagagaagcattcagtctttcattgttaagtatgatgttaattttagttttttcatgtatgtcctttattaggttgaagaagttcccactattcctaatatttctgagggttcttaacatcagggacagatgttgggtttagttgattgccttttcaatatctattgagatgatcatatgttttcccttttctagttcgtcagtatggtggttatcaatacagtaatatggttaacattttattattattaatgctgaattgcaaaacgtaatttctagaaaaatggaaggttagtcacagttgtgcctcaatgatactagattagagtgagtaaggtaaataaccattttctttcctaagaatttttttttttttttttggaatttcagttggctatccctgttacaactgcttttgtatctatatttgctacatccaactgggttagtattgaactagcgtttaaaaagggaaaaagaacagtgaattttaaagttggtatgtaacttaaaatgtgaccccaaatcatgatccctgcttgaagaattggtcaaaataaataaaaatggatcacatgctctttaatgtcactgtcttgtctgaaatcaaaccttcaggaatatttatctgaagtcttttcatgtagctaaagtgcaatcatcttggagacttattttccagtaacatgtcccagagatagaaatttatctaaatgttatctaagttctttatagcctttggcacatggtgataatgtattaagaaacaaaagggggaaaatactcaaaagcttcttgcaatgagaacatttgtcactggtatgtgtcatgaaacggacctgggcatgcaaccaagttaagtaattacactggtctcaggccaatttaaattgtgtgctatagaccttctatgtagaaaatagtccataggttctgcatacaagcatcacatgcaaaaaaacgtgatatgaaagtcttttgttccccaagaaggacctgaatgtctgtctgtcgacaagacaacctctgtgggtacctcactgacatagtatacatggtgaaaaagaaagtgtcaattggttgtgatcatgatcagtaaaaacctatttggtttataagcctggatccaatcacactgatatcattctggactcaactgtcctttgtggttcaaggacataagaaaactgaagagaaggcttgcaacttggatgttgaaaagaaatttattgaaaggaacaccacttgaataacttttactacctccaaaaagcagtatgttctctctactggaaaagacctaaatacactcaaaaagcttactggaggattttttcctattaatttgaacgtcgtataggaacacaaaatttggttaaatatttgatagataagtttggtattaaaaagtccacttggttcattataaatattaaaattaggaacatgtgttctttgtttaagcctgataaagctttagctgagatcatgagttttcataaaacaacttttcacaacacaataatgtattaggtcagggtctactgccctcctgcagattttgcctgatagtattttcatacaaacctcatcactcctgctttttctcagatcttctctgagcttatttcctaatgcaaatcttgatttatatcagggccctaacgtggctgtccaaaatacctccctcccccaatttgtgttttatctcaatacattacccagtggtggcccagcatctcagagtgcccaacatgtaatcttagtctcatagggataaaggaaagcaaccatacctcagggcattcatcatccctgaaagtccctctccctgtcttaccatgctttatgtcatcatctggctcatttatttatttataaatagccctccactcaaataacactcctgaagggtggggaatttttctactttgttcactcatacggagtaagtgctcaaaaattgtgttaaactaatagcattcagttttagtaggattagttgcattaaaaatacatctcctagaattaagattgcataatatgttactgaatagttcggcttctttgaaggtatccttggcagagacaaggttagttctccctgactcaagcagagatactgttttctcaattctcttgttcgactaactcctctctgttatttattactggagacagacagtatccatcacttctcagattgatgcaaggcagtggtaataaaataagctacatacatcatgtaatcatattggttttatgaatcatatttttctgaattagggaaaatagttgttttggtttaagctggagaaaaattctgactcatgtcaacaaatcactgacaaggcaagcactgataaaaataaaaagcttaaagcaagttttattagagaaaacttgcaacaactctacacaaacattgattaattataggctcacttggtcttctttaaaatgaaaatacttttaaagacatgactgtatgtcaacaactaaagaacaggatatataactagaaaaataggaatatttatttaaaatgttatactgcattgtgcttttttttaaagataaaagctatttaaaaatgaagcaagctcaatttgtaattaggacacacaattcctcaaactctgtaagtctattaccttaagttgcccttacttaaaaaatttattcttatctgaaaattatggcaatgtttaaaatgtttaaagaaaacagtaaatttgtgttatgtccccaatttttgaaatttacattttattttcatcatactgaaaacctgatgctgaccttggcttcactcctcgaggtggtatgtagagttctgtgaggtcattgctgtggatattcagcatgcactaacagtgcagatttcctggtgggtcagggctgagaggattggagagcaacactgaagtgtataacaagagaccagtgcaagctttgatttgaaagaaggcactaaatatggattcacggcaacaagtactatcacatggaacacttaattatttttctttctctctttacatcttaagcaggcaaagtcaacttgctggaactgggctaagtttgggagtggtaaaaacaaaaagtcataatcatccagtgatttttaaaattctggtgtgcgtcagaatttcctagaggaatggttcaaaatatgattatctgagcctcatctcaaaactacctaattagagcctctcctgaaagaggctgggcatctgtcttttaaaaacctcattccaggatattgttctacttaacactattcaagagctgttagttttgactcacacttactatgtaccaaggatcatactaaatcacttcaatgtactacattaactaatgatcctacaattctaggattttggtattatttttatatctattttacagaaaagaaaaaaaaactttataacatttccaaagccatgtgaccagtaagtgatgaaaccagaatcacctgacttcaaatcacacacttaactcttatacaaactgcctccaaccatatggagtatagtgccccctataaatgtagaccgttgctgtctaagtagaacctagagatattttacaaaattcagtcccaaaatagtgctactatttttatttactaactgcaattgatgaggaaagtatatgcattgaaattcagtctttaggactccggaagttacacaaggctctatcagacgaaagcctaccagctatatcaagtgcctactgtgtgcaacgcttaggaaagttattctctggaagttgttcttttttttccctcaacttttcaatacaatgtttgagggtaaaattgctatctggggcaaagaatttctgcagatgttactgttactagaatgtgaacaatgattctatggatttgccactgctataaatacaccaactggaaagctttcaactcccaggaaacaggatttggaaagtgagacaggaatacccagctgagaaggtaatttaggtagacacaatgagaaagccttaattcctggcatatttctgttaacaggcagtgtgggaatggctttatttcacctctgagagaaatccaagcgatggattgttttatgagatgcgtgtgatcacaatgagaatttccagtttcctaaatagaacacttaacaagtgttcgtgaagcttccagcaggtcacaccattttaaatgcagcacacatagctcaacactgactctctttaattttgctttctttcactattcttggaggtacaggactaaggaacccactatgcctcacttaatatcatcagggtttttagtcttctcactggttttctgaagcatggatttttgcagttcctagtcaattaattcttggagcttcctttgtcacctggttgatccagctttggtagcactgaatttctctctagaccatgtgttctttatcagagacgttcaaaacacgttttctgaacaaatgattaagtgaatgaaagagtagatgcctcactaagcagcacatctcatactcccatatattatatatgagcagttccgcctgtcacaaagctcctccttatgttaggcatgacagtaacacgaagtcttcatttgactttcctccattagccatcattctgcctttggagagctctgcaaacaattcttccccaggacaaccattttagtagctgaaagaagttattatgaactcccaagtcctaattattcttccactttcttatcaatttcttaaataatatgacctctagatatatcacaattttgctcctccttctgtggagagagcttaccaatgtcgttattaaaaagtggcactaaaaactgaacacaatattgctgatgtgaacaagtggatggttctgcatcttaaatggggattatggcacctcccttttaaagctgttacatggaaatagaatgatggtcaaatgccaagggcacaacaatttaagagatgggactcaataaatattggtatttgtctcatgtcatcattatcatcattaccatcaccatcatcttcatattacctaagtctctcacagcctgtatagttgcaggtgttttttatttaatgtaagtgccacatactacatttgtaaatacacatacattgtttttccctttcagaaaaatttcaatacttattcttttttttcaatgcaaaaataaacatccgatgttttcattaaaatatagattaaatattagccagggaacaggggtcaaccttgtcctccaacatgacattattctccaaaccattatgtccactgcccttagttgctggtacagtttacctggcattagctgatggacttctgaaaatataatttacttttaatgagttgtgtgtgtttcatgttgtggataaccctaaacaaataaatgtaaaactacaatttgatgtccaaaaataaggaagaatgggatttgcctaaaatcagacgtttattaaataacaaggaaatagctttcagctatattaggtatcttaaaactcttaacattgttttgaattcactttgatgcgtgtctcactgttaagaaaagtgttaagacaagtgaagaatggtttgatgttaaatggatcatggaacacaggagatcatatttaaaagggaggttttcctccattttcaatatttcctaaacttaatctcttaagagtcttctcaaaagaacaatttatgaactctttaatggaaatgcattaaaataaaatgtggccgacctcttctttccttgtagcctcagaacactctatcagtcactactcagaacaaattagccaatttggctgtgagttacccacagtttttatcccttcactccaatagcctggatccctggactgcccactctaaccatgcaggcgggggattgtgtgtgagaaggagccatgcaagccacagggaagaggctgtaaactccctgaattgggagctaaaaaccctttgttcgatttggctctgtatatttttcaagatcatacatctacttatgatgccaatgaatcaatttcctcatctacaaattaaaggggatatgagacatctttatttgcaaagtctttctgtcgtacaaatccaacagctgtatattttccttttcacataatgactttagcatctcatggacaaacatctgttaaggaatgtaattgttttttctgaaatctcggtgtatggtttgcacaagtaaattaagacatttataaccagtataaccatgtatatcatttctaactgggattatatttttcagaaaagaaactaaacctcaagatttgcatgctaaggcagacagtgatctataaacagacccgaaggctctcagtaacgcatggggtctgtgggtccttactatctgtattagtctgttctcatgctactaataaagacatacccgagactgggtaatttacaaagaaaagaggtttaattgactcacagttctgcagggctgtggaggccttaggaaacttataatcatggcagaaagggacgcaaatacatccttcttcacatggtggcataaaggagaagtgccgagtaaaagcgggaaaagccccttataaaaccatcagatcttgtgagaactcactatcacaagaacagcatggaggtagccacccccatgattcaattacctcccactgagtccctcccatgacacgtggggactatgggaactacaattcaagataagatttgggtgggaacacaaccaagccgtatcaccatccatgtaacaaatcacctgagatactagtatgtaaagtattttccactcatttaatcaattcacaagcatttattaaacctctactgtctgattcaactaagaaattctgctgtcactcattagtcaacttagggtatgctggtgaatctctaagcaaatggaaaggcctatgatgactctcactagaattgacatagcaattattcacaaagttcacatatttttagcagtaagtcagtttctttgaccttttttacccatattatactgcactggatgagcttaagaaaagattatatcagtaataattttaggaaggctgctgtgtggttttgcatagtaagaaacgagttttccaggtatccctgggttcatcagctaaacttcttgaatcagaaaactaatttattaacctttctttttttcattccatggaaccaccccaatatcttcaactcagtaggtaatccatatataatttttgaaggaaaaggacaccataattttctcacatttaatgccttcacaagctgggcagtgtggttcacacctgtaatcccagtgctttgggaggccatggtaggaggattgcttgaggccaggagttcaaggccagctgggctacatagagagacctcatctctacaaaaggttaaaaaaaaaaaaaaaaaaaaaaaaattagatgggcatggtggtgcacacctttagtaccagcaagtcaggagtccgaggcaggagggtcacttgagctcaggagtctgatgctgcagggagctgtgatgacatcactgcatttcagcctgggtgacagaccaagaccctatctctaaaaataatgataatgataataacaaaaataataatgccttcacaagtatctataaaaccaagtttgaacactaccaatttaataagaaataagatgattataataaatgccacttatatagtgcctaccaccatttattgggtaacacacacacacacacacacacacacacaccacacacaccccacacacagaatctcatttaatccttagagcaactctctctggtaggttttataattcatatttaaagataaatagagacatatttagcgttgttcagaaaagaagaggcatattccatttcatttttgctaaaattttagttcaataatttttataatttaaaattgaaggattatataacacttaaactaatgatggacagagattactgacagaaggtaggagcatttacagaaatattcttatttgtaaagcaacatcacataggcaactataatgcttttgttctcgagcttccagtgtctttatcatagaaaaattacaagattgataataatttttcttaaatggctgtgaagactgacatccattgcagtgtttccttgataaataatcatcctggattctgtcaatatttccctttcataatttgatatacaaatggatgtaacttaagactttaagacactattactgtccataaaaagctcacaggtcttgcaaatagaattgtcatgtctgaatctcaaattatttcttcacctggtttttaaaaaaggtcaatttccttagctaaaaataactgagtgattaatctattcaacataaaacaaatctggattctgacttacttgcccatcctaacttcttttttcaatccccaatttaaatttctattaacactcattccgtaaatatttgtctggcaaaattcaagtaccaggaaacagcataatgcaaaattaacagagtagcactataaagaagcatatgacccaaacagctgcaactcaatgattatctgtcccaatgcccagttcctaaggggggaaatacaacaaaaacaaaccctcctacccaaacggcttccgagagtgtttaactagatcctaaatccattgctgagatttagaaatatttttaaatgtttaagggatatgaagtgatgccagaaaactcagtctcttatcaaggtatctatttcacttatgaatagataggaaactagtatgagaaaggtgtttcaggagtttaattgtaaaaaaattataagaattttttaaagtctgtacaaaattttgcttatttccgtgcatacttaacttataaatagagttactatgccatttatattccaaattgcaatgcttagcaagttaaaggtggggggggggctgttaacaattacagtatgtgtaaaccaagattgtctcatgaaaaatgcggcatatagtcaccctacttataaataaatttatgtaaaaaggtgatggagatattctaaacagaaatccacgagattgaaatatgatgaggtaaaaggaattagtgaagagcttttaacttttagatcgatactgggttaaaagtagaggtagcatgaattgatactctaagtgagaaggtaagaagggcttacatttttaaagaggggaaacgctcacaaaagtcaaggagtgggaattatacctggttttgaacagacaactataaaatggggttcaaataaagatggggctatttcagaggcacttcctaaaccaacatggcaagattatttaaatttcctgttgtacacttaaacaggatcaaacattccatttctttcctaactcagaagtattcttccccttgttatcactacgaagggaaatgtcatagattcctgctctaaatatgattcaaagtgaagtagctcatttgtttattaaaaatgtagggttttagtctccacaaagtggcaattttgttcatccactggggagaattaagttattagtttctctccctctctcccttcctttcccttcccttccttcttccctccctgtctttctctctctcttttattcagaggcatcaatgtctcaaatcttaagtttatcaggaacatactacttttgattccccacaaaggttgcatcttgacaagttcttggttgaactagaaatgtcgcagtagcatgttttgctattaaagcacacctggaggaaaagaacatcctctgatggtgcagctgtttccagatgacctccttgcagtgcaacaaccaaatgactgcaaagatgatgtggctgagatatggccctggatctctcctctccatgtgcccttctgtatcctaacagcacttccacactctcttctccaaggaatccccaccacatcccttctcactctttccttaataatgatccaatttatttatgtgaaggcccacttcctccccacagacagagtctgtagagaaaaaaaaaaactacaattaattccttatagggaaaacaacttgtattttctcttttatgaccagaaaaatagcagacagttttccttgtgaggcttcagattgatgctcaatgatgtagaaagagcataactctgccagccctagtaagtgccatgaaaatacttgaccttttgaggtagggcaggaagagaatgtttcttgagagggctgccaggcccctgaaaccaggaaaaagtcccagcctggcccagggagctgcttttcccttgcaaaccagtggagcagataaataactgggctaatgatatccctgagaaaggctaggcataatgactacattttctagaaactcattattcaatttatgagcaacctaagcatataagaaggctgcaccttttcatattttgtatctcattgttatattacatgttatattataataccattaaaaaattgggtcagtttctttcagatccagtcttaaaacctgaatcaatataataggtgtttgatttcagtcataaaaaataagcatctcttgggccgggcgcacgcctgtaatctcagcactttgggaggccaagacgggtggatcacaaggtcaggagatggagaccatgccggctaacatggtgaaaccctgtctctactaaaaatacaaaaaaaaaaaaaaaaaaaaaaaaaaagtagctgagcgtggtggcaggtgcctgtagtcccagctacttgggactgatattcgatatttctttaagtttcactatcctttataggttacctagaatgggtaaaaaggtaaaatgcacattaatgtacacatgagagttcactgctgggcctccataatgtcaagaagcatgagctgccttcttcacacgcccacagggaaagtcagcaactcacctgtcctgagctgactgacaagcagatctactgcaccttctatcagcagctgtgcaatctgtacagtggtgaaactgaggatatcttgtctggatttttcagacaggcctaggtagcaaaactataggactcactcatttgcaccagcctcttcgaactcagagctagggaccgcagcgtggaaaaggctactggggtgcctgcccatactctctgttttctgtttaccccttattttgtacttgtctttgcctgtgctgctaaacctcctacttttggtacagtgcactatgtaaatcaagagaacagatctcctggccaagaccacctcataatatagattagaggaaagatcaaaaatagtcatagcttttgaaaccacagtgcttctatttgaaaggctccaataagcagcagggaagagataaaaaaaaaaatggtgaagaaagggaacatcagagagttatcttactgttaaaaacctttcttctctgccttggtcttttcttgtcacagcccactcattttgcttccccaccttccttcttaactatcctcttcctctctttctctttctaactttcgaactgccaagagttaaaggaaaaggtggtccccttgtccaaaatgaagagatgaaacaaatttctggtactgatcaatggttatggtcatcactactatgggctactaatggttcttgacagcctagtaatgacttgcatatttaaagaggactcctttcagtcacttccaggagggcctgtgttttaagtattctcttaatctaatctgtttgatccatttaaattgacgatgtaaatttaaagatgattgtgtggaaacaagagaaggatcctaaccagactgcagaggtattgatcccaaggtcagggctcattagtagaaattgctaatggtccaagtaatcttccaagctcactgtacaatattaggtcctccataggaaacaaaacattacttttgtgtaaaacaacttgtaacaacaatagtaatacaatatacctattttaaaaagaaaagaaactacttacaattctactactgtcttaaattatataattttaatttattccctttcaatctttctcatatgcatgttatacatttgaaacctataatgcacaaataattgtatgccctgctccttcttaaatgataattacatttctaatttgatagtcttcatagtttttaaaagttgcatgattccattgaatgacatacaattcacatgaacattccactgttacaatactggacctttgaattgttttgaaagaactctgtgaagtatgtttgtgcatatgacattttaacatttcacattattcccctagaataaagtcccaaaagaggcattatgtgtcaaaggaaataactgtttcatgacacttaatacatgttgccaaatttcgcagcatagctttttaaaaaacgttgtgagcatgttctttctgcaaatcactttgctagactgtgaggcacaaatgaatgagtttaaaatacagtgcttcaccgtggaatactatgcaaccataaaaaaaaacatgttctttgcagcaacatggatgcagctggaggtcattatcttcagtgaattaatgcaggaacagaaaatcaaatactgcatgttatcacatataactaggagctaaacattgggtacacatggacataaagatgagaataatacgacactggggactccaaaaggagggagggagaaaagggctgaacaactacctattggatactatggtccctacctgggtgatgggatcagtcataccccaaaccttagcatcatgcaatatacccatgtaacaaacctgcacatgtaccccatgaatctaaaataaaagctgaaattatttaataaataagtaaataaatacatgcagaaataaaactgaaaaaaaaatacagtatttgccctgaaaatcatataatacagttggggaaataagacatacacatgtgaaaagagaactaacaataccaaccacaggaattcagagaagaaagaaaaagagcatatttagcagaagagggtaaagagttagacttttgggatattctgaggtttggatgagttgaggtagaaactattcaggtcgataaatagagtaaaaagaaaagaaattaaccattccaaggaattttctgtgacttaaaagcactatgtgattaaatttaatgtattatcctggtccacatagactccccaaggatctttccattattagtaatagttattctttcacctttgtccttgaaacatcgacttcccccgttccatttgatgtgatactgtggaggtttatctcctctgcctctaatcagtccttaacttctttcttttaaattcatcttcctccaaccaccaccatgagaacatttctcaaagttctcctgcagttttctccttctttatatatttctgtaggtaatgtcacctgatgacttagctcttgtcattacttcttgctgcgaatcccccaatctctattttcagctctcaattctcatttttgttcgcatacatacattttccactgcctcttacagcagtttaaactagatatcccaaactgaactctttctgtggtctctagataatctgaaagcaccacagttcgcaagcgtgtcatctttcaggtctctttcatcttcatagctcacactgaatcagtttccaaatttggtcccagcttcccagtgacttccaatttcctcctattgtaggtgatcaaaatctcccacctggactattgcaagggctcccccatctgatctgcttgcctccagcttcagccccttcaatctgtggtctacaccattaccagttgccttttaagagcacagagtagattatgtcacttgtctgcccaaggacttccagcaactctagaaaaccagcaaagcccaatccagacacattaatgtatccctcctggtcccttatggtttcaactcacactacttctctattttcatctcctcacactacaacctcacacacacacacacacacacacacacacacacacacacacgcactggactatttaaaattcactgaaaacagacaaactttcactcggccaaacctttattcctgcagtttcccttgaatgaatactctcatattctctggcccattgaaaccttacgcaaccgttaggtccaaccaaatgttatcagttccaacaatccttcccagacctctgtctccacaatctgaagtactattaacttcctgtattttacagcactgaatggttaattttcttgctgcctgtgcaactacaatgttccctttctggaggccaagttaataaattcaatacatccaagtgtgtttaaattttttaatctctttggccaagggctgaacttcctcttgctgtttgttaaatggctattggaagatctcttgctaaacctgaaagtatttaagatgttcaacagaatcctcattcacagatgtgaggaagaataagagatggaaagagaaaaggatttaagttactaatgatttttctttccaatcagccctatgacgtatcttcaaaaccaggccaagaattctcatcacttgtcatgacgagtcccttagcaaggatagggtgctgcacattcaagttcttgttttaggctcttgctcccatcccaggcccttgcttaggtttaaagtgagagctttaagcagggaagactcccaggttgcaagtattcctcaatcccatcccactgcatgtgatgctgactggagtcctggcacgctgtcacagatcctagcataaaaataacctgaggtaggatagaggggaaagagaggaagggaatttatgaccaaccctccagctttatttatcacttaccctgggaaagtactatgtaataaaaagggggggaaaaacaagacagccaagctatttaaagagcaggagctgaaacttcagaagcataaactaatgtttctaactaaaaacgggtgtggagcttaaaacttttcaaaaagtagatgctagatgcatatcttaataaaaatgaattttaaataatatttttgaatggactatcctacgctatttattaggactaatggttattcccaagacccgttctaacttctgatcattagaaggtaccatatttttccatttgcatagtagaggcaggatgatagtatatgtttttgtctgaagtgagactattaaaggaaacacattaaaatgatgaggataaatggtcatgtgtcatcaaggccagtccttcctgccattctttaagctgaattcccataaaatttagttttacctctttgaaaactatgtgtgttgttggactaaacgtaagaaaagaacaaaaccaaccagtgaataataaaggcaatgtctaaggctgactacatttggtatattaaaataaagtagaaaactggaaatacaagagtagtattcctttatgttttctaattagtcatttctgatgttttccctgaatttacacatcagtccattattccaagcagggacacacacacacccatcaataaattactattataaagagaggtaattgtctatatacaaaataaatatactactagttgcttatagttgcaaaggtaaatgtggaaattctcttcattttaccaattaccagctcataaaggaaaaataaagttaaaatatattctctttttgcacagactgctaaataattgactgatcatgattaatcaagtaaattgaggcattctggaaaaatgacaaatggcaagatttactgcctctggaatctacggcatttgctaaatataacttgcttgtaactacagataaatatctaatctaatacaatcgagttacctgcaaaccagagccacatacaaaattgaatgaataaaaacgtctcaaaagacaataaatactttctttcttccaaatgaaataaaatcttatgataggttttgaggagtacacgtagatgctaggagcatcagctttgcaggcctgcagacaagggttcaaatcttggctctaagcctctgattcctacctaggaaaatgagggtgatattatctatggtatgagattgttataagaatttattgagataattcagtaattgccatatagtgtgctaagcttagtgtctggcacataatacattatcaataaatgtgtcttatcattactattgtcattatttattaccactagtgagaggctagaaagtgaaaagtctaaccaatgcttttaacttcattttctacagaatattcatagaatattcatagaatcataaaacacacacacataatgcctactatatttggtacttgtctgtattcacttctatgacccactttaatgtatatgcaaccctacagtaaagaacactcccgggagaataaaaaagtgccctttatattagcaaaattttatgtgagttaactgcataaaataggatgagttttgtactaaaactcatcaattatttttcattagggtggctttttatttatttattttattttatgtttattttttttttgagacggagtctcgctctgtcgcccaggctagggtgcaatggtgcgatctcggctcactgcaacctctgcctcccgggttcaagcgattctcctgccttagcctaccgagtagctgggattacaggcggccaccactgtgcccatctaatttttgtatttttagtagagacagggttttgccagttggccaggctggttttgaactcctgacctcaggtgatccatcagccttggcctcccaaagtgctgggattacaggcgtgagccaccgtgaccggcctaggatggcttttctaaatattttcgtctatgataatttttctctccatgtatttatttattttcagacagtttgaggttacagtgagctatgatcgcactgtctggagtgcagtggtgtgatcacagttcactgtaacctcaaactccttggctcaagtgatcctcccacctcagcctccctaagtgttgggactataggcatcagccatagtgcctggcagtgagttttctaaacagagatttactaaaaggcttgtgtagtgacttggcaacaccgtaagtattttatttctaaactttgaatgcctttctaaatgtcacaggctaggtctacgtaattccctttacagcaccacatgcaattggctgtttagaaaatgctttttgaggatggtgaagagctctgtttttcattaagtggctttgaactttgagactgcaagtcctgactctggatttaccctttacttcactacataattcaattcaaacagtcaaatgatatcctctttctgcaacatgtgtgtggggggaggacgggggcggggggcggtgtttccccttacttatgtatctttatcccgtgagttcattttaatgaaagaactccagtcttccctcaacttccttattctgaccttgtgctctagtactaagtagtgacgccagggagaaaaaaggctggtgagccaaaaatggcttaggaacataattctctaccaagctgcagaaaataaatgacagggttggctgaaatccaaaggtcaaatatatacaggctttcttatgggaaaggaatgtcaaacctgtttaaaaatcctgtgaagtgagtttataatccctgactaccaaaattaaccatccagctgaatcattttaatatttccgtgaataaagtagattgattagcttttccagagttatgtgttatcagataaacaaaccaatatattttaaataaatccttttgacccaaatggcatggtggagcacaaaatgcttaaaagatgccctctggacctcctaaggtttttcataggaaaagtaaattagctagactattttcctttctgcacaatgcaatacaagctgaaataaaaatgtagctttctcttccttagtcttcttttttaatgcttctgaattatgttagaattttagagcttccaactggattaaaaattgattcagcagaatggtaaattacgaaaaaaaatctcttaacgaaaatacttgttgcactcagttaaaactgtcttttaggccgggtgcggtggctcacgcctataatcccagcactttgggaggccaaggcgggcggatcacgacgtcaggagatcgagaccatcctggctaacacggtgaaacttcgtctctactaaaaatacgaaaaatttgccaggtgtggtggcatgtgcctgtagtcccagttactcgggaggttgaggcaggagaatcccttgaacccgggaggtggaggttgcagtgggccgagatcgcaccactgcactccagcctgggcaagagagcgagactccgtctcaaaaaaaaaaaaaaaagaaaagaaaaaaaaaaagaaaaaagtgtcttttattcccaagctagcataagaatgttgaggtaaccaatgttattggggaaaaatctgaattctattcattttattcaagacctaggtatcccattgagcttattctactttgtggtagaaaatatatatatttttctaactctcatatcttcttaatagtataaacaagaataaataaaacaatttcaattttaagagtctccttatcattattgtagcataccatcacttgtcccctattagtttggagtcagtaatcatcacacaaaaaatatcaatatgggctgggcgcagtagctcacgccagtaatcccagcactttgggagctaaggcgggtggatctcttgaggtcaggggtttgagaccagccggaccaacatggtgaaaccctgtttgtactaaaaatacaaaattagccggacatggtggtgcacacctgtaatctcagctacttgggaggctgaggcaggcgaatcacttgaacctgggtgacagaggttgcagtgagccgagatggcaccattgcattcagcctgggcaacaagagagaaactccatctcaaaaacaacaacaacaaaaaaacaatcaatatgcattatcatgtatatccattttgttgcaacatcatcaacatatctatagaaacataagtgttagaattagctaaaaggagccttagagactatccacctgccttgtttctgaagtaaataaaatgaggtttagagaagttagtgattttctctgcattccagtccaatgtgatgttatcaatggaggaaagaaaaagtaccatgtactgaatattgtattaggcttttgatgacttttagcccagtcaaatactcaacgatttaataccaaaggcataaccatttcagttttatatagacatgacttaagtgtagtttaaggccatatatctggacaatgacaatattttttacagccaatgcatatttttgaaatcacactagaaaatgaaatgtattaatacaatttggataatatatatgtgcattaaaattcttaaaagcttattttattggtaccagtaataaaatcattatctgtgattctaccctggagaaggaagaagggtatgtcctgcaatgcactaaaagggcaggaatcatgcccttaaaatgtcctgaaaacatttttttcagccataaatatgaataaccaaagttgagggttacgcactaatggcaaaattatcagatcattgatcaaatgacgtgctattttcaggcaggcaataccataatagcaaagcaaagagaaatctaatttgcatctgggacatttaaaataaatatattaaagaagaactgttgagccagtccctcggccatactgctctcattctcagcctaaaactagtccctcagcctttagggggtgagggggcagcagtaggcttcatgtcacctaccactgtccttgtcttccccctaacctgtaccaaggccttcagtaaattcggtcatccctgctttagccaaaaagccaaaaactctactgatatcaactcatggatctcattctccaaagaggtcattagtgctcccattttgtaaacagtcatattgtgaatcccaaatgaatttcctgctaagataaatagatatagggaaatagttttggatatggatatgatatagatatacaatatccgtatattattttcctacaattatcatactacaactggctttcttttctatcattttagaaatttaaataatgtaaagacaaagcaaatagatgtatgcccataaagtttagcaatgtgctcatatatttttctaatttcctagaatatcaaaatatgaagaagcactgaaagaagaaacatctaccatatattgatgtatttcaaattcagatatggcttcatctggaaagcacactccctgtaattaagcaaaagtggttagtctataaccataattaaatttatattgtgttgtcaagttaaaactgtgaatactgtgtacaaccaggaaaactggatgggaatgactgacttaataaactaacttcttttaagaaatacaatgaacatagcttcctttcccttaattgtatttttaaaaatcatgtgaataatacaaaaatatctatgctacaatatgacagccctaaaagaacagaaatgggtgttttccatggcccacagggccagtctaggaacagccctttgctacaaactacatagatcatgaaactgacaagtgattgaaataaggtaatccttttattaacaggaaatgaatgtgttttgaggctctgcctttgtcatgattatctggctctatgtgaatacaggctctttgggaacctgatccaatttatatcagtggaatgagcctatcagagaaattcaagaaagagataagtgaattaagtttagaaagcactacactgctagttggtatatgaaccaagtactagaaagtcagtggggagaaaggaaaagtccatgaagtgggtaatgctagagctacacctcaaacaagttggtatttacaaggcagacaagatagggtggcatagttccttatgatgtcatgccatgacttaaaaacgaaatccctgccagtggtgaagagcaaatggctgttctctacaatgctccattcccctctaatctcaaggatgaatttggccatcctaattccactttatgtggtaccttaaagacatctgagcatcactggtacagcaactatcatattgcattgtaattgcctgtccttcacttgaaggtgggaaacatatttatatcacactgtaccaatgtccagtatatcttatacactcaaatgagtaaacaaattaatgaatgaataaggatttaaccaagacaacaaaggccttgcaggggcctctcttgtctgcaattcatcataatgtccactaaaaatctcagaatatccattttatacatggtcaggcctcggtactcctgagaggcctaaactagtacagagggctcctcaagagttccagataaatcttatttaaccataaggctcttttctgaaaaaatagtgtcacatcccttagggaagttatctaaactgaccttttcccctgggaatcctccagtcattggtctaggcttcatttctgaagatgctatgataggctatcatagatatagactgttaagttcactttcgttcacaaaaatacaggcatgaacctctgtgtactgccagcatgttccgctttaggatgccttaatatttttattcatgttttcttttttcatgaaaaaaataataaagtccatggtaatattatagactgtggtgtcagagatgtcacatggaatcttgactctgccactttctgtttaactctgggtgaattaactccctgagccacagtttcctaacctggaaaatggggataataatgcttactttatagaggtggtgaatataaaataagatgcacctggcataatgtaccaaattgatattcagtaactagcatccttaaagatgcctaagaagatatgaacctctttgtaatgcacttctagaagccaaccaatttttctcaacatggttggaaacaaggcaaatgttgcttctttttacatataagcatgataattgtgtaagcgttttaactaatgtgctgaccatagtttacagtgctgtgtaagttcaaaaatgtcaaacacattttttaagaatgggggaagtaaatacattcactgttttgaaatggtattttgatatttatacatcaaatgtagtattttcttaggtataaaattttagtatgtttatgcatcatcataaacagtgatattgttttgtaaatatcatactactactcaagacagctcagtcgtacagagtagttttattttctcacccgaggaccctaaattctataaactttaagaaagtacctgattctacagggaacccatgaaggaagtcaggtaaaaaaaggaaaagcaagaaaaacaacaaaccactcacctccatagcgcactcagcaatgcaatggtagttagcagatccaattaccagctactcagtggcactcaatggtattacttggtatggattcatctccttattttctgttttgcttttctctgtatactttaaccacaatctcctaaacctttccccctaggtttccattccatttattttcttgtgagttacactcctatattcctacttatgtccctaggaaaatgcaaaataattccttctattcatggagaaatatactatcctgatgattctatgaagttttcttatttcagttattgtacatcttccgaagtacaggataaacattacattccttgattcttctttttcactgtcagttctacctactatttaataatactaaatcatgtaagttagatgtcttactagtatttagttcaaaaagtcattttgaggtgtgaatatagaggaaagggtgttgaggcagagagagagacagcaatatggacaacatcacccagctcaggaagcaaaggcagcatctgaacttaggaaataatgagggtctgaaagtgctctgtcttaagtttctctctatctctctctctctccctcccatctccctcttctccctctccctctctctctccctttatccaataaggctacaattcagccagtagataatcgtagtggggtagcatcatgcatctttttcagaagacagagatcttcaaggattcatagcaagagaagcctggacatcctgcctgtaagacaagtcttgacatatatcaaaataaatttggcacctggttttactaatctgtaaacaaaaacaaacaacagtgtgtgtgtgtatatatgtctgcatgtatacatacatgtgtatgactgtgtgtgtatgccttaaagcttcttttctataactgggtaatagggaatgaataccagctattctgagaactctgagcctgctgattgaagattactctgagataaaatgcagcacaagtcaaccctcctggcccacaaaccatggtctttgattttatttctgctctgtaaacatcctcatatggcatctgaccctactgaaatcattcaacaaatacaagtcaatgattactgagactaagcaaaatcaacaagactataggtatgtttttcatccataagtgacaacaaaacaagttgtgtcataaagaagtcactagggatgattcttcctttgaaattagatggcaattatcttccataattggattttcttcttttagaaatttcctaatagatcctgaaaggtatcatatgtattacaggaattcagtaaaatgctacgttaattacacatagctgtgacttgaaatatttgaaaacagcgtgctgtatcttatatgagaacaactaaactaaaaatcagaaattaaaatttaagttacaaattagcatataatctaccagagtctctccaagccacagacagtgaacttccctggaaagcgaagtgttggcctcagatgatgggctgctctgtgctattgtgtcaataaaaataagacaacccacaactcagatcacataaacctaggatctgtctgattttcaagaaccaagatgattgatattactaaacaaatacccactacgcgcctctggcttcttctctcatgtttcttttagttcttagtaagcattgaaatgataggttattcattcctaagatgtcattatctgtagcaaccactgtcttgcagcctgcatatgcttcatgtcagatcagagtattctgtttaaagatgaccagtgattagataaaggtaatgtgcattctctcattacctctcatctagatagcggcaggaggaaaggatatcagaaggcagcagcactgtgagcctctctgatgagcagtggcaatccagttacagagaagttgagggctctctaaagtgaggcagtgccagaattcactttaccatttttatgtacacttggttttagaacttgttctagaaacatatattctaccattttcactgtaccagattgtgaaaagatagtaactgaagtacaaagtaaataagtatatacatgtatgaaaaactgctcagtaaatattaactaatataggttatgaaatagaatgcaatttatgattccattgtcaatatcaccaatgaatgtctcacacatgcataggaaaatttgattaagttcccagctcttactgatgaattgaggtaagggagtatgagttgggcattgtgaaatactttcaatttctaagacgtatctaaatagatggatggatagaaagacagacagaagttactttgtaactataaaaatcatgaacatatatcattatgcagaaaacaaatattcaaaatgcaatgtatcctattgcatacctattgtgtatactttcacaaattcaggtgacaaagctaggtcaatcaaacacaatatatttcatcactgcatgacttttcagagcttttaatgtgtactgtggatgtccactgactataagtagtcatatgaggcagaatacaaatgttcatatgcaaaaaaaccaaaaacttccaacggtcattgtagctcatatcctcattaaaatttgactctttcttttaagtcaagatatattgcatgctctttggagatcaaaaatggtggtttgtgattctgatcaccatggaacctctgaaaactataagaaacatgtctatttcaaacttctggtcctatttctgtgagttgatttggtaagctcgtcaagaagggagtcaaggccaggtgcggtggctcatgcctgtaattccagcactttgggaggccgaggcaggtggatcacttgaggtcaggagtttgagaccagcctggccgacatggtgaactctcatccctactaaaaatacaaaaattagctgggcatggtggcaggcacctgtaatcccagctactcaggaggctgaggcaggagaatcacttgaacctgggaggtggagcttgcagtgagctgagatcgtgcgactgcactccagcctggccaacagagtgagactccttcttaaaaagaagaagaagggagaaagggagttgggggactaggcacatcaaacacagttacccatgcccttcccaggtttagggttaggatttttgatacagaactctcttatcagaaggagagctccacaaggctcaggattttcagagtttaattcttgagactggcctgggcgaatctgtttcttgctaaattgaaagctgggtgtgagagtaaggaaaacggaaattcatcatgcaggtaagccttagaggcctgagggtaagaaaaagtttgaaggagttatttcagagacaatgagatagcacgcacccctctctctacccaaatacactggagacttgtactaaaggctttgattcctacacaaatatacattcccatgagagagttaaactttgagcttttattgatcatttcatatcctactatgaactgctttatgagatccatagtggagaaagcatttgaaggaacggatgcttaagagtagaaaggaatggagtagtagagagaagaggggttttgtttcccaaccagaaagtaactcaccctattgccttgtttggtgtgtactagctttgctttgtgtactccctggctctctttgccttatttttttacatacgggagtgtgagactgaaaattagttggcttcgtgaaacaagtcaattcatcttcagaaaaaaatctcaaagagcactaatgagtattttcaaatatatgtctcaaatttggataagtaagtaaataagtaaataaataaagcaaatggtagtggctaaaaacagctgtcttctaacttggccctgactaacttctagttagaatcataacaccatgactcattgaaactattgtggagtctaaatcaagtaaatgagatagtagttctgggcatctttgcaggttactctataaaatgaaagagttccttctgtggctttgttgattttgcaaggtctttccttggcctatcttctatgcattaaggatctttttgttagcaaaaaagttttattgttttcaaaatatgaaacaaatgatgctttttggaaagtttcttaattaccctaagcctcacttcttccaacgtaaaaattgcagttaatgtacctgcttctcaaggctgttttcaagattatataaatgtgtatgaatgcatgcttttaaactctggggttctacaaaagctattattagttacactggttttttgctggacttctaacattcacaggatgatagtgataatgggtcaaattccattgcatggaccatcaaggaaggacattaattcttgtacttgaagtagatttacctttaagcaaatccttccaaaattatgtattctatctgcctggagtgtggatcctgcttaggatattaagagaaagtatttaaaatcttattaaaaagtaggtagcatgacctttcagcatcatatgggagctatagacctaatcaaaggttatttagttacttagagaaggtgtattttgtttgattcactttattactgatacaggtccaagagttagtaaagtttcttgttaacctagtgaaatttgcctggtagagatacaaataatttttgtctagttgaaaagataaccccaagggttttagtttatggccctatagatattaactactcgtatctaacactgcaatcttattctaagatttattaaatggcctatatatacttagctctgcaaatgctctttaaactggccttaccatcttactggatctctaattaataaatgaataagctatttgacatgtgctcatttgatgtaggcaaatcatatttttaatgttttaaaaactatattaacagtgatacagaaattttgttgttgtagagataattagagtgggatttgttagatggtagaatatattctgatattgaaaagaatagtagtaaaaagtaaatgggaagaaagatggacgagtaagtagttagaaacaaagagtttctggaaattttaaattaacagtgttaaaatttgctttctttctatttcccccagggggccaacatgctgttagatagtttatgatgacaaggaatttagggaacttatttaaaaagtggatccttctaataattggaatatacactattgcaattgtattcaacgatactaaagtctcacacaataaacttcaaggtgcagtgccatttacttacactttatatctcagatgacggagacccagagaatcttggttgttactaaacagatcactcactgcaaatatgaacaaacgtgaactaaaatagagtattcggggttcttgatactgtgttaaacgtactgatcactttaagatttataactgggtaaaatgtgtctgcacagaggtccctcacagtgtacaataagagatggtaaccacgattccagtcataatctgaaattgttgcataagcttaaacttaaactttcagaatctcattttaattatgagtaaaatgaggatattggaataaattatttttttctttctcgggtgatattctattaaaaaaaggaagacaaaagatatatgattcaatgtaaaacttgggcaaaaattacttaaaaagggaagcagagtaacatatagtacagcctctaagagtttttgctgtgaatacctcttttaaactctgtttaattatgcattttctcaatcttatttggccataggataactcacttccacctcgtcttttcttgcccatcacctataaacatgtctatgaacatcaccatgaacttaaaactcaagttgtcagtaactctttgggaacttctggattaatcatctctgaagtcacttggaattctaagaagtcacttggaattctaacatcctattatcacttggctaacatcacaaattaccctaaatttacttagcacttactatttgtaaggcactgttctattcacttaaaagtgccaacctattgagatcaggtgacagtgctggagctcataaatgtcagccttgtatgtattaggatctgtaagattaaatatctgtgccatacaaaattgttcctggtaattatgcaaatgtggctacaatttttttaaagcacagattattataaattaaatatagacatatcataagttctgtagtgtaaaggaaaaagatgttcatgacagactgagaaaaatatgaatgggaaatatagtttgaaaattacattgggaaatgtatttattttcaaactactgtacttgtaattttgaatcaaaggctaactcccaacttctgctaatgattggatgagtcttacaaatacccttttccattttttataatagaatttttaagtgactataatgtacaaatccattcaataatcaattgaaggtcaaactacatgccagtacccgcatcaggtacagggatagaggtctcagaaagttcacagctttatgagcaagagagtgtgtacgatggcaatataatgaatcagcagtatggcagccagatgacaggagagatggtcaaggaaagcttccagggaaaataagtgaggccatagagaagtcattttttagagtaataaggaggtcagctgagggcatggcatgaaaaacatattccactagaactatttaaaatatcaagatgtcaacagcaaagtatctaagttaactcctttctcctgagacaatgcaaaggaggaggctctgctgatttcatgcactatttgcctgggatttttttgcatgattcttttaaggtgtcaagcactgggtctatgacaatgtagatgaaggaacatgctttggagggagagatttagcctaaacttttaaaggacttctatccaacccactcactgtccgtatagacacaaaaagaaagggacaagaaaccagattaccccaggtgtgtactacaaacatacaatagtggctttggttctgggaaagttcatctttgagtaagacacccagactcactgtttattttaatgtaaactattagagagaaaaatgtctgggagaaatgtactcaaaaagcatctgttgagaataaccagtcctatgaagtaatatttaaatgctgtgaaaaaaaattcacagagcttcaggtctcccattgcccttagtcttcatcagtctattcctatgtacacaagtttaaaatgttgaggacagccctcctaggaaagtctcactcagaattgacattaggtcctgtacctagcagcatctgaattcccagactaatcttaagaattcatggacctgatactcaaaactgaacattcagcatggtaatcacatgagatctcagggtacatatacttccccacccaatctctcttcctctcacacccacattaggaacatattgcacaggtcaggatggacaaattctagaggactctgggaatcatcttccgtattttgtttgtctgtttgttttcaaaaagtgacaagaggctataagccatggattttctaattttataactggttaagtccaagcttggaatgccaagagtcttcattctcatttttccagtcctgtttactactccagagtcaagaaactctgcacacggtggttgcttatgataggagtgaagggtagatgttttgacactccgtctcctgtggccacaatcaaagcatagcaagaaatttcactaggggccctgctgctcctctcactacactcctacctcatcaataacaacatctgtatttagtaataaacatgctaggaaaatgttaacgtgcttcataaattatatttccatttatttgcaaagaaaattgaagtgtgatagggtagaaaacatgttttataccacatgtagggaagcagtcagaagattcatgtgagcaacaaagctcaagaagattgtcagaacaaaaaaaatcataccattaagaacatgaaagactctacctttcagctctgagatggacagggccactgatttattcccagagttgttaataaatgaataaaaaaaagaaacagcaaatttgtggtaaagtatccctgactatgagccaatatactttgtaatgaccagaaaatctgcattttgaaaaccctctatgcagccatagaaaagaataagttcatgccatttgcagggacatggatgaagctggaaaccatcattctcagccaactaacacaggaacagaaaaccaaacactgcatgttctcagtcataagtgggagttgaacaatgagaacacatggacacagggaggggaacatcacacactgggccctgtcgggcggtggagggcaaggggagggagagcattaggacaaatacctaatgcacgcggagcttaaaacctaaattacaggttgacaggtgcagcaaaccaccatggcacatgtatacctatgaaacaaacctgcacatactgcacgtgtatccccagaacttaaagtaaaattaaaataaataaacacactcatcaacattaacagtaaaaaaaaaaaaaaaaaaaaaaaaaagaaagaaagaaaaagaaaaccctcaagtttcctgtggtcccctcaccacactgctcagaaccagaaagagtttaagactttgaatggattcatttcttagaaagcctggctgtacatctctatatttagggttgatttcttttattgcacacagtgagaagttgatgggaggagtgacgagatggctgagactcccctttcctaagcttttcttgcctttgtagagttgtaatgggcaatttcttaccacataatgagaaaacggacttgaatccatgctactcaaagcggactggcatccctgggacttgttagaaatatatatgctagggcgtttacctcatacttagtgaaattagcatctctgggcagaggactcaacattcagtgttgtgaccagcactgctttatggctacagcagtattcctcctaggaccatgccgccgtcagagttattttgaccctctctgggaagacagcaagcctaagtcaaggttttactctattccacaagagcttgttctctaatggaatttacaagtctggcctttcaagtacagtcccaaaaatggaatgcaagacacaggaaggcagagaggggaaaaagtctgagtgccaaacagagaagaatgacctctatggctaaattgttttgtctgcatcctgtctaaaggcaccaaaatttacagagaataaactaaaggaaagggaaaaaagtcttgtagctcaatgatctttctagtttggaataattttaaattgagcaataatctgagcatattttcagccagcatctgtctgtgttccacttagtttcagtctgacttttactcccctgggtaatcagcccacacacaagcaggttaggaatgaaaaaaataaaataaaataaaccctgcttatttcattttctgtttcccacatctccttttgtacatacatcaaagcacagcatgtgacagaaatgcttccatagcaccaaggcaatagatagcactttgtatagaaggttggtgtgtcttctgtgcctaggttcaaattttggctttgctacatactggctatttgaaatgtggtaacttactctctgtagcctatcgcccaggctagactgcagtggtgcaatcatagctcactgcagccccaaaccactggcctcaaacgatcgttccaaccttggcctcccaaagtgctaggattacaagggtgaaacaccaacctgggccccttgcttcttctaaactatcaacctaaccatgtaaaaggcagaatccctttgagaacctcatatgccatgcttcttcccatcacagggcctttgaatgtactatcgtagaagtcagcagagaaagaagagaatccaggcttcagagccagacagcttgagctcaatgcctggcttcagccttgctgtgtatatgacatacaagttactgagttatcctctctgactctcagttcccatatatgcaaaataagcataatacccattttacagaggtgttgggaatattccatgagaaaatccatgatttacctttagtggtactaagacttctaattgtctataacatctattggctttaatcgaatgttatactaacaattttaaaataaaactaatgaaatactttcgaaatattgtgtattaatttagtttatgactcttgaaacaaactccaagttttaatgaccaacaaaagagatctttagtgattaatcctgaatttaaagcaagatttctctaatttcaaagtccatacattttcatcttgaaatcaaccatataattaataacaaagataaggagataaaataaaacaatggcttacggtctacacattcttttctgtctaagatggcccacttgaaattataagcaatttaaattagaattttaaaagcatattctcaggttttaaaaaatcagctgtatttgctccagtgcttctttatttactgaaggaaggaggtcagtaatttgggagtcatagagaagctgaagtgtgtttccttcttaatttttacatgggctgaaatgttttcaagggctggaagacggcgtggtgacaggaagacaacgtggtgtgcagagagaagattgaactgtacatgaagaaatctgagttcaaactgcagttcccaccagctggaatccacagggcaagtcatttaattgctctgaagacataaccgcctcctctcaaaatgaggggttggcttagctaactgcataggctccttccagctttatattttgctggtcttgagaattgttagggaagatcacagtgactccaaaaagagaagatcagatctcctatcccatcaaagaacctatctaccgtttcagacattttaaatgccaaacccatacatctaataaaaaagctttttttctgaactctggtttttaaaatgtataacttcaagaaaaagataaatctgcgcaagaaacatatgacacaaatataatgcattttatcagcatatgttccatccctagtggtcacgtttattagagatttaggctgagccagggttggctgtgttctcagaagtacggggatgggtcttgcagaacctctgcactccggggtctcagggcagctagtgctgaaacgtgaccagaaagagtgaggacatgaagagtgccatgtcttgcccttaatgactcttggtggtttcaccagaaagacagagggaagcggtattcagtctggaggaaagaagtgggtcagtctccccacagtcgtaacacatgcatcacagtcctcttatgctttcatctgtcaggaatgggccttcatgttgttgttacactttgacctaatgaagagaaaaatgactcagaataaatgaatcttcccactaataaatgatttcttaatttcgtggtgccatgggcttttttgagaatctgaggaatgtggctcttcttctcccacaaaatacacataagcacaaaattgtgcacacagcttcaagggcttcctagactccttcatgcccattctcattcttcaggggctaacagggaaagaatccttcatctaaatgaaggaaaattaagagtttatgaaaacagacacaatttgagcacatcacaaatgtggtataagcctgtttttccatcaaatatgtcaagtctgaaaaaaaccgaagacatgtcttaatcaaatttgtagtctcatcagcatggtgccctgctcattggttacagtcgacactttgaatcatggtcattgagaaaagacagagtgggcaggaagagaaagaggcaaggaaaaggaatgatttaaggatttctgtggaaaatgttatttcaaaaaaatacttctgaggttaaagggaagcagaataaaagactttctagttaccagtgaagtcagagagacacaaatatgaatcctgctccttcctcatagcagctaaatgaccttgggtaagttcctctctgcacctcagctgttttctctgtgaaatggggttaataagagtatctacctcacagggttattgtgaggctggaaggagctaatagctgaaaagcatttagcacagtgcctggcatgtaagaagtgttcagtaagtgaggtatttatcaagaatcaaagctgtggcctacttaagatggtactatctgcaaaagtgccagccttaaaaaggatgtgaaaactaaaccaatttagaaaaaatatcatccttttaatattagaattatacataattctgaaaaacttaagattaattcacaaatcaaaaaagcttgaagaaagacaaaaaaagaaatatggtatttatccataaatataacattgtttctatttccctaagaggggaatataagcagtaatattaatattaaaatggagctccaaattaatggaaagtattcatttccagagatgactaaaaatcagagattagaatttctgagctttgctgtagactatgcattttcctaaactcacagcttagccacccttttattaattttttgttgttttccttacttggatgtttgtgtttatgtgttgcatgtcatatttatatgatgttttaaaatccatttgatctaaacaactcagaattctcttaaaactatcaacgacgccatttatcagctgggtatggtggctcatgcctacaatcccagcactttgggaggttgagtgggaaggatagcttgagcccaggagttcaagaccaacctgggcagcaaatggagactctgtctctacaaaaatttaaatattagctgactgtgttggtgtaggcctgtagtcccagctactcaggaggctgaggtgggaggatcacttgagcacagaaggttgacgctgcaatgaactgtgatcgtgccactgcggtccagcctgggtgacagagttaaactctgtccccctaaaaaaatgtcatttatcaaatggcatttatcaaattacaaataattttttgtgcatttaaaatagccccaagcaagcattacttctcacgcacccagacaagcaaaaaaaaaaaaaaaaaaaaaaaaaaaaaaaaaggcatttccatgtatggctgaattattactctatgtgtaaatttgtcttaacattagccttatataagtatatcttttattgtaaaagctaaaagatgttataaattataaaagcacaaaaactgcctggcacgtcactaatctatggagtataagctgccattttttgagtgcctagaatgagccagaatgtgtagtaggcactctatataaattatctataattctcaaaataatcatgtaaagaaaatattattaatattgccatttcataggtaagaaaattggggctttaagaggttatgtgacttgtcaaagggcatgaggctagtatatggcagagctgagaaatgacggcagctctgtctaaacttcacattctcatccttatcccattgcctataatgcaatattaaattattattctaagtaatatctaataaactttagacaatctcaggtaaagcattataagtggattttatctgggaatgggatcacccatcatactttgtatcatattttataacatttgtatgtcagttatttatattaagaaccatatcttacctaaggcagcgactgagtgtgaattttatttctgtgcagagtagacatctaaactctcactgaataaatgaacaaatactacagatttgaaacatgccatggatgatacatgattcctgacacctcacctcttccactcctcacctactttcccatctccctggttaagagtgagttcaagggatggagaatgtggagacagtgtttgcagtgagaaatcctgaaaaagggagaccataccaatcactagggcttcatcatactactactttttccacagagacttccttgtctgcccctcctgtgatgccgccagtattctaatctccaaatctaacatctgtccttatcaatgtactagagtcaagtagattggcatactgaatgttgcatccaaaaaaaaaaaaaagttggaaaactcatattctagttcagtttccaaccaagacagaccaagaactcacaaacaacttttggcatgcactaaaatctgcccctttctaaataaattgaagaaaggcagtgataggggaaagagctttgacaaagacagtaaagagctctatgtattacagacaatagcttgcctaagtatttgaggttgtagagatggtaggaatgaaagattcaaaccaacaaattgaagggactccccatgacctagactaataagcagtactgatcctaaggtgatgtacgacaatttcaaattaaatggttttctgagcagaccactcctatgttatttaaaacagggtatatgtgcattcataaagaatccaaatcttatccaaaagaagcaaaaagctaaaataaggaaacatgaaaaggtttttaaaaccaatggacgttgcttaagtcaatctagagaataattatgcctagaaattgtaacaagctatttcctatggaaataaatagattaatgcttcgtatttatccagttttcttcttttaaaattcattcataggcgttcatagagaaggaacttgcagttgtattgcaattttgagccagtgtgtcatgtgaacaattcaatttaggaatatactcatttagggaattaaaaaagcagaagttaaatttaacccagaaaattaagaacattatctctgaaataacattttccaaagctaaaaatatgccattatgtttattgagaagtgtttgatttcaaccaatgtctcaaatggttaccttatgcttcccgtgttattcattttattgggaaatggatgttctattcattgtccaaaggcttgttgagttctctttctataatcctcaggaattcaaagaagcctgtgagtcatcaaaactcatttccaaaactgagtgtgaaatttaatttcctagagattaggaaaaatatagcacatatctttggtctgtaaaactctggatgtaattttggctataggcaaagagtggcttaagtgacctttgaagaggatttctatgtgtacttaggatttagcctccaagagtcggcctactcagcctcttttgaaaagtattactgaggcagtcacattttagtcagtaaaatgatttttttccgaacaagttgactgctttcagaagtaggacgtggctttaagttaacaccaggattccacgttactaaggagaggcctcgatatgtctgttgcatccaggtgggctactccctgttctccagtcacgtctgtatccagtaagagctttccaactctttgtggcttatctaatacatctacgagaaaccagggagggttttaaaagctggcagggcataactctcacttacggaaggtccacaccccagccttatttttaaggccttatctttgatttcctgaaggggtggagctctcacagccttgcttttgtgttcaacttctgacttactccttgtgcacctataactttctattgtcaactgaaattacttgggaatcaaaggggtaaattgttttcagcactggataaagaaatttttgagaatgagaactttttctggaagcattctcctgcctgctcaaattttgttcctcaaatatgtgcttgctgtcataaccatgtctctgagcctccttaggagccaactcttgacagctaaagaaaaaaatggagcaaagagagcaatcttcctacagccctcgctgctgggggccccacccttctccatcgttcaacctcaaaaacttggcctcatctgtgaccctctcctgttctccgcaggctctccaaggcctgtagatttttcattatggaaaatggctctgacccattattaagcaatttccaccttaacctccctcctctcatgcctcattacaacatcgctaacatcaagtccaacattctaatattacaagtggaaaaaaaaaatgatctgagactgtgaactgtgagaactgtcgactgtggtaaattttaagcatgttataattctaggcctgaaaactaagagataacaaaagaaatgtaatccacagatgcccccttctttatgctgcctacctgcctttgtactctttctcccaaagtcatcttctgcatatccttttagaaacttgtgtcccattttcattttcccaatccatccacaatggcagcgaagcgctctaccatccttctacctgcacacccttcagtagaggtaaacctcttaaggagagggaggcaccagattagaatctacttcctcactgcccggtctgtcttccttggaaaaggaaaagggaagtagatattgaataagcgtaccattttacctacaaggcacacagtaagtggttgatccaatcaacacaatgccaggttgaacattatacacaagtcattttattcttgtgcagatgtttttataggaaagagccccagaaatggggttgcaagtcaaataataaatccacatgtaattaggttaaatattttcagatctccctccatatgcgctataccactttgcattctccctagaaatatatgagtgcctttgttttctcccaactttgcaatgaagtatgattttaagctgctggattgttttaatctcatgaaagagaaattgtttcttagtgtgatttgaatttgcattattataactgaggtgatcatatgtttaagggccatctgtattctcccttaaatttctgcatttggcagaaggcattttgtaatccaaagagctatttctttaccttcaagtcacactccgtgcacagcccacccatctgctgacctatgtaagaggtcaatgctgcttacacgtgttttgggactaaatgggggtggttgtggcatttgtgtcaatggagcaaaggacctagaaggcatcataattcacacagtcagtctttagttgatggcttggcagaagctgaatgaagtgtgtgaaggtgactctacagagcacagtagtaaggaggggttgcttcttctgtaagtttacatctcatgctattttgggatattgcctggatgacttgtcttctcctctaacatataatattcagagtgttttaagttgtataaatcttaagaaaagaaaaagggagaaaagaaagggaaatgctaggaaaaagttctcacatttgacaatgtgatttatagaactatttctaggcacatcttattacatcaaagtggcagtgtttatttttttacaaatgtgtaataataaggatcttgacaatgcacccctccctttcagattacctctagaaatatccctggaaaactttaagatgaggcaattgtggcataaagaacaggcatagagaaatgctttttgaagagtgtttgacataaaatttctattaactgttaataagcactttaaaaattgttctgttctcaaatacgtatgggaaatgccggatgaaataaagataagcaagctcttgtattgcaagaactgaaaaagcctttactatggggaggagttaaagtaatcagtgtcccccactataatttggctgcagaaaccccttctcccccaaaagcaatcaagagtctgatactgtgataatgctggaaaatgctgatgcagagggaaaaacatctaacaaggtgattccgatgattttttgattctgacaacaacatgcatgatattctcagtcacaaagcctctcagtgctcaggtcactcatctgtaaagtggggtactctaaaaggtcactttccatttttactttgacctataaggagggatgccctgcagaagacaggtcttcctgttagctcagccagtggctttcttggtccatttcaagggcactgttggaggggtgggagagacagcacttctatcatgccaagctaaatatcctgagaaagatcaggggttttctattataaaatataatagagaccttgacatgaatcctcattctgtgtacagatgttgagcccacactcttactgattaccacacactgacccatctagggagtggtttaccctgaggccaggtcactaagccagtcaaaatccagctcgctttaatttgtagtccatgcacgtaacaaacactggtccactgctccaggtcatcattcgaatgtcagtataaactcaccagtggtcccaagagttctgtttctttggcatttgctttctctggtattatgtgccattttacaacaacagaaatcctgatctgtcaatgtcactcaattattaacatttcctggggtgttctacaaaccccattaagtgggatttgctggaaaggttgatgctctgctttgccccttggccccttcaggcacaaacatggattgaacctacgacatgccaagcacctaccgagagctagaggtagagtcactgatggttacgcacatgctgttctttctgaatgctctgccacactctccacaaaatggagctgagatgcctcttcctccaggaagccttactgagcttcacctcctctcagtctggattatgtgtcctacccacccccagttaaacagttccttccacagatatcaaacattacccttatattcctacatgcctgcctccctccttgagggtatctctgctccttaagtgtgaagactaattccttaatcttcatttcctcagcatcaattgtagtgactgccacataggaagtactcagatttatgactgactgactgactgaatcaaggtatgaaaaaccaattcctgctctcaaagaccacagagaatctagttcaacttttctacatgactttaaaacaatttataatgcatttatgatgctttaaataaaaatcgcgtgaatacttccaaatatttttgaattataaacacattttcaaatttgcctttcattagaagataccaagaaaaaaaaaactgcctttcaaagatattggataatgttaaaatgttggtttcaaaatcacgtatggtccaagataccaagaaaaaaaaaaactgcctgtcaaatgtattggataatgttaagatgttggtttcaaaatcacgtatggccccatgcagagaagggtccagatgtaagaaagactaaaacacagctaagggagacaagcacttatgtctacttaaatcggcctgctttttcaggctgtcaactctcccaactctgcagcttccacatgccttgttaatgtgaggagaaaccaatgtgagacaatagcagtcatatttccagtttaattacagaaatgcaaaccttacatctccttaagcctcaattataaaaaaaaatgacaaggcacatgccatgttttctctgcttcttgtcaccaaccatcttgccctattataaacaagaacactccatgagtattcagagtataattctaataaactgctctcagtctgccagttacatctgcagaacacagcaagaagaacttttacgaatgtagatatagtagggtaggaggcacatgaaagagagttccagcttcatcagagcaaataacctgcagagtgtattttgataatagtcacataccatggaaaaaacattcaaaaatatatttatttttccttaaagaatgtaaacaggtcagctggctcgtacctctaatctcagcactttgggaggccgaagcaggaggatcccttgagcccaggagtttgagaccagactgggcaacatagtgagaccctgtctctacaaaacatttttttttttaattagccaaatgtggtggtgggtgcctgcagtcccgactacttaggaggcagaggtgggaggattgcttgagcccaggaggtcaaggctgcagtgtgctatgatcatgccactgcatgccggcctgggcaacagagccagaccctgtctttaaaaaaaaaaaaaaaaaaaacacaagatgtaaacagtaatatttctgtgctcagtgtagaagtaatcttctcacagaaatacctaatgtagacgacaggttgaagggagcagtaaaccactatggcgtgtgtaacaaacctatgtaacaaacctgcacgttctgcacatgtatccgagaacttaaagtataattttaaaaaaaggaacctcctctcattaataaccagcatatagaatgctgagctacatcactggatgctaatcaaatggattaaaagccctagcttatacgacattcctttagtgcacatcatcctctttaaggagagtacagttgatggcttctctctcccccttttcatctttcctgtttcctaactttagggagacgtaagctgctaggaagacagatcattgtttttgagttgcatggttcctctgtgctgccagatattttatcctgatgtgtttgtataaaaagggataaagggaaatccatcacaaaattattgttgctcagtgaatgccaaacaatacatgcaactgaaggaaaaaaaaaaaaaaaaaaaaaaaggtggcggtgctggtggtgacctagccctcattcctgttatgaatgggaaactgaagaaaggttaagaaaagcatttatccatccactcatccacccattcattcattattcattcaagaaaaaaattcagtagctatttaaggtttttagataatttctcaaatgcagataatttttaaaattaaaatctgggcagattaagacaaaaaaaaaaaagacccaccacattgtgccctatgtttaaatatgttctaaaaaatgtccttgtagaaacatctgcagcccacatagacattttcatagacatcttgacagcaaaagaacagtactatcgtttcaggtacttaggaacataaaaggcagtgaatatatcagaaatctctcaaattttgttttttagttcattgaagcatcaaggaaagaataagggatttggagtaagaacatcttaattttaaaacctaatccagtctaatcctatttattctctttattttgtggagctgaactgaggatcaattaaattaatgcatgcataaccatttggttcttgcatgtagtcattcacccattcaattgattgattcattaattcactcattcaacaatctgtacaatggcctaggtacagtccaaggtgctgctaggattctaagtttgagaagaaacaggcaagactcctactctcataaggttttttgtctattaaacagccaggggctgataaacaacaacactaatgaatttacaatgacacactgaagcgtgcactctgaaggagggatatgcttctacaagactgaaggcaaagaaccacacaaaaacagggatgtaggaaggactttactgagcaggagacgctttgtacctgagaggaaaacgagagcttactgggagaaggtgcgggggtggatgggggtggaacggcttgtgcaaaaacctcagaacaggagacaacacggtgattggaggaatggaaagaaggtcaacatacaaagctgggcagaaaagaagtgaaagtgaagctgaaggtggggaaggggtatctagcacgtacgcagctattgagcacttgaaatggggctagttcaaaatatatgggctgtaaatgtaaaatacacactttattttgaagactgtgaaaaaatgaaactctctcaatttcatacatcgattacatactgaaatgacattttggacattttgggtttgataaaatacattattaaaattaatttcacctatttatttttacttttttaagacgactcctagaaaatgtaaaggtacatacatgactcatatttttcttggacagtgctggtagtaagtacatgcatagccttttaagtgtgaaaaagggtttttgtcctgagcgcaatgagaagcattgggaggctttacgaagagagacaatgggatcttcgcagcttctgggtagaaaagagatcaaaaggcacctggaggcaatggagaaaaatgatctgtgtactgcattataacagtttggtttagggtcaagaagtagagataagaggagtggaaggatttgagagatatttaggaagaaacacatcaacaggctctagtaatgaattgagtatgttactgagaaaccccaaagggcagaaatcatgttgggaaaacaaagatacagagtatatggaaatatacaatttaagtcctataatagaggcatggattcattgcagtaggggtacaaagtaagaagcaagtgtgtgctttacataggataaaatattgctgctgcagcttttcaggtaggcttcattaaaaatcaacatctcatcaaaaatatgcattctggttttaaatatcttttacccagagtttaacttaaaaaaaaaaaaaaaacagatacataatgagtaacggctgtgcaagagtctgtggtagggctgctcttgaaatggaaaagaaagagaatgtttctttagtgcccactggcatgtgccagaagttttaagtgtttaatttatttaatcatcccaaaaaccttacaaggtcatgttactatccccattttagaggtaagtaaaatgaggctcaaaattgattgaagttccacgaagacagaaaccatttttattttgcccctccactctattcctaatgcccagcacactgtccagcatatgctaggcactccgtaaataaaggttaaaacagctcccaagaggtagagccaagtgccaaccttgcttatctaaatttgggatcatcatgctaccatttgtttttttaatatattggatagcaagtacatttaagttaaagctttttaaaaatagaattaggcatagtttatatatttatatgtggttaggctaacaggtatttatataagagccctttatctgtgacaggtggttatcctctaccttattgaataacaagaacagttaacacttcctgagaatgtactgtgtgccagcctgttctaagcactttgcttgtattatttatgcctcattctcagcaaccctacaggatagatactatgatttctctcactttagacactgggaaactgaggtacacagagctgaggcatacagaggttgagtcacttgcccaaggtcacatagctgtaaaggcaacaaacccaaggaacctaattttagaatctgcatcacactctcaacccctatgagacagagcccactactccatgagactctagttcttacaaagatctctctagcattagggcaaggtctgccctcttgccattggtccagcaccctctgctggggccacacagtgttgtggtttatcagggcacctccttgtaaatctagaaaatcattcaaggataaattgtgagtcagacatttggagagtcagaataaaatgagcacaaaaagagcctgtagatctcgtgtggatctcattccatgaaaagagcaaacttaccctgagtctttaaatgtccactagcaggaagctatcatttgtctatggtgacatcagatagagtagagaaaagaggtgaagaaagggacttagtaagttgaagatttcccaacagcagaaaccatggcattcgggtgttaacagtgaattcaagagacccttgttcatgaatggagtttaatggctaagatactctctaagcacactaggcaatcagtgcttgctaggagttcacataatgaacaggatggttacaaccagacatccaggcatttgatgtgtgccggttacttcaagtgtcaaattacttacaagttttcaattgtgatatgtaagagggcttattgctatgatttggaagatcagttgggcacatgtgggtctatatatgaacacttcacttcttccaatactttaaaattgttatgcacattagtagagctcctgaaggagcctttttttttttttgttttggaatagtcttaatattactgtaaacacttgagaacatgttcagtatctggccatttcatacaaagggacctcatctggtgccccatcaagacaatctgaagtgcaatcaagaactcattatgaggtggtctaatctgtagggtacctcactgcctataaactaagagcagcacgatgcttctctactgaatgatgtcatctgcagtcactgggaacacacggaggtagaccaaatgccctatatggtaagtggccacacgtatcgggtaggaaggattgcctctgcccaaattctaatataaatgagaaataaattcatttacaagagaatattatgcactgaaatgcataatttttcaataataattatgctagatagtcagatgtttatatcttttctttccttttttttttttttttttttttttttttttggagacagagtcttgctctgtttcccaggcaggagtgcagtggcacaatctgcctgcaacctctgcctccgggttcaagtgattctcctgactcaacctcctgagtagctgggattacaggcatgcaccaccatgccctgctaatctctgtatttttagtagagatggggtttcaccatgttggccaggctggtctcgaactcctggactcaagtaatccacttgcctcagcctcccatagtgctgggattacagtaatgagccactgcgcctggcctacatcttcttataatgactaagtttggaagtaagagaaaaaattgaaagccattctgtctaataggtactggaaaatggaaaaagaaaaaaagaaaaaaaaacttagatagatagattccagggacacaaaaccagtgttagcataaataatgacagcccagatttatttgtacttaaaaaggtatacaggtaaataatctcaatttaaagtaggaataacacttgcaagacaaattaccaactaccaaaataaagaaaggaagaaagaatgcatcattgtgctactattttttaatatatagggtagcaaattcaaaatattttaaaatgctacaccacttaccatttaatcattaataatacactatgttaataaaaatgatatatcttcatgtgacaattacagttgcaaatcaatacagaggtgttgtcttggtgactcaaatatcacaaaatgttgttgccttgggtgggtataatattccaaaattgggaataaattttggtaagtttataaaccaaataaagtataatctttcctcaatttacatcatagttgcatccctcaaacatttagtacaaattaaaacattgtaaaaactacatctttttgtacaagttaaattctgtgttctcataattataaactgaacttgtacttctgtggatttcttgggaatgctcagagtgacctagaactcaaagaaattttttgttatttgagactaccccatgcaatacagtttatctagccccttagttctgactaaatgtcctttctgttcctcctcagtccctagtatgaccataacatgtccccataaatatccataatcatttccccaccacccctagaaggtactgctttcattcaggactacagcttacaactcttttgtatcaaatttgtacatctgatctagaggaatgaaaaaggttttactactgaaggttggtattagatgagtcttataatcatttttcaccatataagttaagctcagagataagattcattcaacatgctttatttttttaatttaaagttaaagctcattgacaaaagactaagaaacaactgataataaaaagtgcctcctctccctttttctgaagtggtttctaaaagaaccactgcagggatgatgatgatgatgatgatgatagcactaacatttacttaaacagttattttgtgtcactactaaactatgtgctgtaaatgcaagaaagctacaaaacagacctccaaactcacttgtggagcacttgtgaagattagagatgatcaatgagaaataaactggcacatggtaaatgattaaaaacaaaagctatcattattattaaatcccaagctaccctgaagcagtaactcaaaaaaccgtgccttaccattatgtcagttgttcagtagttatttatttataccacagacaatatgtttcttaaaatatgcatgcaaataagcccatcagagcaaaagacttcctttaaatttgcccctttgtggcaggtaataatgacatcgcctcgcttggatgattaataaccagttgttatgaggactgtgcctactgacgcaaatacagcattgtatttgggccctgagttataacattcatttctttaaggctgattgactctgaacagtcacattatttgcttgttgagtttacgcaagacgtttttccaagggaggtttatttatttatttatttagtggcatttacatgtgtgcctctgacttcggggagaaaaaaatgaaagcacaatgtaagtagtctaaaaaaagggctaatcagaataaccctggatgttttttcaccatgttacctctgtactcatatcactatagccaatttttaattaaaaagcttttattttctttcaataggatagtaaaaatgtgcaactgcctgataagtatttgctcttagtatagcacacttttcagatatttttaaagaagtatcagataattaaaacaaaacatataaaaacatatcagctgatattattttctcaatgctcagtatatgaattaactgatgggaatatagagaaacaaaacaatttagaagaaaaatagctcttaagccatcaagtttcaaacatttcaaactcactggaattgtgcaatcactacgagtttgtgtgtgtgtttgtgtgtgtgtgtatgtttagggtaatacactttattgattcattaaaaatgtaagtacagtaagctggaaagtatggcaagtaaaacaaaaaaaaaacaattagaagatttctatgaaaactttacaatctaataaaattgaatcctttttttttgttgttgttctctccccaggcaattattttgctctgttcacatgtcttcacaaaatactttcaattttatttttccaccctcagataaacagattccttttgttcggcagatgagaaacgtaccagctgttagtactactatatccatccatttactaatatttaatgagaaaaaatttaactccattttcagcctttctttccctctgctcattaaagagaagcctgccctcctggaaagcccttacttgtcagcccagttcttgaattatttttaaacagaaagttaggagaaaataatacagtgatgaggataagaaagtgaaagtgctgcaatttttttttcttttaattttttttcttgagaaatgacagggaacagctttggagtgtgtgcaggtaacagatggaagacaaaaagagggattttaagatttgttgctggggcacatgtctctctaatcaagaaatcaagtaaagaactgagttattttatggtattattgtattgcatggcatgtattctttcaaccctgatgcctctctgggactggcccacactggccatgttctccatgagttatttatggtactttaccatttttagagtgtatataaatgctttaccttatttgaacctctgaaaaccacagggtaggcaggaaagatattatacccacattttacatatgactaaaccaaaaaaaaaaatgaaagcgggacaagaattcagactttctaccatagaatttggtggtccttctatcagctatacattgacatatcatatttttatacttaatttattgtgcatttgcttcagggctatatctttacacatccaaacatctaaataacctgtagaaaataaaatcagtgatttatgtgtttacaattatccgaatatttggtattcatatataacagagaaataattaactgcccatttcacttttcacctaacaatctataccttctgtactcttagaagtaacagcactgctcaagaatcactacggttgggggcaaggtgaggggctctgaatcccatttggaagctttcttcagaaatattgcttcttgtgcagaagtcatgggtcaggttttctgtttggttgatgacctgtctatacctacatttacacacacaaacatgtcattcatttgcatttaacttgtcagtctaaaacttgcttatttggccaggtgcagtagcgagcacctataatctaagcactttgggaaactgaagtaggaggattgcttgaggccaggagttcaagaccaaactgggcaatacggtaagatctcacctctacaaaaaattaaatatatatatgcatgatggtgcatgcctgtagtcccagccactagggaggctgaggcaggactgattaagcccaggagttcaaagcttcaatgagctataatggcaccactgcactctaacctgtgtgacaaaataagaccctgtctgaaaaaaaaaaatcatttttaagattaagaataaaaaaatttggatccagagaactaggacttcattcttcttctgtacattatgagctacctgaaaactggtgatgaatatgcttcctttatctctacattctctatttgtaaaatggggataataagagcacccacctcataagggcactgtcaaatgggctaatacacatgagtacttagaacaacatatagtatgcactcaacaatgttaactttttaacattattaagttttattatgttacagttgctagtgcttgctaaaatagtgctgacacatggtagtcacaaaataagtgttattgtggtatatgttaaatgaatctcagttttgccaatgtgtgatcttggaagaagttacttcaccagaaaaataagaatataaaacccacaataatgacagctgcctgacaaggctatcgtgaggaacaaatggaataatatgtcagaaatgctttataaattataaggtgtgaaataaatgctaattaccatgtttgttctctaactttatcctcacaaataggctgttctgtagatgcaattatcctcattttatagaggaggcaacaggcttaaagaggattatataactcgctcaaggtcatttagatggtttggaggaaaacacagatcaaaaatttggtctttttctggccctttaactccagtaccttctttactatctctgttccatacagagatatgatctccctacaatgttatttctgagtattcttatgcttttttttttcacaaatgccatttgaaaatgttgatgaaaatatactttacattttatggatattttgccatcgccaagaaatttaaaaaagagaatgtggcagcaatcccatggcagcaactaacaagttgaatcaatccaacatcctctgaacaggatttcatctttagttttaggttcggtatattaaaagcaagcatcttaaaattccacctgagattaaccttcagcatctgatttttaaagttttgagggtgtggttgtcaaaaaaatgaattactgaggttctgggtgatttcatagggatttttcataaaaaccaaagagtcataagatcttcctagagaggccagcccccaacctgccagtgtgctgatccccaaagacaagctgtcactttgcaaaggattcatactaactcttgcttaatcaggcagatggcatccttgttctgcctcctagtctctgcttccatttgtctcctagacatcaaatactgagtctatagttcagaatcttcttctgcctgtgttccctagtcaacctggaattccctgacactgactgactgacacctttacatccattgtgctataatattctaacacttcgctgatctttgctgcaccctctgcatccatggtatcgctacacacatcccttttttccccgactgagttacctatatttgttcctcctctgctcttttataataagtattggtaaactgtttcttccaatagaaacacaatgtaccaaactatacagtaagtattttccttgccctattgaaaaccgacaacccactctcaagtgagacaaacgtacatgtgtcatcagtgtgtgctgctccgccataattgttcgccatctcatctagatgcctccagactgtcaatgaaatctgaacatgtgggtccaaaatggaatctaatactcaagctgtggcctatccagtacaacatgtagcgagacaataatatctcaggatctgaatacaccccttctgttaaaatgcagcctaggattacactagctttgttcacagccacgtaacaccactgactcacatgaagactgaagacaacacaaccccccacatcttgttcacaaaaactggtagcatgccaggtcttccatatctttacaggacacttggtatttttcaaaaacttaaattcagtccttcatatttctccccactgaatcttaaacctttggtttaggtcaagtgtttcagcctgttaacaacatgttgaatttttaatctatcatgcacatttacatattcctcccaactttttgtgatctgtagctctgattaagcagttatcttgttgcttcttttaatcattgataaaaacgttaaagatactaaggataaatccctaacactttttctaaggaccactcatggtttgatggtgaaccagttatcaaaactttttgtggatgtctaactacagaaaattcatttcaacatctaggccataggctccctttttatttacaataatatcataaaagattttcccaacgcttttgcaaaaattaaatttttaaacaaagttatttctttagtaaccctaccaaaaataaaaataaattcatttcaacatggagttttaatgaacctattttagtttcttctgaacccctaagtctttcagttatctgtttaatgttttgtatgtaaattttattgggaggaactgggatttaccactttttatttacaagaattgggatttactgattttatttaaaaaaacagaattatcttcctcttattaaaattgataaatattttcaattactgtgttttttaaaaacttttaagttcaagtggtacaagtgtaggtttgttacacaggtaaacttgtgtcatgggggtttgttgtacagattatttgaaaacccaggttaagcctagtacccgttagtcatttttttctgatcctctctttcctcccgcccaatatgtgttgttcccctctatgtgcctgacttcaaaccatactacagggtgacagtaaccaaaacaacatggtactggtacaaaaatagacataaagaccaataaaacagaatagagaacccagaaataagaccacacacccacaaccatctgccctttgacaaacctgacaaaaacagcagtgagaaaataattccttactcaatcaattgtgctgggataactggctagctgtatgcaggagattgaaactggacccctttctttcaccatacaaagaaactaactcaagatggattaaagacttaaatgtaaaaccccaaactataaaaactttaggagacgacctaggcaataacattaaggacacaggctggggcaaagatataatgacaaagatgccaaaagaattgcaacaaaagcaaaaattgacaaatgggatctaattaaactaaagagcttctgcaaggcaaaagaaactgtcaacagagtaaagagacaacctacagaataggagaaaatttttgcaaactattattgcatttcttaccactttcacctcgtcatcatctgagctggttgtttctagtgtgtctgcaacctcagtgttcagggatatgaaaaccattagcggaatacataaagcattaagttggaaacaagtatcagcacagaatctctcttgttaacatgcatgaacttcaagaattccactctaagagaaaatgaatagatttagcattgctaatgttaagagttctgtctgtttttcatccaccagttgtctgtggatgttttactgtactccagtcaaatcttagttgtttaaataatgcttattgggttgtggattagccagctctaatgtcctgtccatctatgtctatcagccatttcaatacttgttagtaccaataccatggagtacgcagggagcaacattctggcaagtaaactggattttctttagcagatcttgtaaatgtctttccagttaaattgttgagccattggccagagccaattgaggaatcatctgtggttgggcctgacagccaattctgagagcagaacaccatgaaaaagaatttcctatgaccactgctggtgtagaaaagaaaaaaaaccaaaaaaataaaaaaactgcttaaatacactgaagacataattcaaaatttattctttgtttttaatatctttgtaatatttctgtaaagataaagatctataaaataaagaccacagaagatggagagaagttgagataactgtaaaatcttatctgttgctgttagtcttagcaaacacaatacagggagacatggcattttaatagcttcacatgtgtaaattctagatgatctaggcaacagattcaacacacaataccagttaaaattaaggaaaaaggtctcatttctgtacgcttgttggtgagtcattcattgcgtgggcaggagtgatcacccttacagaatttcttctagaaccataacctcagttggtgagttctgagagctcagacatttttctagaaactaaacagggtacaggacaccagaaccctagggaatcaatttacatttccaacttttcttccagcacccacaccaccttctccccaacttcttatatagcaaaggctctctggtgcctcttttctcttttccccttcatcttgcctcagacttgtgtgttggcctcactttcctagtgttgttttaaagtgactttgctttttctcatgtaattgacaggctaaactatccttgcgtctaacaaaacatcctggaaaaaactgcatttcttagatatcttattcttatcagaatgacttgagctttctgccaaaactacatttaacttgaataatgaattataaaatatgttaaattgacaaatgacactaattcaataaatatattacaaaaaagcaaagaaagcctctactgtattcttgagtcagtatctcatgaaactaataccaactccagtattttacaatttacaaagcactttcatacctgtattcttacttatcagcattactaatactgtattactattatcatttccattttacaaataaggaaattgaaggtttattgaagtaactggagacactgagaaagtaaaccccaaagctcatgaagccaaggtcagtgcattttatttagcatgacttagtacactagttgctatttgaaggtacccctagacattcatttctataaagaccacctacatttcattttctgactcggggtacctaagaggctgtctctcttactttcagaaaggttttgctacatggggacaaaaactagaagggatcttttctagcaaaataatgcctaaggttcaaggatttcttagtatgatattggtggtccctggcccagcccctggaatgatccctgtgtgcattcatttcaggtgttcacaggaaagtctagatttagtacaggctcacattttcctttcagtgtaggggttaagattttgataaagtagaagcaaattgctcaagttaaatcccttcattgttgcctttcaaatatacattacagcttcagaaatagggtggactttaggtaagaagggggagaaaatggtgttaggcagaggccaggggcagtcctgttgactctcatggatctgacagggaaaatcagtagtttctcattgtgaacataggctttgatgtctagcaaagcttgactacaatgttaccaaggctcagggacctcactcttaaaacacagaagatgttagtgtcttctacctcttagggtttttgtgaggaccgaataggctaatgaaggtaaagcacaatacatagtcaacttgcacatagtgaatgctcaataaatcctagctcttgctattatgagattttatctgattttggagatagaacagagacacatatgtttaaagaggaaacaagagagaacaaaggtttaaactgtctttgagatgggatgtgcaaaattgtctcccagcagaaagagttgatcatatcctctggaaacccgatctctggcaggcagattctgaggctgtgacatcactgattcttgttgctgtggcagcagccctgcagccagacaatacggttttacaacagaaccaggtccccagttggtctcctgggccaggcactgagacaaaaaaccaggactatattcgtacatggaactgggatgtaacatcctacccatgacttaatttataagcattgtttattctctttggagcaaatgaaatgcttttccaagggacagctgcaaaggccaaggatttgaaaagaagaaaattatgataaacccctcttaatgcaggaaagattagatagcttgctaccagaaatcaagaaatatttataataatcacattcaaccctagactttcctctaagaatctaaacagaaaactttaatcctccagaatgtaaactgatgccatggctatatatggtcacagaaatcctaaggggaagaaaaagaaaagaagagggggagaaaaaataaacacccagttgctgtgtctcttaaattggtgtatgtgtgttctaccacagagatctgttaaccttggcaaaatttacaagtaagaagcattaatcaactttacacaagtacacgtgacactttcctttttaagtggaagccacaaactcctctccctttgggaaatctcactgtcatgctgaggatttttcttcatagataatactaccatggcaaacatcaaaaacaactggattccatattctgtgggcttgaccgccccatgaaggcaagcaatattaacttttcttgtggttgacttcttttctttttttctcctttctctacttcttttggcctttaggctagaaagactgtttcttgaaagtattcaactattcttggaaattgcaacattttcctgcattctttctatgttgaagacacttccagactaagtttgggttctagggaatcttgcagaagatacttcctcccctgtagttaataagccatcgcttataccacggtattttgttgtttgactcacgtctccagtgtaacagtggaaagtcattatctctggctttggtgttaacatagggagggatagcaaattgcctcactctactagtgaatgaatagaagagaaatccttgatggtttatcaagagaggtattatgggaacacaaaggaaaaaaataaattcttacaaaataccaacagcagccttgcaatccccgtcaaaatgtacccaaccaacttaagggggaaaaaaaaattcaaactatgtcctagccataaattgaagaaagaagtccagaaatgttaaaaatgtttataatcatcaaaattagtattttttgccttgaaggatgtctctttaaaaggctattcttaccaggttttgtgttgtaatattaaaagtggcttacaaaagagtgaatgtcaattgcaaaattaaatttatctctgggtatgtgattctatctctttactaatatacaaagctgtcttgaatgatttacacctactttccacccacaggtcctctgccagggtcaatctcagcagaaacatgactcttcaaaaatagatcatcacagttgtgattaaatctcccatgttcaaaatttacagcctataattcaatgccgatatgaataatgacttaaataaaaagttacagtcaccctctttccccttccccctaaaatgaccccaagactaatttacagttgtgggaggtggggactaagagctcttgagtatctattttaagctaggcatttttcaagtttttttacttacataaccctatttagcctgccgaacaatccagtggaatagtactaatttatctaatttacacataaggaaatgaaggctgagagaacttgagtaacttagccaaatagtacagttggatccgaggctcagaattcccactttttccttcctacaaacaaacagtagataaacaaaatattcatgtaaggcttaatggcaggtggcatgagagtactgaatttcattgtatgtatctgcaccctccattcccccatcttttgccatttgtgctccatattccctgacagtgcaccaaaaacaataggtttaggtattctctttcagatatcttccaaacaagtgtgcataaaatggactagaaggcaacttgatagagcaaataaattcacgtgctcttctcaagaaatctgagaagaggtatcagatacactccttgcctgacccagtgtgaaacacaggacgcagtgaggtaaagtttggacttttccatcctcagagcacacacaaatccactgaggattaaaaccacacaaccaggaaaaaatgttaagttacagaaagagctctttaaagccaaaagtcatacagctcatgagaagagagaagtcactttgtgctcaggtgaacaggaaaactttaaagaaaagatggaataaggccaggcacagcggctcatctctgtaatcacagcactttggaaggccaaggcaggtgggttccttgagcccaggagttccagaccagcccgggaaatatggggagaccctgtctctgtatttatatatatatttatattaaaaacaaaaacaaaaacaaaatttaaaaaagaaaagatgaaatgaataaaaataatttatatatggaaaggacttaaggctattcaggtgtgtgtgtatatatatatgtatgtatttggaattataaactgtacattttgcataggggtgacttgattacagcaagggaaattaacctgcccctgaataggcctgtaaaggaaagaactaggtaaagaaaccatttagtaagttattacccaaatccagctttgttggtgataaagtgaaccaaggtgatggtggcagacagaataagaacaataactttcccagcctggcctgacacacattcaggcctgatacacacacaggctgtatcagcctggcctgatacagcctctaaaagattattctagaggctgatcccacatggtgataataaaccatttcaactgctttgtgaatgaccaaagatgacatatgtttaaggactttttttaagaattgagacactgaaaatacagactagccatttttaaaagtactcgtcaatatccactaaaaaggagccccttatattttcatcttccttatttaccaaagctagcttcatcagtataaactagaaaggtaattccagagtaataaatcttccatggagagctctctacctctggctgcttgataatgaatttaatcagtcgggagaacagccctgtcattatggattaatcaccaaagactgttttggtaagttgatgctgtgtttgcagctgatggtggtcacaagacacacttgatatttttaagaaatttagagattgaaggaatgctcagttaattaacaaccacaaaacacaacaaacaaaaaatagaaaccctaagaacagcataaacacagatattagtacctttggctttgatgaattcaagacagaattgactcaaaatattggtaatatttatcttcctgttggtttgtttggtttattttccaatccaattagggaattttaagccagtggattctggagcagggtgaattttcctaacaaacttacttacaatatatccaattagtaaagtgcagctcattttaaaaaataagcattttaattggatagttttattagaagaattttatgtttccttttcaacatggtatcaaataccataaagtcctcattaaactttcatgtatatgactccaggatcattaccacagatagaattaagtaaagttggctaagagtggtctagtcaattattctcctaaaagatattaaggatttcagatgagttaagacccactcccaaagaaactgaaacaagttaatcacttgacaactatatcaagttatatgcttaggctgggagtggtggctcacacctgtaatcccagcactttggaaggtcaaggcaggcagattgcttgagctcgaaagttgaagaccagcccaggcaacacagggaaaccctgcctctataaaaatacaaaaattagctgggcgcagtggtgcacacctgtagtttcagctactcagaggctgacatgggagagtcgcttgagcttaggaggcagaggctacagtgagctgagacagcaccactacactccagcttgggtgacagagcaagaccctgtctcaaaataaataaataaataaataaaaagttgtaatttgtaggttgactttttcaacagtatatttagaatgctgaatgaagaggtagactctcaaacctaaaattttcttctagaatatatttttttccaacatctttgtcattcctcttaagtttcactgattgcaatataagtttgtgacttaactgttaacctatcagtctagtatttgtggccaaccttaagcatctaacaatgtacaatttacattgtacctcaacggtttctgtctcagataagctaacctaagccaattttgcttgtcaatattttggtaaataatcatggtcacctgggattagagatagacagtagctatggtttgttcgcctacaatttcactatcaaacgttctgttctataaaagcaagtctcagactaaattctgctgaaccttccacatttgtttacaaacaggcacaaaatagacattgtaaatctgaggaggtctcactctctgttgtcagtcactctgacatttacctcataagcaatgttcatgcatttcagtcaagttcaaaagtggcgaaaggaaaagaaaggaaaagggaaagggaaaaggaaaaggaaaggaaagttcacgctgtggcagatgcaaccaacaaacaacaggaccaggcaaccatggagtcacttagccagtggaggccccagtgaaatgggagacaaggaccgatgatgctttgactctgtgtactaactgcctcaaaagtattgagcagctgggctagcagattctatatgtccttaatgcaggaggagtagggcttataaaatctctcctgtcaactaaataatctgaatacttgtaatttccaaaatggaaacttattccatatgtctattataattaccatgccctctattatgcaataggtagaattctaagatgacccccatgaaccatgaccaggtatataattctcttctcttgagtgggaacaatacatacaacttgcttcttatgaatagaatatggcaaaggtgaggggatgtcactcctaagactgggctattttgtatggcaaaagtgaagaaagtgtgcatatgtaattaaggtccttaattatttgactttaagttactcaaggaagagtttatcccgagtgagcctagcctaatcaggtaacccattaagaagagggtccagggcttcactgaaagaagaaactcaaagacattctccagttggctttgaataagcaagccaccatgaagtctatggattcgagaaagtgaattttgccaaaaaccacatgagttttgaagaggaccccaagcatcacataagaccccagccttggccaataccttgagtgcaggcttgtgagaccctgagcagggagcccagttaaacactgcatggtcttctaatccatggaaactgagataacaaacgtatgttgttttaagccactatatttctggtaatttgccatgcaccaacaaaaagctaatataaaaatatttgaagtgcttgaagtctcacttctgaattgtgtgcttcagatgccaactcacagccctagagcagagctcaaagtgaatctacacacacatgcaccacctgtttttttctcaagtaatttaaaatagatttccaccatagataataaaaaactctggtccacatacctggtcttagtctctagatacgacatcaccgagtatgagtgggagctggaagcactgcagatattgtttagtcttctcctgcctctccaatcaggtctacttctactaccttctccctgttatagatgacaaagtagagccctacaaagtttctgtggcttcctcaaggccattcagttgcagaataagactgaaatcttgtgtcctatggtcatcaattcaaaatgtttttatttcaccctgttgtaatgaagtcttcttattgtcttataatttctaccacaaactccaacttcatttcacaggttttaaagaaaattatcctgtactctttgtcatccattcattcattcatcaaatatgtattaataacctgctgtatgcaatgcgttgttctaggagctggtgataaatcagtgaacagaacagataaaaatctatgcctttatagagtttaaattctggtgaaagggaaataagaaataagaaaaaccactgaaatgcctagtatatttcatattgataagtgctcagggggaaacagtatatggaaggacatgggagctgcaatttcctggatttcaggaagatctcttgcagaaaagtgccatctgagtaacagcctgaagacaagaagggagtgagttaagcaggtatgtggaagaaaattgttccaggcagaaggatgaagaaatgcaaaggttatgtgtgagtagaaaccttggagtacaagacctagaaaaactgaaggaagcccagatggctgaagtagagtatgtgatggggagaatgggtctgacaggtaacaggaggccaggctttgtggagtttttactctcagtgaagtgcgaagctagtggagagttttgagcagaggagtgtctgggaaaatcagcattatttcttgggagtttcaaactagaaccaagtcagagtgttcatatagctgataacagtttgtacctttcctgtggaagagaaagctgcccgtcatctgcagagaaagaggaatgagtcagacacatggagagaagtagaggtcagaagccagaaagaattcagccaggtatcacacacatgctcctgttcctgttaaattcctattttggcccagcgaactcacttctctctttaaaatggccttgcccctcattttgctgaggttgagctcaatgccacctcctagagaggtcttctttgaccatattctaaagtagcagtatcaaacactctatctccttctcctgcctaagttgtattcatgctaggcatttatcaccactttacaatgcactatttatttgttcactgttttgttcccagactggaatgttcaccccatgagggcaggctctttgtccatctttgtcactgttttaccgccagtttccagaatagcatctggctcataatagatgccattttaataattttttagtgaataaatgcaaatacctaaaatccccatggttatttactccacttggaaagcttgttaaaacatgaattactggaccctctcttgagaatttctgattccgttttgaggtggtgcttaatcatttgaatctctaagcttccaggtcatgtccttgctactgatccatggaccacactttgaaaactactgttctatacctcgctagtttctgttacaattaagaagttttagctaatgtagatgacttgaattcttttttcttcaatttttcatatgatttttgttttcttccttcaaccataataagatgatacttaaattttgtcttaaccaggagatctataaatacaggcttatccatcccacttataagcatggcaaatggtgcttctcaaaagtgtcccccatgaaccctctggtcacctaaccgaagtcgcccccttgcctgtccttagcttgactatgttgtgcagccatttcactgaatctcattccagactaatgtttccatagccttcatgattttgcctttttttttttccctgcagagaatgtgtctgtttaccgcatcaccatcacctttgggaccctgtgcctttatgtcagcactggtgctctaagaggcttcttctttgctcattttcccagagccacattttccttggggcagcatcttcaaaacttgccactgaagtctcctgaagtctttctaaatatctattaaagttctcaggctaaacttaatgtaaaacatatactcacagtaaaaacttaatggctcactcaaatattttgccaatatggagccattaggaaagagctctagtaggtctcatactgttagagatgtgaaaattaataaaatactttaagtcttatttatgtcacttgataccacatgtcagcacattttctgacattatatcataatgtctacaatgaaaatcatggaaaattttggcttactacatttagcttgatcagtgctttgtagtttacaaagcactgtttgttgttctatctcaatagcaatgccaagaggtaaaccgaacaagtatccttgtactcattttccatatgataaagctgatgcttgaagaggtcaagggcttgaccccaggccatgctgatagacagcaagagtcacactcatatatatgccaagcatgcaaggcccttgccttcacagtctatttacaaaacagcctggaagaataataaatcaatcctaagaattgctatgaaatgcctttagcataggcattaatgtgcaatggatgtacagcctattcaatttcttcatgaatctctatagtcttcacaaggaactttcactagaaaaaaagacaaacttatctgttttatctcatttttttttaacaccaaggactatgagacagatgcaaaatcatttttgatttgttggttgaggattgactgaaatcattactaattattcggcacaagtgggttccaccagctgcacttgaagaacacttcaacatcctaaagcaaaataaagtagcttacggcaagtgatgagtgccttaattatgttattgctacacttactgcgatttcaaagattaaacttaatagaatttcctgagcaatgatggtccacactggatctgagggggcttttcacaaaggaaaaggagaaaatacttactaacctggctacagctagatctggcctccctactaaaatgagggttaccaggtgtcctacttcttcagggaatgtgctacttttcaacaaatcaccctgcgtatgggatccaaagtagggcagtaaaaatgtctggctttctgtgacatgccagattcttctcctctctctgactcactgattttccacacctttcagtgtccgagtttgaagtttttcttagactgaagaaacttaggattggtcaattccccaaacctcttcatttcctatagcagaatgtgattaaagaaaaatttccaccaaccaggcaagccaaattttctagattgtatatccacaacaacaacctcagctggttgctccaaacatcaaaatcgggggttggctgcactcggcaataccaccagccctgcttgaaatggtttactgcatgatgaatgctgaactgtcacctcttccagggagcctttcccaatccactacatgctccacccacccacccacatgcttggctgaaattaacttttccatttccctgtccttccacaacactccttatatacttctcttaaagtaagtataacaagattcctagtatcttagagattcctgtgggacaaacttcacaactcctttctcttctcacatctctccatgagtttatgaaccttcaattcatatctccagaacaggtttctttctcttcacttcgtcaaaattttattcatctcacagaattcaggtcaaatgtcttttacctggccccattcttcccatctccataaagttagtcaaaacttccttcatgatctctgataactatgaaatggacccagctgtcctatagaacagatgtttatggtttcttttaaataaacatagaagttgactctcccagtcttaaaacttgagaaagttacatttgtcttatctgagttcctttttcaggaaaccaaccattgggcctcctagatagtatcaaggaactgaaactttccagatcaccatctggacaaagagaagccacacccctcacctatcatgactgcctaactgaccacctgcttcctgttcaccaactcctcttccatacctctccctaattcctgttctcctcatgtacttacatttcttccctgctctacaaacccgattttagtcagtcaggaggatggatttgagactgatctcctatctcctcggctgcagcacccaataaagccttcttccctgacaataatcattgtttcagtgattgattttctgtgcagcaagcagtaggacctaaccagaacccctggcatttcagtaacacacatttctctactgtagcactaatattgtaattagtttaattattactttacatatcttcttcactagactgtgaattcatccaaagaggccaagcttaatgacctgccacagagtctagcatattatagctcagaaaggcataacagtagaagttctcctaaccaatctctacttaatgatgacttattggtgaactgaacattctctgtagcacagtgagtacatacacctagtaggcggtcttcaggtacatccagatggtagaactgcacatttgccaagggttagtatttttattccgtaacctgtttacatcacttttgttaccgtaatttccataatttgattaaatattattcaaatcaataaaatatgagtgttttaaaacagttatccctataagaaacaagcagaatgccttgtaagtactaataaacactccgtaaagactagtattattttcttttgactgcctgatttgatgtaaagaagacaattataaaagactgggcaaaatatgtatgaactctgcaattagattgccttgcaaccatctaaactgaaaatcgtatattataggtatggtttgagcaaataagaaaacacaaatttacaactggtggacctttgcttaaagaaaagctttaattgttctactaaaatagaagtgagtaaatgtacatttatatgttttagttaaaatagaatgtctattttaaaattatttaaaattcctactttgacattttgattaactaccaggaatataagagggattctattataattatgtctttcttggttgattcattcattaattcatctgaataaacacttgatgaatactatatttgcttttatactatttaatacacaacctgtcttatggcatttattgttgacatataaatgtggcacatagtgcttggcaaattaggtacccaatgataaaacactaaatgaatctggacctattatccctgctttgattttgttttttaatgatacgttctgttttgacacatccttgtattcaaaattggcaaattaaagattacagacacgttgtagataataaacataaatcatggagcaaagtttcatgaatttttcacatttttttgaaatttggagaggctattgtttgtatatctcacttgtcacttagtaacttttacataccggaacaaatttgatatatgttttttgtccttagttggacaacaaaataacaaacattatattttagaattgctcttatccttcgccatgtttataagaaacatttgacacaggaaccatcccaaagacatttggtgactgtcattcgcttcatattttggtagagagcatcactcaagtttagtaataaaaataataacaatgagcatatttgccatgtgacagacctgtgttaaataattatataaattatctctttctagatttacaactatgatagtactcactagagaagtaggtactaacagagaaaaaaattaaatcttagataaaaaaatttgctcaaggtcacaccaactaattaagtaatacttaatacataaacaagtattaaatattaagtagttgtcacttaaatccatttgatggattttgtcaatttatttggcaagacactatttaacaaaggtacagatccacagaagtcacagactgtggtatatgagatgcatacgtgtgatagggaaattgtcataattaatagcatctgtaaacattatccttaacagaaattttagagatacaatgtagtcctatatccaagagtgaaccttcagtcattcacagatctggtaacagggcatctgcgaactttacaattcactataaagtaataaatggtaagcactggccaggtgcagtgactcacacctgcaatctcaacattttgggaggttgaaatgggaagattgcttgaggccaggagttttacaccagccaagacaacacagcaagagcccatctctacagtttttttttttaacagttagacatggtgggcctgtagtcccagctactcaggaggctgacacatgaagatcacatgaatcccaggagttggagactgcagtgagctaagaatgtgccactgcactttagtctgggagaccgagcaagaccctgtctctaaaataaataaataacattttaaaaaatgttaagaattattaaactgttatttattgtattaactagaaactttcttgattcactctgtatgttattgagcacagtcttttgtagattgttgaaatttgatgaaaacacaatgagacagtctcaagcagaacagaaccttgcatcatgaatcatgggtatagaaggcaacattctctaattatctttgaaagaaggtacactatacatcaacatcatcatcattcaaaaagaacatagaagacagaactaaattcttctataaataagaaatggactcacttggccatcattgcaccacctattggtttctactatgctcatttcttcaagatattatagttgtattttgtcatgatctttggtggaatattttatattttttatttatgtatcagggaggttttgttaaaaaatttcaaggactggatgaaagcctttcgaaaccaaaaaatatttaaaaacctaatttctcattactttcacatttgggcatttaaaaatgtattagcttttacaattttttcccggcattttatcttctattgcaattattgtcttttctgtggtcagatgagtcaaggctttacttgtgtagattaacaactgttacttataatagcacttgtaatttcacaaggattgcataatcaaggtcaaatctctttcctaatgcctgccaccacttctccttaagtatatagagttcttctaaatctaagtgatatagtactttcttataaaatacatttctaaaataatcataaatgacatgccactattcaattcctatagtactcaaaaattcaactcttatagtacttttgatcctgtagtgatgaaaagttaattgcaaatagtacggtcattaattgctatcacctttttaagagcgagtatgttcttaactgtttctgcaaatagaagatgcaataggaataatcctagtctcgaggaggaaactccttttttctaatcaagttttataaggaacagtttttgagacatactactgtaactctgggcttttctccttctccttcagtgatcagccacacttaaagaaagttgtcttgaatactggatttaaaacattcatttattttttcctacctttctcttttaatctctctcaaatcaccatttttcaaagtatctgttttttggaaactgtatcaattgctacgaaaagacagaagtataaatataggtgaggagatttataataaacacgggataatgataataataacatcaatataatgtaaaagttatcatatcaacaaggaaaaaaatgtaccatgaggagcaacataaaacaaagtttaaactttggcaggctgaagccaaggaaacttttgaacacttaatataccatctttcaaatgtctttctggagagcagtttgctaaagtgtactaaaaaaagttttaaacttcatgctttttgattcagtaaatccccttaaaggaatctattttaaaacagaagcttggcaaatataagtgtaaaatatgtaatgacaatggtttttaaaattaaaatagtcctggaaattataaaatgtccaaataaaaaaaagtacacaaaatgataatccacttgatgatagaatattattccaccactacaaagatttgagaggtagaaagaacattcacaaaaatgtaaaccttctgaattataataggtgattttcatttttatctttataaatttttaaattctccgagttttctttattgaactggtattgcttttgagctccaaataaatgctactatgtgttttaaaagaatatctgatagcatggagtatgcttacaatacaatcaagatataaagtataattttaattttgaaatataagtttacatatgcccacggacaaaaacaaaaaggactgttaggaaatacgtggaaatcttaaatgactacctgttattaatacagctggagataatttatattattttattttagtttagatattttccagaattttataatgagtctattttactttcaaatggtaaatgtgtgtgtgtatataacagagcaatagaagtcaatgtagcggaattcctttccttggctcaaacctgaggcttcctctcagaccttgggacaaaggtctgagaaataatatgaggcttttacattatttaatctcaccaaagaatgaatgcatgaaaaataaagcctaaagctattttagatcaggatttttatttaacatcaagtaaatgaaaaaagagataatgaataatgggactacccttttatgatatacaaagcaaggtattgggtctaattacttgatgaaatttaaaaatcaaaaaaaaaaataaagggaaaacaatgcagttaagtttccaagtatattattaataaataattgtaggaaaagtcagtaagtccatatattcatgtacggaaacagaacccatgatggatgagcattggttactcctcattgctggaggttttataagcaaacaggccagttttcttcttttgtggctttgtgagttttgccccttgacataaataatgtatccctaaaataccatgaatgacaacaaactaccattttgtcttccttgtctatcttcagtatgtggtggttctactatagcagatcacttcaacccaaatattatctttaaactctccaatggtgtacacttgaataaagagaaactagaatatcttaagtaacttggatcctaaaattcacagagatcaaattgtacatgagcataacaacctttatgaagatccaaagaatgaatgattcattggaaacaagtatgttccaaaggctgacctcacagagcattggacctcagaattcaacctccatctctgtctttctttccttgtattttatttaggtttattctgtagtaatggtatttccagggtctacatctttacttggatattttgttcctctttgtgtgccttctctctagagaaatgctgcaagtatagatcaccaccttattttagcttcccattactgtggcatgtagaagagaagcaaaggagataacaaagaaattgatatattctattcacacaggggtaggatgggaagatacaagcttttaatgaactggctaaagtttccaaaactcaaactttttttttccataatttttgcaaagctaattgaaaccagatacaaaacatcgcagacaaactacctaagagtaccttgattattccttctgcattgttctcactgttatttatctgaagaaaggggcatcctagacgttatagctatattttcataataaactatctatgctaattatgttgaactagacttatcaggaggatattaacttggggtacttaagaattagttgtggtggctcatgcctgtaatcccaaaacattgagaagcctagcggggtggatcacttgaggtcaggagtttgagaccagcctggccaacatggtgaaaccctgtctctactaaaaacacaaaaattagcgggtgtggtggcatgtgcctgtaatcccagctactttggagcctgagacatgagaattgtttgaacctgggaggtggaggctgcagtgagccgaaatcatgccactgcactccagtctgggctacagaaagagagactgcctcaaaaaaaaaaaaaaaaaaaaaaagaattagttgagactgatgggctactaaggaaatctctcataccagttaatcaatttagctactttgtatctcaaattggcatctctaaattgtgactgaaaagtatataatcccttttcaaagcaagtcatggtgaaaaatgttcccacttaagccaaataaacaaatgtttatgccactgatgagtagtgccccttagaaatcatcaaaacccgctttagggattagggcagaacatttgagagtataattaaatgcataaaagtgcttaaacttgaattgctacaaaatatagaaaccatttggaaatgttttatggatcacattaatgtgtgtgtgtccccgtgaaacataagatatatagttgttgttgcataatgagttctgacagcacgcttcctagaagatgacgttcatctgagcagtatcttacttttcattctacagcattgcaaaaagtgactaatgatagagaaaatactgaagagcatctcctttgatactaacttcaagcttctaaaccatgagaaggacccatttaaaacgttaggctcatttactgatgagagtggaccaaagaaaatcactctatgcatctaagcaacagtatgtagtgtcatcactaatttatgtcctttgggtaaacgttcttgttaaacacactggtttttgacaattttgttggaaattttctgtttataaatttcctcttttattcagaagcttggaccaaatcaaataacgcaaagtgaacaatgctcttttggtgatgtgcaaaacaaagagaactctaaaacattctgttaattttaataaacaacatgacttagaaaaaagtaaataaatcaaaaagcaagtagaatccaaatacccaaataacgggtgtgttagataaaactattaaataggaataaaatcagataagaaaattgcttaagaccttgagcctgctgtgaaatatttagtgaatctagggaacaaaggataacataatgaagctaaagtttaggaaacgtaagtgttcacctatcacactgtcttagaaatgtgtatataaatacatacgtatatatgtgtgtatacatatttacacaaatgtggctatatattttttgcaggtttttatacatatatttgagtgtgtgtgtgtaaataaagttcacagggatggcctgaagcttaacctaaaatatttctatttcaaagttgatcctatttataggcgtatttaacagagaggctatacggacaatttgtagagatcaatagttggctgtatagaaaggattttttttttaccctttataatgttgtgaatccctaatccccagtctcacggtaagtgtcctacatatttagtagagggtgatatgaacattcaattcttaaaccctttggtgccagccttaagctatcagtttgcaatatttcatatttacaatctaatctaagcttccaggattttcctcactctgaaagataaaacagacattttaaaatatgtatcattaattctaagttttagcaaataaaattgctacactgagacaaaatgtggttacaaaaatcattgtgtcagttaccaaaaatcccaagtctaccacttagactacttttatgtcccaccaataaaaactataaccccagaccatccaactgaatgagccacgaaaattacccccattcccatgttactgcctttccaattcccatgtcactccctttccaattcccatgtcagttgtgggtctcatacctaggtgtggggaagcaaaagaaagtttaaattatgagaaattgttttcagatacttttttttatgatggacacttaaaaatttggggaaatatatatatgatatatgatatatatgatatatatatcatatatatcaaagaaaatcaatgttataatcagccagtctccccaaatcaccaaagctaataaaatattttcttccaatttatagacacacacacacacacatacacacacagtgaatctggtattctaccaactaacatgttataaacattttccctcctcattgaaagttcctcaatcttcctttttctaatggctgtataatattccataatatagatatgttgtaatgtattattaggcaattgtaatggaagaaacattttactagaaaatctggattacacaacctagtcactgtagtaaagtaagagcattagtagaaactgtaattgttttagaagcttttagaagtgacagattcacctatcgtttcccgtactcttcaccgacattccttaaggagcagattctgttcagcttgcaattgtcacttggcttggaatcatataattatttaccactttttttttaactttcaattgtggataaaatgtttattaaatgaggctgattcacctcagctccaaagtctgtggcaatttctcacctgcttcctgctaattattctaaatagttacagaaacataattgtgattcaagtggttctccaagtagagtccctggaccaccaatttcagaaatacctgagaatttactagaatgtcaattcttgcataccatctaggtctactaagtcataaactctgaggatgaagttcagcaatctgtattttaacaaacctccaggttattctgatgccccctcaacttgaggaaccaccatcttatcctatagacagatcatgctgttgaaatgtgccattttcacatacacatagtccacagaggcttctgccatgttttttttaacaacccgatatgtaacttttgtcccagcaacattttaacatcaggggactgcatccatttcaatctgaacacttttgtccaatcactccaagtgagcttaagaaaatgtagagtaaatttttttaaaagatctgtgtacccaatttgatagacattttatcttattttggcatttctattctcaggtagcaaattgcctgaaagggcaaacaataaatatgggagctaccgcatggctctttgtggatatatttggaggcagtttaacatgctgtggagatgtttctagaaagattactgacaagatcaaccattttatgaaagttgcttttattacctttggattttttctaacttgaaaaatattgctcttaaagtatgcttctctactaatccttcctgttgagcattctattctccttaaaatatatatatatataaatatatatgtagatgcgtgtgtgtatatatattacacacacacatatgtctgtgtgtatgtgtgtgtgtacatatgcacactcacaaataattaagtaattccattctgggagaaagactttgaagaaaagcagtttatttgctactcagaaagggaaagtgatgttcgtgggacataaagggatttgaataaataggaataagtgtccttttaaaagaaagcagcatatggaactagaaatactttctggaagctctaatctcctatttgaagaaaatccaattgttctggctggtggcaaactaggagattacagctgaatttctctccctccattcaatgtgaagtaatcatagagccataaggaatttgacaggaaccataaatacttctcctgtaaatccctaaaaatttataagagcattatgactttcatgctctttctttcctagagtctttacttcaaagtcttctgagactagaagagcccctggagcaatcattctgcttccatatccacaacttggaactcttagtcccagaccctcaaattatagaacctgagggaaaatttagggggcactgaaaccaaataccttcacgtgtcagatgacaaaataaatcaggtagacaaaaagtgttaaccacatcacgcaaagaccaaaacccaaagttccacattttcaggcagagccctcagcctcatgtcactaggcttcatttctaccaatatcgccccactgactaaatgtcctttgtcactagaattgtttagttctgcataaatacaaagtatcgatgatcaaatttgacttatttcttctcattcagtccttaagtggaaacagcaaaatgctggttgccttctcttaaaaaaacaaacaaacaaacaaaataagaaggaaggagaaggaaggaaggagaaaaataaaaaagaaagcgagaatgaacaaagagtgaacaaatgaaccaacggaagaatgaaaaataaaagaaagaaaaaagaaaggaagagaggaagaaagaaaagaaaaaagaaagaaaagaaaaagaaaaagaaaagagaaagaaaaagaaagagaaaggaagcaagcaagcaagcaagcaagcaagcaagaaaacctaaagatctttatcatcacatttaaataagagtaaatctcaagaggccatcttatctacccgttcccactaggcattactcaacagagaaccaatagctaggaacttcctctattcctaaagattttcaagaaaggaagagaaatatcttgggaagtttaggaaacataaatatttaggctcatttattgatgaaagtgggcaaaatgaaatcatcctatgcatcttagtaatactatgtggtatcacaagcagcttgacataacaggctggtatcaattgtcatgggtaagtgctaattgctgaagatctaccaatttgctgtgtgcttttactaaaaatatctttgaaagttccacagccttccaagattttgtattccttgatataacctttaaattgccttcttcacattccctcttgtttgttagtaatgaaatgccaatgatcacagtaccggaaaaaagaaaacggagaagaggacaataaaaaatcatggttatgatttgtggagcaaaggagggctttcagcattaatatttacattaatgtttacgttaaagtgggacagattacactactttttactcacttcacttcttcttaccctgcatagagttaaatacttactgtttgtgccttgtaagaactctaaagattatagtgtactagtaaatctactttattttgctggcaggagtcagcagacaaaagaggagcaggagaaatgttgtcaaatcaatagtgatactgactgaattttatcagtgtttcatctttagctgaactatatgaactcattcagattttaaaaaatatgtaaactgtctaatctattttatagctccgttttacagagttataacatgtcaagaacaaagttacaaaatccaaaacatacaagttagcatcacctctatttttttctgaaaattccgaaagtacaatgattagaacacacttcaaacctcacagctctgtattacttaggaaaaaaatcccaacagctatccagttgtgctttgaggtcatttctcaaagcatgtgcattaagaaacttagcaatctatgtttatggttgctttatctggtagtataatacaatgaaaatctcacatataaaatttataatgtgatatttacaggttcaagggtggaattgctatgttccaaatgattttctgtcatcccttagttcactgtttctttaatcctttaaaacaatctgtacagcctttgctgtaaaagattattacattcttatttccactgtgtagtcataattttgaatgtactctctaatttaccaacattgtttccaattccatataaacccatatgagggtgctcccagcaaaactaattagggggataactgtgtaatgtgaaaaaataaagaattggaatattatccttgtgtcatttgatttgccaaaattcagcttgtaacaattagatactacagttggaaaattagtgattttatttatataacaggatctgtcataaaagagccaaactggcaaaatcactaatagtcataacctaaatcacccaatcaaccaaaatattataaagttcagcttttatttttatgcctattacccttttcatggcaatgggttatttcaaataccccaccacaagccctgagaacacagctgggttacttgaaaccagtagctctaaaccagtggtgacttgccccttaggtgacatgtgtcaatgactgaagacagttttgcttgtggcagtctgggggatgctactgacattttgtgtagggctcaggaatgctgctaaacatcctacagtagtgcacaggacagccccccacaaagaagaatgacctgggctaaaatgtcaacggagcttaaaaaaaggttactagtctaagtgagcttaagttgagaaaccctgcactaacattaagaactatgtgtccaacacggttgcaacatgttacgcaaacacctgcattttgtggggtggggggtgaatacagccattctagggagagtaatttgttctaacttgggtatttctgcccaataagctagtaagatatttgctttttctaacgtggattcatcagggcactgaaatttaactattttatttaaaatatggtatatactatttctttgtggtttttctgttagtgtgtgtgtgtgcgtgtgtgtgtggtgtgtgagtgaatttctgaaacagagcggtagcaagcaaatggcagatttggttttatcatcaagtttctgttagacatttcgataagattatacagagcatatagtggatgcctactacatatttattgatttttgaaaataaagtttgtgaacctatttctgctatcttcctctttagagaactgtgattgcatttttcttctttttttctaacatgtatagagtgcctgttgccatagtaatcactgatttagcacaacgtgttttttcctccttctttaaaaaaaaattagttcccattcctgccaaaaaggaacatattaatctacccatcatgctagcttggggaagttgaaggccacagaagttgtcatttgtgcaaagactcccagaaagtcagttgttagcatcttctgtgccaagaactctaccccaatcccagagaggaaatgagacactgaagtaaaagattctggagctgaggaggtaacatctctcttcttttctgcaaagtcccacaaaagatgtgcacaaatgctcatgtctgtgtaaacaaattcacctactgattatagatttaacagaccactgatgtccagaaaacagggactaactagacagtgctctttaagacaaaagtttaccttaatctacttacttctgagggtaggggaacaacaacaaaagcaacaactaaagaaacaaaaaccttttgagaagtctaaaagaagtagagaaatcctactgaagaaaccaacatcaacagtttcatttctttatcaaataaaaagtccggcctgagtctcctgactgactacattctttctagtattaggtaaatcagatctcaaatctgatctagccctgctattcagaccacgaattcctgtaaacatacctatctagaactgtgtgcaggcccctcttatgacaatggtctgtgctcacctggatttttatcactggcactcttagtcaggaccaccagattcttcctaatttctcaagtcaaatccgaaggctaccctgcttgtggtgttccataactctgtctggcccctcatgagaaatgccacctacttggatgagagcatttaagtcagagcaagacagcacagaggttgactttaggttcccatctgacatatttactgttctaagagaggaaaggtagtggaagagaaagaaaaactaaagtggaactgcaggatttctgattttcagaaatgtctgcttattatcagagtgataagaactcaaaattaagacatgggaaaggaaaagatagggatatagagtcagagctgttccttaaccaaaggctttacagaattagaacacagctgacacaggaaattcaatgcaagaaggtcctgctctaaataaaaacagatgaggagaaagtccattcatttttactaatagtatgcatggagaatgaacacacgctgccttttacatagacccttataactgttcatactgttctgtaaaatcagcatatttcttattattttcttctgggaaaaaacacttggctatgcatttccttttaatttcatggaaatgggaaaggggtaaaaggaaagaaagataatacttcctgaaaacttgaatgttttgctgaaaacacccttaaaggaatgtatctctgtcagggtaacaaaaacatttaataaaatatttttaaagcagttggtctctaagagaaaatgtgaggtatatgtaattagtagcaaatatgcattcaattgtactaagcatgaccattcttcccctttaaatcctcaatccatgaagtgtgtttgttaattaggcagtaacttgaagagcgctgcttttcccatagaagtcaggtgctcaactactcaaccatgaatctctacggttacatgaatctatgaatggtctgcaaaccacttatactccaggtttcaattctgctgccagtaataatagtaataataccatcattctattctagtagcacagtgcaaatttaagataattagaagatgatgatagaaatttgaaagcaatggattacaaaacaagactgcatcaaagcataacacgcaacacaacactttttcaattatgtacataacctggaaaaactagttggcaatgaaaaaaatgtgttgagaagtaccttattaattcattaaatatttctgtaatcctatgtttctttaaaaagaaaaaaagattactagtctaagtgagcttttatctttgttaagcagcatccttttaacctccatcatctctaataactaaaaaaaaaaaaaaaaaaaaaaaaaaaaacaagagaagttaaagaagcaaaccagcaagagaaactgtagttgctgtatcaatgacaattattccagtgataatgacctgactttttgggttggtcttctagctagtccacagggatccactgttcaggacggtgttaggggaggtgggctttgtcattttgcacaaggtttgacaggtttcagggtttaaatctgcaatttccatggccctggaaaagtaatgtctaaatattgcttaactgaaagttgctgatgagaatatttcagtgctctgtgcaaagagtggatccgtggatcagttaattttattgaacagaaaaaaggtgaagtattgttgtagggattgaatgagaacagatacacagtgtttaaagtaattcctggcacatagtagatatccaagaaggtgtctgactccaccccttccttttctctctttctgaattgtattccactgtcagctgctagtgtatacatgtcatgagctaatgtgcccattgatggtttagcttatgactttcaggtcagttttctaagttgataaaaacaagcattatagataataaaattcagaggcagttccaacatggaataattggcttgtctcattccatagtcaaagctcatctcaactaagttttccattgctcacagtgaggactagggaagaggaattgctgcaaatccattttcacaggtgggtaatcaacacaagaagcactgtcaactgattgtgggtgtgaaaccatctacgcacttgaaagttttcatgttatcattactatgtatccacatacatttgccgagcctgaccgttccagatcagtcttctgaatgctagctgcatatcagaaccacatatgtatagtttcataaatgtgacaatactcaggccctaccctgagacaagtggcacaaagcattcagaagtggaaaggattctcaccaggagaaccactctgagaatcaatagaaacagagatccaggtcaaagaaaaatattatctttcttccctgggaatcaccagcatttgcacagacttctacaactagctacatgacccagggcaatttcttaaagtgggacacagtgtgctctgaatgcagacctgacactaaatttatcatggttgggtagctgctgccttatggagaatggcctgtgggacactgaacttacacattaaacagctgagccaacggatgtttcaactgccaggaaaataacagaatggggagaccctctgttcatttgacaccagtgccagcttggagaaacagcatttcttctgcagttattgaaagaaagtaacccagaagtacccacagtcttttagctcttaaaatatggagccactttttcttttccagcttatttccaatgcaaacctgattccaggctcaagagaagtacaacgtgccttggtcccttctccctagtcttggtcagcttcttcaattcctcttgctgatctggcctccagtttggctggctttttagaggagtctctcagcactaccagcagagtcttttgacctatgttactaacgcgtgtatcatatctagatccactcctcaccatatgtcatggtactgtcttgttcctggttattggtggtatatttgtttttctactgtatgtagttaaattttaagtaacttaaagaattacaatagcaatacaatttcattataaaaagcagaatatgtggataaacagaaagaagaaaataatatccactatcataccattaaggtgacccactaacacaattttcaaataaatttcctacgtacatattttatttttataaaaatgcaatcatagaatagtcaatatgatttttaaaagtcccttttatgaaataaaatatgtgaacatctttttgtaaataattattcatttgaaacattcttttaaaatggctgtatagtatttccttgtgattttcataaccatccccatattgatatttagcttgttttgaatcttctgctgttataaactatgctaggatgacagttacagctcttcttcaactgctactacccagtttgattgataaatgacacacttcccttggcctaggaagaagcaacagattctgatgtttgcaaaatttgtcagtgtggcttatcaagaaacagactctatctctctatttatctatcatctatatatttgacaaaacattttgaaaaatgacttttaaaaatgaaataaggaatgtaaagtcacaaacagcccagggacccaaatgagaaagcatctgtcagagattcatcagtcaggagtacctattattttaacattttcatggtcatataagaggaaagaacaggtaaaacagccaaagtatcacctgattcccactgatttagaacagaactgcagaaatgttgaaagattttttattagattaagcttcccagcaagaaatctagacagcaatctgcagctagcaacatgccttcggaaaaccaaatacgagattcactgacactgttttgtgagggcctcctctacccctcgtctcccctacccctcgtctcccctttttcacataccccacactaggatcagagaagtttggggaaaaatcaacagaaacaacacgccaggtagattatggccactgcaaccttgctgcagcttaggctaggctcttaggatgaccttctcaaaatccttgaaggagaagttggctgaaggaattttatgcaggtctggaatggtctcgtctctagaggtctagatccaaaaaataaaaagactgcaatttttaatctaactcttaccagaatgaaaaaccatctaaatgctccctaggggccttaaattgttatgttaccaaaaatgctatgctgtgggaaatactaatattaagtaaatagcccctgtcatttttaccaaggacatttgggggaaaaaaagtcactgatgaataagtgaaaccatcttaagttgctgaaactgacataatgaaaaccaccatctttctaaattccttagccaattaactaagggaggggaccacccctcatattgccttatgcccaattcctgcctccaaagaaagaaaaagtaaaaactaaaaggcagaaatgaaatccacaagcagaccgcccggcgccacaccctgggcctggtcgttaaagatcgacccctgacctaatcggttattttacctatagattacagacattgtatagaaaagcactgtgaaaatccctatcctgttttgttctgatctaattaacagtgcatgcagcccccagtcacgtacccgctgcttgctcaatcgatcacgaccctctcgcgtgcacccccttagagttgtgagcccttaaaagggacaggaattgctcactcggtgagctcggctcttgagacaggagtcttgccgatgcccccggccgaataaaccccttccttctttaacttggtgtctgaggagttttgtctgcggcttgtcctgctacgtaacaacttgtatcattcatcactacatttatttccattaacctatcctagaaccaaaagatcctagaaccgaaagatgagggtacataattgaagggaagactcacccaggaaagaaaaagaaaaggagtcagactgggctatctgagaattcacaaaggaactagaagctgtgtagtcaaaatgttcctggcaacgtggcaaatgtatttcaaatcaaaccatgcattcactagactcttcttttctaatcttttgttttctcttggcctgagtcaaagtcctttgtaaaactttcatggatcacatgaggaggaaaggggagaaggagaagcaggcagacagggaggaaatgagagggtgttcctgctggcaaactcagtggggaatgaactacctccttcagagggaaaatgaggtgggagggacagagagccacggaaagaaaggtaccagttcccttgcaagatgggggtaggagagggctcttctcagaaaactagaagagattttggtgatgatgtcagaattggagcatctgccttctaaggactttgtctgccaactggcatagggagcactgcccagagagccagttctccgtgtaataagcaaaggcaggaaatgggcagggagcagtaaactcagtgggaaaagccacatttgaaaaacttgggagagaggaggagaaaaaggaagccacacagaattttggtgccacgaggaggaggacatctgtatcttgtatttgcatggtgttttacagtttagaaaacacagacaccatcataggtcactgtgaggtgggcacatttattactattttccagttgcagaaatcatcacccagaaataagggaaaaacctgattgcaagtcttcttatatgggtctgttctttctactacatctaagacatttctctgtggcatgcctgcactttgcagtgttatcttccaaacaccatctactttcagaaccctacacttcggagaaactgtacttgtaccattcttcaaacacgctacaagttttcctgcctctatgtatttgttcatactatttcttccccttaaacttctttacccaacttggactgttagaatgttgcccaaacctttcaaggtctaaatctccatgttacctgtttttcttctatgctattttttttaacatgattctttgtattacagatatttacaaacatttcttctcccatactaaatttaactttgtattcattttactgcctagtaaagctccttgcatagtaaggaaactagttttgaattaataggccagtcaaaaaaaaaaaaaaaaaaaaaaagaaagaaaagaaagctttgtgagttcttaatatgtattttttgtcacattaagtgaaaaaaaaaaaaaagttccccaaagtcatgaaaccaaagcagattctatttacatttagtgtaagattttgctaactgaatactatatcccaagtttatggggaactatctatacttacttttatatattgatcttacattttgggtgtgtggttatgaggttaattcattaaaatgagtaaaggctcttaatgattctttcttgactttatgggtcatgtgtctaagtacagaagttagtacacataaaaaactgtaattgggtactaaaaaatacatatacagattgccccatatctaattttctaactttaagtgtataattgtcagaggcatttgaagcagagcaactccatccatgaataagggctgggtaaagtaaggctgagacctacagagctgcattctcaagtggtgaggcattcttagtcacaggacgcgatacaggtcaaaggccttgctggtgaaaggatgtggtaaagaagctggtcaaaacccaccaaaaccaagatggtggcgaaagtgacttctggtcttcctcactgctgattatatgctaattataatgtattggcatgctaaaagacactcccaccagcaccatgacagtttacaaatgccatggcaacatcaggaagttaacatgtatggtctaaacagggagaaccctcagttccaagaattgcccacccctttgccaaaaactcaggaataattcaccccttggcatatgattaagaagtaactgtaagtataatcagttgagcagcccatgctgctgctctgagtagagagtagccattcttttattcctttactttcttaataaacttgctttcactttatgtatttgccccgaattctttcttgcacaaggtccaagaaccctctcttggggtctggattaggacccctttccagtaacacaactgtaggcttttattgattgaaacataggtgataaacagaacttcaaatttcctttgattttctgtcatggcctggattaatcgccacattttccctaattatggccatcatcttttccagtgcaaaagaaaaactcttcaccacgtctttctgcagagtttccacccaatcttgttttccatcacaggaaagtaaaaggaaagcttgcaagtgtctgtagtcatcattcaactactcaacttgactagaccatcatcacctactcctttaactttgtgctcagtaaactgtctctctcagatgaaagtcattgctattagctaccaacacaattgtgccatttgattttttatttgtgacttactgttccagagctgatccacagttaacgaaaattaaagccacaaatttttcccctaattagacatttgtgccttccataatgacacttacatacaaatgacactcaaatgtataagatgtaggctatatgcacaatacacataacgaacaccacatgaaacaattttggaatttaaatttagattaaattggtatttaaagttaatcctcattgaatatgaaacattaaaaaggcaagcttaaaaataccaagcaatttggcattattcagtacagcatgtcaattcaccttattcaaaagcaaaccttttgcaaagcaaaaattctcccattaaacccaggcattaagaagaaataaactcttaattacttaaggaggaaatgctctcgtttcatggttagcaggttatcaatgtaaacaatccagggagctttctcaatggctcctgtttcaagagtcccagcctctattccccattccccatccgccaccctctttctacacaacaggagctaatgtctttatgcgtaccaaaaaagacactactgaccacaatgggagagcttaggtatttgcccacactttccctgcaggagtaaattcagtagaaccctataattctgaaacagtcaagtcatggaccatctgactcattaaatattccaggcagccttgtcagtagtctggaagaccttgcagttataatttcttccctctgtcattcctctattaatactcagctaacttgaatttcaacatgagctttagactagctgaagaacatttattgtgcaagattcataaggtacagaacctattcatagaaagcattttggcatccaaaatatgtgtaactaataatgaataataatagcattgtctccgaaggcaagagcacaaaaatacagctatgaagcaaaaataaactcctgacagtgccatatgtaccctaaaggaaataagtaaaaagctttttttctgaatattagttgtcactatttcatttgattatttcaaaatgtaacttttcattaacttaggtttatcatggatttgcagatacactggtatctaatagagaatattaaccttagactatcaagataaagcaaatccatgaatttcagcatttttttttaagacatatggtctcactatgttgaccaggttggttttgagattctgggctcaagtgatcctctacctcagcctccaaagtactgaggattacaggcttcagccactgcacccagcctagcataattctctatagcttttacacttgtccaactttaatggaagaaaggcttctttgtacacaaatctgacaacatatctttttttctttagttgtgtatgcctatgatggtcaaactttggactattaacatttttattctcagttgcaaacactaagaaccattctacatttcctctgtaatgcaacaattttgctgatgccttcagtaattatgacaatacattttttgcaatagatatggtaatttgaaaagaacacatttaaatatatggttttatgcaacagctatcaaatatgtaaaattcaatatcccaagagtttgtgcatgttgaggaaagaaatccaagaaatatttaattaaactaatgaatcatcattttctcactggtcttccatgtgctgtatttattaagagagagaatatgggctctaaagaccattggtctgacttagggtgccatttctcgcattttcatgatctgaaagtaaaactagagcatttcggcagtttcaagttggcacgagtgcgttgcttcctagcttgaaatgcataattaaccagaaagctagttgttgagcagttaaacaggctgtccaaaaaggcccccattgctgttcaaatgaatgctgaaaagtagggtgccacagtgatttttttgttttatagacaagctacatacaagcaattgacaaagactaattttcctttcttttcaaagcccatgaaagcttgtgggtaatagcaattatttctatttgtcaaatacttgtatccagaagtggatttataatcccacgaaaattctgtaatttactgaaccactgagcaggtccatgctactccccctccccagccccataggatgtaattcatttcaacagaggattggagacaatgatgtaaatgaagcagtcctcacaaggcagaaggggaaaagtgtcaggggaacatacttcttaattcccataagaaataccccaattactggacagagtgccaaatttcagaacataaatgaatcccattcttattaccgagtggagaagatgctagggcaagaatagtggcttagagttagaaggagacatacacctacaattgctaaagcaatttctgcaagaaaaatttaaataaatatgggaaacattatggatcaaatccaaggaaggtcttaaatatatagtgctcaagaaaagtgcatgaatgtttccatacctcaaatatggtattttaaaagagcttgcctttaaaatacaatggatgtgtcatgatctaacagttgtccgcttttccagcacatccgactaactagaattcttgggagatcccatgccacaattcattttccaatttctaacaaagacaatgcacttcacatttttacttttgcattccagcacttacttgcatggtggtttatggttggtttgtgtgtgtttcttttttagaaatgttagaatgggaaaaatgaggtaattcttcaactgactcagtctttaatgattttaatgagttccagtgtttatgcttgagctaacaggtgccttatttttttccttggctattctttcttcccttgtcctcctattccgggcaatccatgcaacactccagctgtaaattattctgatggtatgaataagctttgacctgaaatcaggttagtaactaactgaaatctaacttacatttccataaatttgctgttttgaaaatgattagcatgactttgaaaaatctgttagctgaatcttcaaagactactataatcttcacaaaatcattttatgtaatatgtcttccatcactgtattctatacatacaacatcctctttctatagcactgaactcccaaattgtttccactagtggaaaaatgcagttaatattggattcatttgttgtcagtcacctttataaaatatacacacattcaaatgcacatggacacaggctccgcgttttaaattccgcattttctcaaaaatttaaacatatatgccaaagattatgcaaaatatgatctccctatagaacattttctttttgttaggcagtgtaaaaataatagaatgtatcactgttcttggagctttgtggattcctagactttgtaattcttcatgaatgcagagttatttttccaagatgctagaagattccccaggccattttaatagttctattattaaatatataataaacatgattacttatttattgtataatggatgtataataaataaacgtcagaaaatttcaaaacttctaaatgggttattgagctatcaaagtctgcagcttttcactatcagacaagtgagggtaggaaaatgggccatcacacgatctaaggtgaaggctaagggcagacggtatattagtaagctagaagaggggaatatcttcccaggtggactgataagatcagtgtggcagagctgtgggaacccaaggccctctgttactcaaggctgtgtgtgcagtgctgagaggtcagccatggaggaagcaacatggtcctgcatttcgatctaagcctacaatctaaccattgtcagctcaccccatttgtttcacgtaaaagcaatgctcagagacatctgcagagggacctaacttctcaaacttgccactttggattgaaaccgtatatgatatgcattccccctatctacgtcacatgcatatacatagcacagtaacaaggcaatcctctgtgttgtgttctcaattccttctccacagttttttttacttcatgatgacaatgcaaagagtggactgaggactaggcttaccaggttctaggcccagatctgcccctttctaactgtgtgatcttagtatgtcactcagcagatttgtgtgtgggtgtgtgtgagagggagtctcactctgtcatccaggctggagtacagtggtgcgatcccagctcactgcaacctctgcctcctaggttcaacagattctcctgctcagcctcctgagtatctgggattacaggtgcccaccaccgggcatggctaatttttctatttttagtagagacagggtttcaccatgttggccaggctggtctggaactcctgacctccagtgatctgcccgcctcggcctcccacagtgctgggactacaggcataagccaccacacctgacccaccagattcctcatggactggttccttgtctgtaaaaatgagatgatttattagatgctatctatacttccttcacttcttcaaacgtcagtggtttcttttttattggtagttttctgtcttcctgccttttgcctgtgtccatttttccattttcattttatgaatttttaatcctccacctcagtgaacagcctttccttccacaccaacaggtcctctgtcctgaaagaatatcacagctctatattggagctcccacagctcttggtgcactgcattttgattgctgtgctgcataaactgtcaatttctttccaaaaagacatcctctatcttgtttacccttatgtccccaacttcctggcactttgtgaatattcagtgaatatattttaaatacttgaccttcctaaccttttcttggaaggacccttcaggtaaaggagatggtcaagaggagttgcatttgcttttctggccaactctctttacaaggagccagcctcctgttcagtctcttctgaggtgacttttctatcctgtggatcttcactggtgactgtaactactaaccagtttgcatttattcactcacaaatgcagggacacacatataaccgtgttaggcatcacagagcatatcccataagtgataaagtcacaaatatgttacccccataacaagttaataatcttccagcatgccagaatgtcagtttagccacagaaacagccctatatattcttctacaatctctagtttcttttctaccctttcttccctatcacacaactcctaatgtagtttggggcatcaaatatagttcaatacatttttatgccaaaagtttcttcggaattgaaccagatacgcctgatctaaacttataccttcaaaagtctttatgttgttctctgtgagatacacagttactcaaataatcctcccaggcttaacttatcaacagtttgataaattagcttagactgtggatatcctcactgcagcacacctctgcagattcacacaaacaaaggccaatttggaagcactaagtgaagagattctctcctgtttcattttctccattctcctcctaaaaccacaggaaattttggcactttggacattccttttacacaagggacacagtaaaacataattcaactgcttgaatctgggtgaagggagacagcaattaggacagctttggaaaaataagagagtaacaagtaggtggcccaactgtgggaattgaaactacaataacagcttctaatgaacaagtttctacacagagaagcatgccttcacacacacaacagtggtaaaacagcacgaaagacctgtatttcgaaggggcaccagttagatatttaaaactcacgagtatggtcaagatttagtcatacaaatttattatcccttgcacttgactaattctgttatgctgaaagatagagcatttgagcacatttcaacttaagtattgaatccaaagacactgaaatagaaaaaaaatatagccataagaaccatagaaaaatggaacaaaagaaagataagagaaaaaaacaaaattttctcggtaactgtaactacataggaatgaaaaaagttgtaactatacagcgttttaaacagtagtcaatgattatatgtaaatattgtttttgacattacaaatataccaattcaagacagacctgtaaagtgctgctttttctgtagtcatttacattttgagacaatgagacaagaatacaaggtccttttctcagaacaaatttccctgcaatagtcacatcggtacagcttctggtattcatgtaaaagaacctattagttgactaaaatacccctgtaagttcccaatcatattttgttactagggtatattctaatttttttcctacgggaaaaaacaaatctgtacattcaggcttcaggaatatagttggagtaaagagaaaaatcaggatttctgccctgcattatggccaaaagataatggattcttaggctctttgtcaaaaacttcctactttacaattgtccagagcaagcttctggacagaaataaatttgaacccccaaagattcttaaattcacaaataatcagaaacattcacacataacaccacatcagagcttccatttatcaagagcaggtatgcagtcattccttgagaatactctaattcttacagcccaaactgcatctactgtatagcttgctgaatagaaaaagtgttggaggtggtggcatataatgaggctggagagtggaaaggaataagagcaatagcatgctcaaggttttggagttgattacagtagaaatcatcttgctcaaaatatagtgggatttatgcattccagtgccacatcatccaccattatccatctaaaacacagaaaaggcagtgagaatgtagtcattcatgtgtggtccccttgatcctgctttgccttcaatttcattactgtctgccaaccaaccaattaatctgaaaacttatcagtggtgctactgcatatctggcatccctgccccaacaaaactggagttctgtgagcgagtttaaaataacctagtgaataggagcaaccacggactaagagtgagaagggaaaaaaagggggaggggagaaggaatacagggaaaaaagggggcaacttctggaagcaaatactaaagaaaacatgaaataaaaactttatgttttaactttttaataaatcatggggcaagggatagaacacatgactctttgaagttttagacaataaatcttggaaatgggttgttcgattattatagtacccctccgagggcaatgaaaggatgtaatgaaaaaaatcaggccatcagaacaataaattatcctgacttaccagaaataccagcaaaatctttcaatatgacctgttactggccaaattaggaggaaaataacatccagcgctagggatcacattgaaaataatttcatttgattttcattaaaagctttccagatagtgactggtaaaagaagcccatatattctatctatagtttaatgtatatgagtactacaggaaagaagaaaactttagagataatctatttgcaaatatttccggggaaaaacaaaattgtgagattttcctatgatgaaaatatagtaattataattatttttaaaatgtattcttttattttttaaaaattagaaaaaatgttttacatgtataacatgatattttgaagtatatgtacactatagttaaatccagctaattaacgtatgcattacttcacagttatcattttttgtggtgacatgctatttaaacatatcttcccactctgtgagctcacctataagttatcttcaaaatctgataatacattgcatgtcattttcttattaaaaaagcattttcacataccttatcttgtgatacttaccatagcactttgagaattatttttgccatttatcagaaaagaaaactaagttcaggagtatataactaaattagccatgcacataataccagcaaatgggattcaaaatgggattttttgaccccaagaatgtgccctttctatagtactgcaatacagctgcaggcttgataaatgattttgaaaaataattaagtttttttagattggatttgattttggggccagcctaaagttgtatggcactaagactttcatacgaaataaatgattaggtaagataatgccattaggaactttgaaaaacaggtattatctatggctctgaagataatttcaaagggcattttaagaagagttttgaacactaatagttactattcaaatctacgcacatttcaaaggtaactgatttaaagttaataatagctagcataacactttgcacacagcatacactcagcaaatattagcaaaaacccttaaagtacttccatatataagcactggtaaggttttctaacaaccagtctcatcagaaaattacacatgcccattaggaatgtaaattcaggcagattctcttaaaatagctttgtgaaagttattataagccttaccatgtctataaattttggtctatttattccaatttgagaatttagcctaaagaactaatctaaaatgtgagccatgatttttttgctttctcaaaaatgtttactatgatattatttatgtataaacgttgtctttaaaaaaacctgaaaaaacaaaaacaatgtcaaaacaaaaacaaacaataggggcctcattaaataaattgtattcatttaatgaaataatacttagatattaagactttaaagaattttattcatataatgaaaacttctaacgcaaaccttcacaaaaaagcaagagtaaaacaaagattatacctgtacacactaaaatgtaaaaagtagccatctctggtttgtgaaattacaattttctccttgtcttttaaaaatttcttatattgggtatcctgtttttatacagacatctaagttattttataatcaataactcaacagtcaaaattgaatttttagcatgtgtcaggcatagttctaacctttttgtacatactatataatttacttttcataaataccattgatatagaaaaatttactttgtttttatacgtggaaacaggcagagagatattaaataactagcccaatattactttccaaataaatatttgacctgggtcttgaaccaaatggtctgattccagaactcatgttcttcatggcgttgctatactcttcatgttacacaggctgcttagcgatatgtcagaatatattaatgtcaaggagaaagtgatctcatgcaactgcgaccatgtctataaaatgttataacctttttggtgagatggactgatggtgtattaagtgtacttagcttacctcacatataactagttttcatgaatgtgttacttctccttcccgagaatacaaaagctgttttacatagagggatattacatctattttgtaatcatatatttacaaccatttatggtatattaggcactggattaaaagctggaaataactagcaagttatagcattcattgccataaatttaacactaccttggagtgggcatacggttttaactgaaacagattcttgaccatgggaatggaggcactaccttaagagcaaagagattcagattgtttccttgctagaacatgcttctgaggcactactgactgtatagatcaaagacagcacaggtaatgttattgacttcagaaattcctgctatattcactggctaatattatgtccacaaaaccacagctgctaaaattgcaaaggcatgagtcagtcatgacaataatttagagtattatcatgataagctcaactaggaagacaccaacctcattttactatggatgaaaactattgatggatatttttggtattattgattccatctaaatatcctctgaaatgctagagtgtaatctaggtattttttctggttatcattgctgatttttttttattatactttaagttttagggtacatgtgcacaacgtgcaggtttgttacatatgtatacatgtgccatgttggtgtgctgcacccattaacttgtcatttagcatcaggtatatcacctaatgctacccctcctccctctcacctcacaccagttagaatggcgatcattaaaaagtcaggaaacaacaggtgctggagaggatgtggagaaataggaacatttttacactgttggtgggactgtaaactagttcaaccattgtggaagtcggtgtggcgattcctcagggatctagaactagaaataccatttggcccagccatcccattactgggtatatacccaaaggtttataaatcatgctgctataaagacacatgcacacatatgtttattgcggcactattcacaatagcaaagacttggaactaacccaaatgtccaacaatgatagactggattaaaaaaatgtggcacatatacaccatggaatactatgcagccataaaaaaatgatgagttcatgtcctttgtagggacatggatgaagctggaaaccattgctgatttttaaaatgatctatttaagaatctttataagcagagcccttttttcttaataaaggaggaattcagaagttaataacattggtctgctttacatcctatacttgttttccctccaaattatatgaaagtcttatttcaaatgcaagtgaaaacattcatgtcctgtagcttgagaccttactacatataatatcactgcacagcatgatacaaattaacgtctttaagagggagctcaaaggcatacagaagtataagacatgccaagaagtttcatttaaatttcctttgttcataaggcaaatttttatatttactaatccttggataaatataacataaatacatagaaaaagaagcattatgttttcttaaactataggttgacccattgcaagcacatgatgatgcgtctcactaggtgtgcatgtagtaaaacagattgatttgccaaccaacagttaagaaaattaatttgttgagcatcatattttatactaattaaaaaagaaaatttgtaagaattatgtaagagaataacctaacattaaatggcaccataatggcatgaacaatttagaaacagaaagtcaataccttggtttctctaatataaatgtgttgctcatgctcttcaagcattttatgaaatgaaacatgaatcaaagtcattacagagctaatgagtgaaattgtattatttgctgtctctcattttcagtgttgattttgttggaaaacagtatcttaagaccaaaactctgggaactgttgagattctggccacaaagacagctagaccgtggggaagcaaacatctgtacacatctgcagccatatatgaggtccctcatgagacttagcaacaaggtgtgttttaatgtgacagtgtgtctgatgtgtccccagcacattgggaccagtacacagtgttatttgtacatctgctgagtaacattgagtgtgtgggtaactaaagccctcagtaattattttacttaatgttttcaagcttaattctgatcttgtacttgcatgatttattattccttgtgctaaattcttcaatgttcttgccttgattgatctttcattatctatcacttaactaaaatattaaattctttaattaagtcatgtttaaatgaggacttgttttagtctcttggaggtttattcattgcttaggtactttttcaataactcttctcttgtttaaaatcaataaatatgattaatttgccatacatttatgataggtcaatatatttattatggaaacatatagctaacttgatttgaattaaattggtttatgcctacagatcaatattgttctactcctacaaaatcaccttgaaaaaaatactattggttaaataaagaagacaatgatgtatatttataagacaataggtatcaaccagagaaaactctttgcagttggcaatattgggaaagaaggccacagacagatttatgtcatctagatatcaaagagaatgaaatacatggctcagaaatttgttgtaaaagggaatggactcgtatttaaggacaggactctgaggactattcatggaatgcatgaagaagactgataaggatagcctataaggcacagtatagtagtatagtagaagtgcaccaactatttctccagacttgaacaaccaagtctaagagtaagataaggtaagacaaggtcaggaagtctcagggctggagaggtggtgatgttgctgaataattgctttttaaagctggaggggacttccaagagtctctcatttaagaagaaaaattaaagacataattggtaacggttttgactgctgcagaggcaacactttgctcacaatcctacagatctacttcacctgtaactacaattttcctgaagacatagaagaaaaatcaattgttctaatccatatggaaaaaaaaaaaaaagaaaactgccaatgtggtttgactagcaaaccactggagttgtggcttaagcataaaggattacttcttccattgccactaatctaattactttcccctatctgtctccattccagcaggcatgtttagtagccaagctgtattacaaaaaaggataggatgtgggtaggtaaagcaaacaaacggcaacatcaaatgcaaagtctttcatttcaaaggactaatgctctcttattccacttgtctccaaagaaaagcaatctcaaccaggtgtggcctgttatcccagcactttgggaggccgaggtgggtgggtcacctgaggtcagagttagagaccaggggtgggtcacacctgaggtccggagttcaagaccagggtggccaacatggtgaaaccccatctctactaaaagtatacacacacacacacacacacacacacacacacacacacacacacacacacacattagctgggcgtggtggcaggtgtctataatcccagctacttaggaggctgaggcaggagaattgcttgaacccgggaggcggagctgagatcacgccactgcacttaagcctgggtgacagattgagcgaggctctgttttaaaaaaaaaaaaaaaaaaaaagcaacctctccacttttctgagacagcaagcacagagatgttcaaattaggttgactatgccatacttcttaattatgtatctgcataattattaatagtgccctcttttactcacaaaagtgctctgatttggacaataagttatattgttatcctaaatacattgtgacaggaaggtcaacttatataagacactaaaacaaatttgacaaaattcattttagtagatcatccatttaacatatataattctacaagttcataacttatcaagactcactaagaaacaaagatttaagctatttttatatatttgttgtctttcaaaatgtttctttttggcaaataactttactttaaaaagtaaggcatagactaatttagaaaacaaaaaaatatcatttcctcacactttactctaaatcttattcagtgttatgtcattttttaaaaaaatttttgctttctcttaggacagcaaacatttttgagatggaagaaaacccatagattatttacttcaatgccttaatgttactatcaagaacactgaagttcagagaaatgaaatgactcacccaaagctgctggtctggtctaggtagcgaccaactaaccagaccagtagcctaatgagccaagttggttctggaactcctgactcctaaatacttgtttccttctgcattccattctgtctcctggattatattctctattttattaggttggtgcaaaagtaactgctggttttaatttaaaagtagtaacaaaaccagcaactacttttgcaccaacctaatagaagcctcctatcaggaagaacttcatcaaaacctagctttgccctaagcatcacattttcccactggaaaagggtagataaaaaagcaaaggaccaaaaataaaaatgataatttaccaacctctctctcaggaggcaaagtacagaggtctctgcaaaggagcattttaaaatgtcttaggttattgatatttgattgctttttgaagattatgcagagttctcctatctctcagtcttgtgattgtcttcagtatgaccaattgttatttttacttatttttttatgtaacttttcttttaggtttggggtacatatgcaggtttgttatataggtaaactgcatgtcatgggggtttggtgtacagattattttgtcacccaggtaatatgcatagtaccaaatagatattttttttctgatcctctccctaatatcaaagaagagcaacaactttgggaaggttggcccaggagacatcattgggaattgtaaaccaaacaagaaaaacataatcaagacatgtttcttaatattcaatttattacaacattttattggctctcaaagcaagtgttaggattagttttgctgaagaatttgacaattttgtttgtttcttttgttttgtttttgtttttctgagacaaggtctcgctctgtcacccaggctggagtgcagtggtgtgatcacagctcactgcaacctagacctctccggctcaagtgatcttcccacctcagcctccttagtagctgagaccacaggcttaagccacagggataaaatgaggatttaaacccaggctagtatggccccaaagcgtgggcctttagtctttatgttaccagcagaaatggcctttggatggcacagtgtccacaatgaacatctaccattcacttttattccatgttcatgtttaggaagcaatatgtttaaaatgaagatagctggagtcaggcacactgatagcttggatggatacacacacacacacacacacacacaaggtaaacgcacagagtcataaaacagtaagctggaaaactttagggtcaaagacccagatctacttcaaaatgtttcaagtgcttcatatataagaattgatcatagaattaataaccaaataatcaaaaccaggtcgatttaaaagaatatagtttacaatagctatagaagtcatgaaatattgagaaagatgttccttccctaaaataattcaaacctatagaggacacttaaattatccaaacaaataacaaccgcaagatagtttagctctagatattgtcagataaatatctggacttaatattctttacattattttatttgttttatgtttacttctacacttatatattcatatttactgtttattacattacattatattaatattattccattttactagaccatgtgtaggtcagataaattacttcctagaatatatcagcttatagcatcccagaaacaacccacaaagggttcttctttgcataatacaacagctcagaaagactcccatatctgatcttttgtcttttctcagtaatccgtctggcctacttcaacaacatgtcaggatattctgaggtactaggccacctgagcctaagacctcaaaagcactgagcctcagctcatcagattcctggctaagtactttcaatgtctgtagtagcctcatttgctcatgcttaataagctcataccatttagagaaaggactcaagtgtgagtaacacatgcttcccctagtaatgcacagcattaagaagcgaagtagaagacaaaactctctccctatttcacattcttctgagttcattattgccatgaaaaacgaatcagatttgagttgttcctaatctctgctcttctggtctccatcagagagggcagccaaactgtgacaggagccatctgggatggggacaggagaggagagagagccctgtagttttcttctggggaaaagcaggcacagggggtaggttgctcctagagtggacagcaacactgacagctcatcatcatttattctcagcctaaacaccagtggcaagagccccatcaggtggcactgagagaaggaggccaaagaaggcacagagaggctttaggggtgactaaacatacacactgttgtaggactgaacattcgtacatccatctcctctagtaaagcttgaggttttctatggcagaggctatgtcttaggtaccagtgttgtcacagcatcttgcaaggggcttggcatgggattgatgctcatagaatatttgctggaagcaggaatcaatgaatagggcccagcccttctggattccaccggctacttctggcttctcaaacacactcaggcacgtacacttgatttcaaggacaaagttgctgtctatttttaataaagaagcagcttgagtgaatcccatttctatttccttactctcatactgtcttctgtttgcgtgagcaagagtatggactaattccaggcttcagttcattttagtcacagcagaaatctaatcagggctgtatattctgtctctgtccctctgtctgtctcctttctctccccctccttctttctctgcctacctctccttcttactcaccctgcctccacctccttctctgcctccctccatctttgcccctgtctctttttctctctctgtcaggtgatatacaaatcccaggaacacagatatacacactgaactgaatagctcatttttcaaaactgtgtcaagattgtaatggttagtgtgcaagaaggaaacttatccttgtaacattaggatttttctttttctttaattgcgccctaagaattaaaccctatgcaaataggacttaattttgcgttcccactttttcctttaataattgtgtgtatatgtgtgtgtgtaagacaaatgttctttgttgaaagctaacagttgcaggcttcttttaaaggttataattatatttataaacacattgctatcaggtttacaccaaatagaccaataatttgccggcaaaaggtaaaaaatttaataaaaccaccttgttcgaaaacaaatttgttatagaaacacctgaacattggttttgtataaagtatatgcaagatgtaactggacattcatgtgattttaggtagaattttttgtttgttcttgtcctccagagaggattcagaaataagaatgacttggaattgggcatttaaaaaatatatctaaaaattctatgtgctgcggaggttggaattctaagttttttataagatgaactgccatgcaggtcacttattctaggaaagtctcctaataaataattcttactattaaccacctccagggtcacagaatatgttttaacctctttttagtgctgacacaaggtaatagcatcccctgatactaattctttgctgtcattaatttggattgtctggtaacacattaaaaaaaaaaaacagaccaagaaactgctatttcaagtacgaagaaaagctgcattcattattcagccatataaggaagttaaatgctacagcgccaaagcaggcaatgacagaaaactaggaataaagaagtttctttttaaaaactaggaacatagggaaataaatattgtgtgagagaaaaaagccaaaaccaacaataactaggtaggtcagctacacggagggactaaaacattaagcattcccttgcctctcaaactcagctattcatggccttctaggttaatggagagtggggcacggggtgcaatgtggttaatacacgttctagaatcccagaaaagataaatgactgctctagtttctcatcttctgagcagcttgagcatgtgttgaggttactgtcactgcaccacagcctgatacatattcctccttgtgtatgaaagccattcaaaggaagaaacagccctgaataagactctatgggaattacagtcaagcagtgctgctgaattctggatccaccctttattagctgtgtgacccagagaaagttaaatctctaagcttcaacttcttcatctgtaaaatgagtctaataagagtagctacttgatatagttgcaaagattaagtcatacggatactttaagaatagcatgaaacttgttgtttaataaatcttagtgccatcaccatcatcaccaccaccaccaccaacaccaaaaataatcaccactaccgccatcatctccaacactatcaccaccaacaccatcagcatcaccatcactaccacctccaacatatctagaaccaccaccattccaaccacaaccatcactaccaccattaccaatatatccaaaatcaccatcaccaacagcaccatgaccatcttcctcattttacaggtgagaaagttgactcagaacctcagtaactggctgaaaggcacaaagctggtaggggacagagagctcaaatttccaagtttagcgatcctcctaagcccatctttatctcaggaaatttgtcatggaaaaatggtgtggccttggtttcaagggtcaccacaaggcttcagaatacctaggaccccagatatctcatatgtaagcatagaaaagcaaaaataaaatcaaaaaactatatctggaaaatatcttagggtattttattaatatgtgaattgctaagtatactgcaacacctggttgccctgttatcatgagcaccagcctgaaaggtgagggactcaggttctgcttttcgttcttaccttcatatcttcaactgtcaccaaagaacacaatgcctattcccatatttagccctgtgaagacactataggaaagaaagaaactgtcatctacagcaccaagtcctcaggagaaaggcaggaaatgaaaaagaattgtttatttagcctggctctatagtgaaacagctgtataagtctgtgaaaagaaagggccctggcttggctcaacctttggcaaatacatgggtattatgtaggcagcatgtcgagccaggagaggaggcaatggaggagatttcctctaatgcttcccatattgttaattgctgctttccctcccagggccttctggacttcccaccagaaatccagggcaggaactgcaaggcactatgggaagacagcagcttgagtcctgcctgcccactcagcaccttccactgggaccctcagcgggctcacccaaggcagttacgaagattatctcatatgccacttacccacagtacattcagctatcttctcaccctttcctgccacctggcccagagccatttaactctactgttgcaaggctaaacttctgagtttcatggcatttatactgtaataagggactaatcgatgttctaccccaaacagtaaatctccaatggtcagatttcagccatggaggaaatatgatgaagatattttataggaaaacctcaatagttcccatgatattacaatgttgcctataggcaattttccacatctcagctttgttagctgacagagaagcaaaataacagcaaataaccccttgtatgtcttagaccctcaaggttgctctactcaaaagaattaagtatacttaaatctccttcccttggttaatggtgtcctaaggaaagaaagcaaagaaaacctcttcccatttcacaacttagtgtaaaatccattcagattttacaagatggtgacagagcaataactcttgagaaaatgatgtgacaatagctaattgtcaatggctaaggactcctcaaaagctgctcaatatccataggattaaagtaaagcagaaccattcctagagacccaaggactagttaacaaagagaaaaataaagtactaacaatattttactacaaatctgttaaattctctttaggaccttcaagaggcaaagtagtatggaagaacaagcacataaccttttatttcaaatagaaaagggttcaaatcctagatccataatttattagcactttgaaaaaaattaatctctctaagtttcagttttttcatctgcaaggtcacttacttcattgggctattataatatcacatgtatgaaaagcatttgagaacgggaaaacaatacgataataccattagtcttccaaattttgtttctacacattccacaaacaaaaagggttctacaaatagcaatcctttaaaggatgtattcaggttggtttaagtacccttataatgatttaaaatcccattatacaaaatgtacttttacttagcctttcattaattttgataatggtcctgtctattgaaactgcccatactcttagatttaccaaggtatgagtccatcttacaatgcacatcccattttccttttaaattatgcttttgtcctccaaaagcaaatgaaaatattttatctaaaatcaaggcttcctatagtttacaaaatgtctttaaaatgaaatttgtacttatcagaatatacaccatctcattatctcccattttagagtataaggagcatattttttctatttctgttataattcttagcccactgatggccacaaatctgtagcttattaagtatgtgcagattaactgatatataaattctcctctgcccctaacccagtaaagcaatcagccttctatgtaatggccttgaatgatgactaagaaaagagcccgtaatttaaacacttcaatgtggctgaactatgaaatctcaattgctaagacaaaattcctttacataatgatattataaccccaagctttaattagtgctggaaaaataagattataatagcaaatatggcaatctggttgacaccataaacaacctttctgcacacaatcaatttaagctcctggcagtactaaattcagactcataaatgttttttggctcttatcctatcttatttttataatagctatgcattcagaaaacatgcatttataaaaacatcttttagttataatttaggtttgcagatgatattatatgtgatttggctctaaaaagacataaatattctgttctgaaaagataatccactaaagcagaaatccattcaaatgctagttattccatacaaatttcttacattaatacattacctaggaaaattatatgtcagtataaaatatcatacctccatcgtatgctttaaaggtagcagataaaattctactgctataaagtaaagcttgaatatgttggagttattaaattgtgtgcagaaattagtatgtgctaacagcctttcttgtcttgtgatattttttctaatatttttcatcatttctgatttctccacacaattatccttctgttctgatcacttcaaattttcttaatatcttcatttcaccttgtttacatctggctgtcttattgtattttgttctactctcagaattgaattgccatctcacatagctaagtctatagagaattctatagaattctctagaacaagaaaagaacacaggtcccataaatagcaaaaacaaaatatttattttccctggaatataataataattccatagaacccatatactactgaaattttttttcctttctagtcttttttccaaaaagagtaaaatgtgatataaatattgagcatcagacagctatattggttaagatgtcttacacatactatttcctaaagttaatgaagttacaactacactgaaaaatataatagttgttaaaacaaaattaagtttgggtaggcccgttgtttaatatgttatactatgactaggaacctctggtaagctgatattctaaggagtatattaagtaaataatctaacttgcatactctgatttttcaactctgtactttaaatatataatactaaacgctcataatcttttaaattgtcttccaaaaataatactattgctgggctataactaattaaatttgatttgtatctacattagttaattagccttatcatttttccaaaacagttaagctaatgttagaccttgaaataccaaacaatattttgtaataattattaccattaaactagaaccattaaagaacaatcattaacagcacttcaaatgtgtagatattacctaccaaaccacaaatcaaattagcatattcttaatttattttttattagctgttaacattagacagaattccctgttgtaagtcaaaattagttggcattggtttagtatgtgtcattgattgagtttataaaaaagcatgtgctagctgttaattatatctatttaatgggattttgctttgtaattttaaaatgttttgctgagaatatattttattagaaattacaagcatcacttatcacttatcaaattgaaataaatcaactcatttatgtgagaatatgaataaatatttatagacatttttatattataaatttaaatgactatttctacactaaaaataagatcaaagattaggaatctatcttgtttttggaatccaacaatcattaaagctgtagtgcctcttattctccatccttgatcagattggaccttatttctacctttgttagggacttcttaaaattagcctttaaatttaggcttttccaggaatctctttatggtgctctggaaagaataataaagtctggctttgtgcacaacattaaacaaacatttttttttcaaagtacttaataaagcttggtggcgccatcagccatgtttaagtactgtaggttttgaaggaggacatctttcaagattaactatgtaatttgatgagatataaattcattcttaaagataagttgggtttaatctacatagtctgactccattgcacgatgacaaactctttcacttggatctgactgtatggaaataagacaactgccaaaggaaaaataatccataaaaaaataatgttttctaagctgctaagagggcagcacaactccatttgacccagcaatcccattactgggtatatacccaaagaaatataaatcattctgttataaagacacatgcatttgtatgttcattgcagcactattcccaatagcaaagacatggaatcaacatatctttgataatatgtttttctagaaaccttgtgtttgaatcttggtgcttaatttaaggttaagtcccagccaaacaaatctgtacaatcaacagacctatttagcatctacaaagcttgtcagtaatacaactctacgaagtcaagatgaaatctcttcaaaattaaaaatctagaaaaaagaaaaatgtagggctgtaatttcattccacttataagttaaatgctttgccatttctaaaatttcacatttcaattaagcaaatgaagtatagtaacaattttatagagcaagaaacttgcgattgatcttcaatactcctaagaacatatatatagagatggcatgaattattagccaattttcaccaactccaccaatgtttaccaattctcacaagaaatctaaatttctaaagatggaatgtggcaatattccttccaatttaattgcataggatgaatgttttaaatggaacttggcagaataagttattctatcaaatcaatgtcaatcctttttaaaaatccttttccttattcttctgcatcgtaccacccaaaagaaggttatttatggtttggtaaaagtcctgaactgcagaatagatagggaaagactgcttttcagataaaccagtatagagtccttattcttaagaaaaggtaagattaaattttcaaaagaaaatatgcttagtcaaacaaacaaaacaaaacacagatttaagttgttttaagggctacccttatgagttcatttaacgacatgaaatatacctttaacaacacgcagtacacttttagatggattacaagtgctatctactacagaagggttcaataattgaaatgattagaaaacataatcattagggaaaatataatcaatagggaaagaattcctagcaaaggaataaagttcatttgtgttaacctgggcacacatgaactttccaatgcaagaccactgaaaaaattctttcttggatatgaaggatattaatttgctactagatcactatctttcagtaaaataagtatcccaacaaaacacatctcaataagtgtaacactaacaacattagaattaacataaaatagatattaatcaaaacactttgctccctacaaacatcagaagatggatattataatccctgctttgcttgatttcattgtgatattgtactcgacactacttatcactatagtataacaacaaagagatgtaaagacactggaaggctctctcaggaaaatctgttctctctgcccatcccctccccctttttggtttgttttctctcactttcagtaggagaaatttcatatttaaagagcatgcattcaccatttggcatatcatatgccattatcgtaagagttaactattttcgaactgtatttatatatttatttttcttccctgaaatttctaaatgtccagtgcttcaaccaacataatcattcattttaacgtcgtttgttgtactgaagatattatagtcagcctccctccctctctccctccctcctttccccccagaaattgttcatagagtcaaattttctggtttgcttttggtgagttgagtgcaacacactttcctaggcaaagggggaacagccctctaaatatcaactctcagtcgaagaatcacttaacaactgggtacttcatattactacatgagcacagtgccactgtaaagtaccacgaggaagaataaatttttccttcttttctctgacctgctccctgacaactagacacgtggacagaaccttatttctctctccatcactgtatcagtggggtacagggtttgtttaataaggatgtaaaataaaaccggacttgaactacaaaagggctggatggcctttcccatgttggcataacactgaagaagcaggattggttatgaagtcataatttagcattggcatttaagcagaaacattaacttatattgtcacaaaacacaatgtcacataaaagccacaaaaatattttcagccagccctggtagccaagaaattattttcagggtgtttcctttttgggttttcccaatttgtactcagaaacgaagttagagacctattgtgatgttttaaatattccttttctgagtatataccatgtgattcaaaatagaagaccaatttctcagcctgtcttaagtcatctgataaactgtgtcccatcactcattttatcatagtcacaatgtagttaaaatgtgtaaatgtataaaagtaaaaataaaattctgatgtaaataaatttaagatctctgtgtgcagagcatattgataactggcacccaagcaaagactgatatcttgaaagggatcttgtataaaagctattccattccttgcatgctatttaatttaaaaaatgatgcacagactcacattcataaacacactgaaccacacacacacacacacacacacacacacatatataatatagaacttacacaatttcatcattctggaattcgagctctccacaagtgtcctcaaaatcctcccctccacctctggcagtcccttcgatggttttatatggaacgataacatttcctcgagctccagatgttctcaatactttcacctccatgatgccaatgctctcactcacatgagtcacaggttcctcaaaagtaaaaatgcctgcgtggtcatcatcaaaaatagttacagtggcagtggagggagatccgaggcaagcaagtgtagaaacatgattggcttccagtatgccatcttctgaagcttcagaagatactttgacattgctgagatgcacaaggaaattttcatcctcctcaaagatatcatcatctatgatacccactctgatttccttctgggtatcaccaggcttaaacaccacagttccttcagtaaattcataatcagacccagcatttgctgtgccatcctctgttctgaagtcaacaaacacagtgttagtcaaatcaccacctctgcggataatggtaagggccacagtaccacagttctccagacactgatatgtcccttgttcaaagaagatcttactaacagggtcattttcagtcacttcagtgttgacctcgtgcatgctgacagccttccttgcttggtcagctgcatgcctctttaaaatgttgccagctccagtcatgaggcgagtagcttgaatgcgataaaatgctctacttttttgctgctgacttaggacttggtagttagctaattctattaattgctctatttctttatctggatgcttctgcttaagttccttcagaatcctagccatttctcgcctagcttcttcatcatcttggtccctctcatccacctccagaaccagagcaccatctaagaaattttcaacatgagaattgaccactttcccgtccatttcaatttcagtcttagaagatggcctgtctccttcatgttcaataatcatccccctctgcttgccagctcgatacctcttgtagacatacttgtaaaacagaagtctcctatccgctacccaagcgaacacaacacagatgggaaagaagaagaaagtaagcaaaccttcccagacctccacaacaccaggagatatgacagacaaaataatgtaaagccaggtgtaggcaaagatgctccaggctgctgtcacaaagaagacacgcaaatgcttaatcttccttgtctctccgtcaggcaccacataaacacagagtgcaataatgatgaacatattgaatgcagcacttcccacgatggtgctaggaccgaggtctcctgcagtgaagttatggccacacacttcaattactgaaaggagaatctcaggagcagaagatcccagggccatcaaggtcaggttagaaactgtttcattccagatcctcacagttgtcttggtggtctctccattgggtttctttatggttatttctttttcttgagatgtgatgacttctatagaggacatgaaccgatcagctatgatagagactccaagaaacatgtagaccatggccacaaaatacacagtagctctagcaattttgtccccaaaagaagggtcttggggttcccaaatgggcaaaatcacccctttcttacagtaatatgatccagtacattcaccagtttcatttccttctccttccatttctgtctcagcaattacatggtccacatgggaaaataagagactcacagtaactaacagatgaaatcccattgaaaaggtgggtgaaagacttaatcgccgcatgttgtacatgacacttccaactgtcacaaccta

SEQ ID NO: 1982 - DNA, 318159 bp, Homo sapiens; identical to SEQ ID NO: 1981
  source 1..318159: mol_type = genomic DNA

SEQ ID NO: 1983 - DNA, 400290 bp, Homo sapiens
  source 1..400290: mol_type = genomic DNA
taccattttggtttttatttcttcaaaacatgaaaacaaaaaatgaagtagatgacaatgagaaaggagaaaacatttcatacagaatatgctgtatcactagtgattaaatcagaaacaattagaaactttatttgtctgtgtcagtaatatgtaccatttataaggaagagcacaattagtgcatttcccgccccccccccaagctgtgcacaatacacacaaaataaaataattttacacaactataataataacaatcctgaacaaccagaatcatagtttcctagaacatgaaaatttaaaaagcaaacaaaccaaaaagctttcaaattgaaatcgaccaatgcaagaatttcttaaagttctctgtgaaaatttgctacaggattattgacattcctaatacagctaaaaaatgagtgcaaaaatttttctaatgtttaaacaacttatattccttgaatatatttacttggtgcttctaggctagctttccatttagcaattctcaaaaaaaaaaaaaataaggatgggaaggatgggttagaatgacaaagaattgtaaagtgtgggccatagaaaagttccattgccaacaaagataaaagatgggatacactgggctttctcagtgatctggatcaccaacatgattgcccttcttggtttaaaatggagagatatatttatctgcaagtcggtcaaagataaagagggtggttttccaaacatatgccttatgctctcttagttaaagaaattcttgggtataaatacaatttggacaattgctttgatacagtttcagtgtgtttatgttaaaagagtttcataattgttttttcttgcaagataaaaatctttccatatggctttcttcacttttactcatgaaaatagtaatcacataaactgtaacccttctgagggcagggatctagactgttttgttcatggcttagtccccagaaagtatcatactacctggcacattaagtgggtaaccagcatttaattactcattcagtcaccaaatgtttattaaatgaggaaggatcatggttactgagtgacagaagaaaaaataagtctcaacagctttaatttattaagtatttttgaatcaatacagagggctaggaatgtctccagcctgggattccttatagacacagaagtctccgagaggtgaccaaagtcattctattatttttctcattagtggactcactactttggaatgttgggtttatccatgttctttggtattttaacatagaaacagctattctttttaaagggttaaaaatatcccagtccaatcctcctgggaggtactagtcttatttaattgccttctctttcagcataagtagaggagacaacacttttaaaggcccgttggtcaccctggcttctttcttactcagcaactactgatataatcaaagaggactagactggacagtgaaagaaacagggctcaaaatagccttttaagtaaaaaaataaaatgaacaaaccagcactatctaccatctgtgccagacagtgcagatgtgaaataaatactttgcagggaggggtgttgtggaaagggtggctctgaaagcctaggcacatccaacatatcaacgtctctataaggcctttctccttggccttcctgaattaatgggtgatttttagaggcctctgatgtgttccacatggctaattttccatgaagatctttgtagtttgcctgctatcctctcaatagctttaacttctccccacatgacagttattgcttcttagaaatgaatgtgcagaaccgtgaacaataatccattttctccttttatccctagtaattaatcaaactcaataacagcacaaaagtaacaactcaggtgaaaagaaaactcacttatgtcttcaatgtccaatcaacattgccaaatgggagaacagtatgtactatactctactatatacagatactctttgttttgttttatttgtttttcaccatgcactgtgtaacaggtatcacaacaacatttccgaacggcacatgaagaaggagcaaatgttcagtcatgactggaacaggattgtgcaagccatggatgcctttgaaaataaaactgacagacaatcccaagcaacggcaacatgggactgagacacatgttaatgcaaatggaaaacgatgatgtgctttttgaatggggttattcttactgtttgcataggggatggcaggtggacaggaggaacagggttgggatggggcacctgggggcttagctgggctgaatgctggaagaaggaccttgccaatcacagtccagagctaaagagataagaaagaaaggattttgcacgttcctgggaatctaggcacgttttccttgtacctgttaaacgagactgccaggtatcacatgtttaaatatcagactatttctagaaccatcggatttcctggctccattccacttttatgcttcttcttggaggcagcttcacctccactcacattccggagataagcatgaactttggtaatacgatgaagacatgcttctttcttcttccatgcccagattttttcttaatccaaaataagttttaaagtgattgggggaggtgagggggaatactaatgatttaaatttttaccaaaacccatttacatttggatggtttcactttccacaaagaaaagcaacaaccctgactctcccaaaaaaacaaaacaaaacaaaataacaaaaataaagccaaacattaactacctccccagctccactgaaaacaaaaccaaaaacaaaacaaatcaaagccttaaggatttatcaacctggagagagtgcagcccttctagactgagctgcaaagatggccctgcctccatgccttgttgaacatgatgatgcccctgggaatgggaggtgatggttttttacttcggccctagtacagagtatgctcttgaagctggattccatcagcaggtaagtgaacatgacaaatgtcagtttcctctgtccattatacataatttttatgtatatatatgtatatatataaatttactatatctgatagttcctttagaagccttttatgtggcagtaggcctccagggaggagaagaaaatgtacaagagccataggagcacaaagaggcaggatgtgaggagcttggcagtccggggcccacccagctcacctccgatttctggcctccgccgatacagcagcacccccacattgatgaaagcaaaaatggtgaagagagtgacagagaaagctagtgtgccaggggacactttgaactgttccccattggctgcgtggtagatggcagcgatggaccaggccacaccgattcccaggaagacattcaccgcgttgctgcccgtgacgttacctatggaggcgtctgcatactggtcctgggtggctgccactttgctggcaaatgtgtctgcagaggaagaagagaaagtcaatgacactcaatcttttagagatgtctttggagtgctgcaagcttcagctgtgtactctaggacccaacccttaatataaacccagtgaccaagaaatggctttgatgttcctctgagtcagactcatggggtgaaaagaacaggatctagatattgggagttaagggttcagtgctggctgtgtaatggactgagcaagtgatcttggtcaagttttgtatccacagatactgcagttctttgtaatattgaccttgcagggcagcattttttcagaaagtagtcacagctcacctacatcagaatcaagtggggtcctttcaaagagtgagtattgcaaggtgccatgcggctgtgctggtcataatgacagcggcccaggaatctattttaacagtatcctaaaagattctaggtcactaaagtttcggaacagctgctggagggtattactaaaagatgctgtatcagcagctctagtttatagatgagaaagttaagatgtcgggagagatttttcaagattcaagagcaagccaatagtggaattgaaaacaattgaactataatagagtagctgacatttgcttagagccttaagaataaaaaagcagattcagctatattactgcattgattgtgatggtacttttttattattattttttattattatactttaagttttagggtacatgtgcacattgtgcaggttagttacatatgtatacatgtgccatgctggtgtgctgcacccactaactcgtcatctagcattaggtatatctcccagtgctatccctcccccaacccccaccccacagcagtccccagagtgtgatgttccccttcctgtgtccatgtgatctcactgttcaattcccacctatgagtgagaatatgcggtgtttggttttttgttcttgcgatagtttactgagaatgatggttatgaggtgagggaacgaggcttagagatgacaagtagtggatgcaatatcacaactaggaaaaaaacatgttagggctacagctcctgcctcatgtcttcaaaacgaatgctttctcatggtgcttttctacctttcactgtgctgtgggcaccaatgatcattttcaaagccctttatttactcataatcctgactgtatctttttgtgatgataggaaaatcttggtccactacagaaggttgaacaacagtgacttaaacttcttgatgggtagaacacaggggtttagagcacatttgagctgggggacttcaaatcctgccttcgcagctgactgtgtgactctggaagattacttaacttctctgggcctcaatttcctaatctgttaaatggggatggtactgctcacttcagagtgctgttggtaaggtgaaatactacatgtaaataaaatgcttttgatgctttttggcacaaagtagtaggagaggctgtttttgttgttttggaaacacaatataaaccgagcaggctagatcggtttaaaagttgaggtaggatctgaaatagcttcctgtattaagcatgtgaacagaacttgcaagatactaaatttcttgtccacattatgcctacttacatcaaagtcctggctgggcacggtagctcatgcctataatcccagtactttgggaggccgagatgggcggatcacttgaggttaggagttcgagaccagtttggccaacatggtgaaaccctgtctatatactaaaaatacaaaaaaaaaaaaaaaaaaaaaaaaaagccaggcgtggtggtacacacctgtaatcccagctacttgggaggctgaagcatgagaattgcttgaacccgggaggtggaggttgcaatgacccgtgaccatgccactgcactccagcctgggcaacagagtgagactccatctcaaaaaaaaaaaaaaaatcaaataaagtcctttcagctaccttgcacagtaggattatagcagatattaataactgtcaaattgaacttatttccaaagccagtaacagcaagcattaaatgactgcaaggtgttgtgttatctgctctggtcctcctgaggtcctgggcatgctctgagcatgtatgtagttgtacgatacctgtactagtctctcccctctgttgttatgctattgccaccatccttcctccgtaaacttccagtggggaagatatgtacagcatgtaaatatagatcagcccatggattctcctgctttacaatggataagaaggctttttaggctactaaaaggctactgcatctgcagtatgacattcttcctgaaagggagttggtcaattctgaaggcctatcatcaattctgccctctgcctgtgatgaaaagcagatctgattattatttcataattaaagaagtagacaaacactgcttattccatgctaggcactatgctacacaggcaacgtgtgtattctcattcacccctctcacaagcattatgggctagatgtcattactcctctttcatgatatgagaaactgtgacgttgtgatattatgcctcttggatagggtcttagcaaatgtgaatttttaaaccaaagtctgatttcagagcccagtctcagtccacaccacattgccccttccaggaagcctgaagtttgtctttcctcttagttcatttcaggtggccctgttcctttcactcagaaactttgaagcaggttcttaccaaatgctctttactgtatcaggagaacaaagattgaagaaggtatgggcagtttgtgaatccagactcctggatttgtgctgctttgtgcattcatgatcacacattcacacagcccaatcaactatcacagagactggtgagtaaaagcaaagcgagacaaatcttaatggtttcttgtacttcattattaaaagttaatagaaacagggcagcagcctcaaaaagaaaaaaaaggaagtttttttttttttttttttttttttttttaaggtcaggcagtggaacatggaaagtaaaggaacaaaagtctgaggcaggagaaagcagcttccagctcaggtacagctgagaaacacctgagatgttattctaagctgaaatggctggtagcactggctggtggtgaacagatggccacgttaggtggggcagttgcgggggtggtaattccctctgtatgctacagggacaggtgacctggtgctgttccatagaacacacctgcttacctcccctggcacctgatacattgcacactggacttcctgggtatcccatgtgtactcagaaactctgggctttctagatggcacctttgctgccgcaccagaaggaaaggaagtttaaaatcaaagactcctgggtctggggactcaaagcacccaaaccagtcctttaggctgacatggagggcacacctgggtatgcagtgatttcctctccctcaagccatgtatcagtagcctattaatgtgaatgttgcataaggattcttacttgtaataataataggttcctattttcaaatgtctttctttgaatttcctaagagttaatagccaaagtgactagcttgtcacataagtaaaacatgtttttggctactttgtgtctcataggttttatttacttgggttagacatcaggccttttgtctgtttttattttcaattcaaaagcaatgtaaaaaaaaaaaaaattgcaggaacacacgcaaatccaaaccactaaccttagctccaacagagagaactctgttttccaaatgaagtgcgatggattctccccaaattaccttttattgccgctttgctgctcagcacatagggcaatacatcacataccatatgttaggtgctgccaagccctactttgaacactaagcctgtaacctgcctatggttaaaccaggcaaatgccatatcctaaaataaaatccaagaaataactactgccttgggtttgaaggggatataataatattcagaggttggcccattagataaaaacttttatatatggatcagatttccaatgcgattgacacaaaatatgttgataataacacatgtattttttccttcatctatgtccctggctaggtttttaatagtttttgctattaactcccaccttgaattctaattaattttagatcagtcatacagttttagacttttagtcctggctccttgatacatatgactataaatcaataagaaggaagactgttgaggagacagcatggctggaattaaactacacatcacaaagtcaggacgtaattgttctttgcagacctgcctcaagttcatggtatattaccttgcccaagtcatctggtcaacatgcaaaaataggccaatactctccctttccttcagcaattattctttacctaaatttctcaaactttattgctacttataggctaagccttaaacatctcttctgcaaaaaaaggtcattctcacagtcttgcaggatggatgcagggataatgtattatctggagcaagggtttcgccccagatggttcatcttattcttggctcttagtgttctttggggaccagctgttcagctctccaatgcttcatgcccaggaactgacactggcagtggttttaattggagtccatcctggctatgaaggtctgcttgcttctcccagcaaccagaccttgacgtattcgttcactgacaatgaaagaggcagccaaggtgtacagatcttcatggtgtagtagtggaagaagcctcatcaaagagactctcggctcttccaactgtctgtatgctctcggcaagtcacttcacttttttagattgcagtttcctcatttaattagagtatctctaagactctttctaactttactgtttgggtggtgcacagaatacattaaaatactaaatttatatgcaatgtttgattttgctggtttttttgataggagtttgtacataaccactcttcacaataattaactgatgattataactattttatcattgtgaagaagaaatgacttaaatatttgaaaatcctaggaaaatctcaagacctgaagatactacctttgatcaaactgtgacaatatttatggaattaaactacatggcacagtcatttaccttttaaaattaggtaagaaatgttggcaaaattatcaacttcaaatcactctgactggccattcattgatacgagtgaagccaaggtggcagacagatgaccatgtttcaaaggctgtgtctagtgttaatagtgttagaagtacctggagagctttgcttaaaaaatgtaggtttggggcttcacccccaagcttgtccagcctgccttattttgttgttgttgttctgttttattttgttttaggcttttgacagcctgaagccatggtttttagtttctgtctctagtgataagcagacaggagggatgtcgaaggggctttactggcccagacagaaacagaaactaagaagccatgactgtattctctctcttgggcatccctgctagatccacttaatcagactctctgaggacgggatacagaaatacaccttttaacaagcggcctaggttgttcttatttataccaaggcttgagaaccacagttgtaagacatgggaaggggagatactactcgaagtgcccacagttttgggggccttcctgcgagtaatagatgtttgagtttcagggaagcagctaatcggaaagaagtaagaagctggtttctcttagaaacatggatgcccttagctatagtggttattttgctgataaaatgtgggtaggcgtcacggagatgctgggggctgcttaattgtagcttcttccactcacaatatggttattctcctatttttttaaaccctattccagctaccctaaaaggccaaatgagggggaattacctaaattgattgaattgtgctgctctgtttgccaggttggaagcttacctacttcatagggttttgaaggaaatgagttaacatgaatagaatagggcctggcacttaatgggtgttcagtattattagctatttttataatacaacagagccagatccccagagaatccatacatggtagggaattctgactattgccaatgattctatacttttaaggagttataacaccctttaaaaattattaatttgacaatcctttgcatttaaaagtgtgatagagcttaaaattcttaattattttactttgaaaatttcatacaaccaaagtcattaaaagacattagagctcttttggtttagagcccaaatcttactaatggctgtaaggtagatatctttacttaaacagtgtatatattcctctcttttttcttttttgccttctataccctcatctgtcttgctcttttagaattaaaagagaaatagtgtttacttatgtacttgttcttctgctgtcactgaagaccttaaacaagcatttgtctttggttgcgatatttatttacccaagtaaatagaaaacctctctttctctctcacaagtgcatgcgcgcgcgcacacacacacacacacacgtgtgcgcgcgcacacacacacacacacttcactggttcatgtgaaaagaatcatcatttggcttccaagtgaagttcaagaggtaacagaattgctgatgtttgactgattaataaccaggtagatgaggagttgaaaaaaggaaacacactgaaaatttctgcccataaaagttgtccctgaagagggtaaagaagaaatggagacagtgacatgacctacttttagaagagaaggaagcagcgataagtaaaaagttcaagaggacctatattggcaggatcagggcacctgcttctagtcacttttgtccccagctacaaatgagagtcagcaggacaacttttgaaaacatgaacttgctagccccaccttgagtttctgcttaatcggcctgagatgtggctggagcattggtatttatcaaagcttccccaagcagattgagctccactaactgaccactcacagccctggtttctttgtccctgtaaggaggacaatgatgcctcccttagattaactgaggtaatgatgtatggaatgagtgacacatagatttgtttttagagtaaccatttttgttattgaaaaattagctatttttcatttttgcatgttaacttgaatgtttgcactttatggaggtgccccgggcttagttttcctactttgtatctgatatcctgctgtattttaagttcaaagaaagaaatttattctaattaaaggagagaaaaaaatggaggtttatttttcagggaacacaaaacagtgaagtgaaaggatacaaaccagcagcgcagcactatttgatctgctttccaaactgtaattggagtcatgttctcaaaaggaaatgataagactccactacacacacctagaataggattatttttcagtgtgatgttcacaggtgtccaagagagaatccaaggggtgctgacaaggtctagataactgatacatttgacaacggacagagtgtccaaggaaaatatcaagaagcttcatcatgttcaactccgactgtgactacacaatggtaaagcagctgatcgtttgaaagaaaataaatacaattattccatatagaaacatcaggctgactcctttagcaaacatggataagaaacagattaagaaggagctattttcatgaaagactccttattctttaataccattaatggagataattctctgataaggaaaattacactctgccactcacatacacacactcacttcactggttcatgtaaaaagaatcctcatttggcttccaaatgatgaacaatttttttttgattccttaaattcttggcttctcctggcattacatttgggctgtctttatagtactttaaaatgggctggaatgaacttgcttttaaaatagcatcaagtttttgatattttcagttttaagccatgattctgttactttcataataactcttattttaataatgcaaagtccgtgagggcaaaaagaatcataagatttagttaagcaacatttggctaattttgaaaaggaaaaaagcaagggcaaatttgaagctaaaaacaaatagctgaattaattgtcattttcccaagccagatggtttgttattatatagatataactgaaactaacttcctgcttaaacacaatctagggctgccctgcacagatcggtgtcctctgactcgcttctcctcccttcccaataatctccctctttcagttaatcctctttgcatttgaagcctagttctttcttctatgctttgttctatttctggaacatccatctcctatccaaatctcctcaaattctcttctctcctattttagagatagtaaagacataggttcgcctgtcttgctagagctagctgagaaggatcagatagagaaactgtactctaacttgaagagaaataaaaagaaaacagaaaccttcattctcacctgcaggtagccttaatgggttataaggaaacttcgttgtcagctggattatactggtgtgattctaagtgtatggatctagacaatacaccgaagatgcccaaaatgtgcctttccccaatggatatctacctagttagttactcactccagagacacttttttgaaggggctgctttgtgtattatcagttcacaaaaatatgaacactattaaaagtaggccactgcatgcaacctcaatccagcacaggaggcagcaggtgacacttgaggacacgtgagacttgaatgggttctgaaagtttccaataattcacctattttgccttccaccttgctgtgatttggtgtaaaatttcctccattaactcattcctacagattagtcataggatacaaaaaagcatatgtgcctatcaaaagcctgaaaagtctactaactatttggcccagcaattctctacttctgaggctctagaggcaattttacaaacacacaaatttatatcagggattggagcagagtttctatgttagagaaaaattagaaacaattgtctatcattttagaaaaaataaattgcaacttcatataacatgatactgtgcaactgttaaagtacactaagaaaaacattcatgacacactgctttgtgagaaagcaggttatgtaactatgcctactattagtccataaaaaagtatgggtaaatatttgctatatatctgtatacacattttttgtgcaatttacttaaatgtcccaggatttcacaattttaaaggtgcaaatggctgaatgtagatggtggtgagatggcaggatttctttttgttgcttgcttattaacattttctatttacaaagagcatgtattgtttattgcttgtgctactaaaaactaataaatataggttaaaaatagacatttaaatagagtctctctgggaaggagtgaacggctgaatttcagctttttcctggtccttttggttaattcagcattcataattatgttagacaaatccttggatgaaaagcatcctatatactacacacagagcaggtgcatctcgaagggtgtagcggggaggaggaaggagtggaatagaagaagaggagatagccttgacatcaggatctggcctgggatccagtgtcccgagggtgcctaggacagtccacaatatggaacaagaatcgtaaaaagcaacttcacccactatgaaagtttgcccaggaccagctgtgaagggaagatgtgtttgtgtcttcattttcccccacctactcgtgttaagcattgaagaactgcagagcagcaccaaaatcttctctcttaattttatattttgtgctacaaataccttctattttatttactaacagtatgttttagtgacttcaacccacaaaattgctttgcatattcacttaacctgacaaatactttttacaggcttgttaagagattcatgtccttgagatgtttgggaagggattgtaatgcccatctttcttgggctcttactagatacgtaacttataatgaaaaaaagaaaagaaaagaaaaaaaggcatagagctctacctaagctgctaagaatatgccatgagcctgatctctcaaaatgttctcctttttctctctcccagggacgtaggacagtttcttgtggatacttaacaaacagcttttgttaaatatctcttatttttatagattcttgtaattttcagagcacgtccatgaatgttatactatctgctgtgcctgacaattctgaggaggaagatgggtgggagcagttacccttagtttcattttgtcagggtgaggaaacggaagctccttaggggtcagatgaatgtgagggcacgaggtgggattagaatccacatcctgtaatttctggtgttcaggtcctcatgctgccagtacatttccaggatccttcatcagtttgccagataacaactccatgctctgaacatgataacacatctacgctgactaactctcagggctgctgtgggtatcaaagagatgaattataaaaacatacttttaaaatgatgaagctatataaatgtagttactatgaaagcattttttatgtgtgtgtgttaaatgcaaggggtctatcttcctgaaaccatcattaaccactgggatcttactgtgatcatttgttggatattccaaagtcctaactaatccagaatatttagaatggagggtctgtgggagaagaatccagggcagtgggataccatctgctgagaacagaggtggtaggggagctcatatgagagtatcaagtgctggagtgagaaggaaaaataattcaaagccattatttgaagtggaaagaaaataacttttcagtttctgggactagacctgcctgagtaaatctaggggtggggtgggggaggacacagattagaggtttgaagtgtgatttgttagagattagtagtgtacaaagtcaaagtttcctattaaaataccccctcccccacataaacactctccattctatggctccatgatctcgtttaattttcttctcagcagtgttcatcctctgtgctacctgaaagtttatcatctgtttataagtaccagtcttactccacgggagtagacatatcatctgtcttgtttatcccccacctccgccatgcccaacactggccagtacatagtgggggctccttaagtatctgagaatgaacgaaaagaaatgcagaatggcttgaaagcctatgctttgccactgggtcatattgcttcctttgttttaattttttaaatggtatttatctcttttttaatgactttatgaatggtgtggaggaaaaaccacttgaaaatttgaggatcaagaatgccacattgcttcagagactcagtttgggcttcctagttagctattggcattgtcaaaatacagtgtttcattgtgaatatttcttgtcattagtattccactgtagactcagttcagttatagaagctatagatgagagagcttaatctttactctcaggataagaatacttgacatagcagaaagttattgtcaggttcttctatgtggtttaccccatttctccccaaagcacagactaaacggcaggaagcacgtccaaccacttccagcgcagcctcaaaccaagtgctggttccccttgagcaaccagaactgcagtcttctaatgtgataactgggttagttttggggttctgatttgccatatttcacccatctgaaggctcatcatacacagaatccttcacagaaggacattttcatgatcacttggcatagttgtggttacctgcttttttgcgactataactcaggaatcacaggctatgattaatcctctggtgggcctatctgtggaccccagtgggggtcattttagtctggagctacagcaagcctttcttgttatcttgacccaggattttttacaatgatgacctaataatagcttataatttatggaggactatgccaaaaagtcccctgggctccagagaggcaggatggggtggggagcaatcgagggagagaaaacaaatacaacacataatttcttgaatgtaactaatacaaccaaaataagctgttttctccttgagtacaaaatacaggatttatagatgctgagctgaacaaaggttataaaatacgggcactaacggagttagtgtttttagatcatgtgctagaaaagatgggtgaacaatgcaaagcatctgatggattgaaatccttttctggaatgaatcagagtataaacaagtaatacacagcttatgtttcattcctgagaaaaggcaggatgtgaggtctgtgtgccgaggagcagtgatgggattccagctggcgctgtgcataaatgccaagcaccatgatttcatatctataatatgcactaccccaaacagatattaaaattttttatggccacatgtaagctttgccttttaaattgagttagcattttatttgttctcttttctaaaaataccagtgggcttaaattcatttgtttctcatgcagggaccagacatggcaatgaagttttgctttcttatagcccctattttcttctcttgcatttagcaacaatgtgtcattctttgtgcagggagatcatgcacagagcctcttaccaataggccttggtctctgtactctcttcctaatggttgtaatggatttgaattgatttaggagccagcagtcagcacctacagtatgacgtgctggggccatgaatgagagtaagaagctccatttgtgagagttgcctccttagcactgtgttgtgatcaactgactgaactggtcaccgacatttggcatttgtctatcattaaacatcaggtactgccctaagagtcacagtgctaattctaagcgccattgtgtgatccccacccccagcaatttgcagtgtatgaaccaagattactgttgggggcagggtagtggaattgttttaaaaaggtggacaaatccatatatacacaaaacaatgaagaacaaaaaatatctcatgtaatttacaaatatatagagagagattctgtgatgaataaaacaaaataatttcaaaatcttacagaatccatggtaaattctgacactatcatgtagagaatccatgacatttttatattagaattagtccttgtgaaaaatagagaaaagtcaaacctattgagtcagaaagtacatcagtggttgcctggggcagagggtggagatgaggattatctgtaaatggccgtgaggcatcttactggggtgatgaaatgttctaaaactggattagggtaatggtagcaagactcagtgaatttactaaaaatcatgaaattgtatgtactacaaatggatgcattttatggtatgtaagtgataccaccataaagctgttaaaagatgcagactgagacagcattaaaataaaaacaacccaccagaaaacagtggtccttgagatgtttcatttttttttttttttgagacagtgtcacactctgtcactgaggctgagtgtgatggcatgatcatggctcactgcagccttggcctcctgggctcaagtgatcctcccatctcagcctcctgagtagctgggacaacaggtgcataccaccatgcccagctaatttaaaactttttttttttgtagacacagggtctctctatgttgcccaggctcatctcgaactcctggactaaagcgatcctcctgccttggcctcccaaagtgtggggattacagacgtgagccagcacacctggccaccttcatttcaaatgtgaaaagggagaaataaaagtcatcaactcaacattatttacaaatcattccttagagactgacactcttgtgaatgcttctgctacactcgatgctcattccctttgcaatacaccctgagcctcaaaagaaagggaaatttacactcattcacataacacatgcataacaccaaccctccaaacacaaaacacatgaacgcacacctgtacagcatgatgtttctaccaagtgcccttgctctggccaacctagagtatgtaagaaggcctagatagaatagaataaaatatttttagctctcttctcttacactgtgacttttatgggactgagtaaagttggctggtatggggttggggcactaatccaaaggctctgcaggacttcagattgggcaggacacatgctgagcatccctgctccctggaccacctcctggtaaatgacatcattgttatcatcctgattcccctccagctttgtactcaatgccaggtgcccatgcagtactgccctttgagagaaataaggagtatgactaccaacaaaaaacccttaaaagtatttaataaaaaaactcttcctttgaggagaaagaataaaagatgcaaagagctttgaaatggatctttcccaggtttttacagaatctttgggtcggctgcatgcggcctattccccactgtttcttagtatacgataacaggcagttatggtgccatttatagagaaaatcttgtaaattctggttgctagccttcttttgtttcattctctcctcaaaaatgtttgcctttgcaggcttcctttaactctaatgacatcatctattcatgggaaagtgtgctggaaagtacaaagcatttaaactccagactgctgcttgctaaagtgaggttaagataaggtcctgtggaaagccatttgagtgattagggctgtcccgtgctgcccgtctggcagtgtccctggttagctttgcctcttggcctgactgcagatctgagggtccattcagcagtactgaacttttttggtagtaaagaaacgtgttgcttattagagtatgtgaaaacaaaatatacttgccctttagtagcctcttggggaaactgacaccatagccactgggaaatactggcttagggtaaagtcactctgttttcttttccatttaagctgatgtgaaatgtagccatccaattaaatatgtatgcacactgtcacaatggcacctcttgacactggctatctgacttgaaatgtcaatgttgagaggagaaagctcatggtcagtgaaactgcaggaaacagaagcacatttggatatgtccacctcactagaattcctaccatagggaaaaatgaagataggctgaaaatttacttagtttttcagttttcaattgctgcaatgtagctaaggtaaataacccaggaggcctaacttgtttatcagtgcattgaaatagaaagtaagggagatccaacatttttaagggtctactatatgcgaggctctgtgttgggtactttataaattctctctcatgtaatcctcactacaactctgtgagatggattttcatgttcctattattctggcttagaggagttaagcaatttgcctctggggatgtcatacatctagtaagtagcggagggagggttgggtttgaacacaggtctacctgcctctctaaagctcatgttcttttataacccctcagcacgtagtcattgtgctaagactttgcataacttctctgagacagaggctgttaactgtcaatctatctgtgagctttgcactgagaacaacacatctatttgaagtaggatgggatgagaagaaatgatggaattaatctgattccctgctgtccttcaagggagctcagaattcagaatgactgggtacagtttcccaaggggaacatgtttgtgatgagtgggcatttttgtgttcgctcctgaccacctctctgctgttaagagtagactgagtgtgtttactggttggtgagaccttggaatattaacctctatggttcccactcctacttctgctcagagatctagaacactggaatgtaatttccaaagctgccagtaagcctgggcagaacatgactgctaggagggtgtcctcaacatgcccttcctgggccccactgaccggcacctgggtagctgtgtatcacagctgtgtttggtctagctcgggaagaccaaatctctctttgtgttcagattcattagtggcacatggctgtgctgatgaggattatcttggtattctattttttttttttttttttttttttttgccagctgggtcagaactgaacatctttcagttgtcttagtgattaaatttttacatacaggaaatgctaatagtttacaggtatagaactggatcttgattcatttctgaatttttttgaaagcatggactccattaggtgtttttcatgccaaacagaataatagttcctgaccttgaagagtttaaatgtaatcttactgttgcatgccttaaaagtaaaaaataataaaattgaggtaaagagagaaatttaaaaatttcttaaaacgtttgtgaggcatatggaaaagagcatatgcaatactttaaaaataagtccaagatggcacgatagagtagctaagtaccagattataaaaacgagagataacatggattccacagtttaccatccctacaaactttggctaaatatggacaagtcatttattctctatgagttttagtttcttcatgtaacatgaggatacttgtattcactctcctataagctattaagtgattttagacagggccactggagttacatccaggcatattgtaccctatacagctccaggagggtcactcagattatggggcctcttggagtatgtagcatacaacctgcacaaccatacaagttacttgatggtccaccgagaagtaaagcgacaggacccagtaaattgtaaagtacttgctgtttaagtattctacagaatatcttagttttgagagttattagaagccagaaaattaaaaactgaaaaacataagctatcaatagctaactgtttttctcagttactaaaaataatataatgttttgtagcacagtgctgaacaaacagaaaaaaatatcattttcaggggaaggatctaagcgtcaaaaaaaataaaggttgaaaggaggcaaaatcagttcacatcacttaatgacataacctaagtaagataatagataaagtatatacagtgcttatgcctagatatagtggagctttgtggtaaattttaaaaatgttccttctctgctcaaaacttttcccatttattctcattttctggtgttttctattccttttgacatttttttagagttgatctcagtgtaaataatgataatagtttcctgtattttataccaattttcagttgatacattctctgagatccatgctgttacttaatcttcttgaaaagtttgtttgaattgccatgtatcattaggctgattttacaggcccagagagtcaagaaattggttaaagccatgcagtaagtaagggttagaagtccaggttcctgaattcagctctaaagctcttgtccctctaccctcttggtgcacagtcgttaacaccacgctaagagaacatggtgaacaaccagggtaaccagttttatatatcaagttctttctatggaattcagaagtcgaaaagtgttgcaatttaaaaatgacataaattttccccaacataaggttttattttattaaaaaggttctatatacaaaattggggggggggggggtggaaaccaaaaccatctatttccttctccttcagccttaaaatccttagagggaaataattcatgtttgacagaatccaagggataaaagaatattcgaaacataggaaggacacagaaaatcatacaatgccagaaactaaaggacagcctatcatacccaatttttaagcttttctggcccagtagcaaccagctggtagcaggaactagtgggagaagtcagcaagcatcaggcacaacccccaccaagacgcgcagagaaagatgaaggcaagacttaatggggcaaaaatcccccccccccaccgactcatcagtatctcagagttctccctgcagttaaaggaggatgcttacttctatttatttgaatccaataggaacaagacatgaaaggaaagtccatattttgaatctgggatataagctggaatgtcctggcccaatatacccaaggcttatccaagtaaataactgtaagctaaaagaatgtccaatgactaggtggcccttagtccaaaaaaaggctgggctccaaatgctccttcttaattttttccctttattttgaacctgtttttccatagaaataatgtgatacataacatagtgatacacttgtgttaggctactgcaaaattcagcactccagagtatacctaaagtttttgtttgtttgtttgtttgtgttttttttttttgagatggaatcttgctctgttgcccaggctggagtgcagtggtgcaatctcggctcactgcaacctccgcctcccgggttcaagccattctcctgtctcagcctcccgaacagctgggattacaggtgcccaccaccacgcccagctaatttttgtatttttagtagagacagggtttcagcatgttggccaggttggtcttgaactcctgacctcaagtgatctgcctgcctcagcctcccaaagtgctgggattacaggtgtgagctaccgcacctggtctacctaaagttttaaaagtactggcctgaggtctgggtcttgcgagaagggatcatagaagagaaaagaatgaagaaaataccaaaaaaataccttgctcctcatcacagttcccaccatagccaaaattatgaaagaggaaaaatgtttgttctgaggtcctcagtgcttttaacttttgtcccttcttactacaataaccgtctcagatatgtcctattcaagaataagcaacactaaaaatcatctacttacctccctcaataatttcaattcttaactgtcgctagaagttattaggaagaaagcaatctgattgaaccaacttgtactaatgtgtaaatgactgatttgtacatgtatttacatatacaacccaaagacaaacacacagatacacaattgcattacttctgtgttagctaggcaccattctaggcactagattagtggacagagttagaaaataataacattcaaaaataagtaaactaaaaaaatccagaatgtaataaatatagaaaatagagtgaaataatacataagaactggttgactacttcacagttggtgattatgaaaggactctttaaagatatcatttaagatgagatgtaattgaagacaaacagccagtcttgtgtaaatgaaggggatatgagacagctagtgcaatccaaagaaaggaatgagcttggtgtgtggatagaaaaaaaggcccatgggcccaaagaacagcaggcaaggaagagaacagactggaaagataggcaggggccaaatcacattggtcttggtaagacagagtgatgcttttcagagtttatcctaagttaaataagaagttactggaagactataagctgtagtctggcctgatttaccgcttaagatgatctctagcagaagcagggagacagataggaggctactgcagagatatgggtgagagaggacagctgtgtagactaggatggtggtggtggagagatagctagatgggctcaaacaagacacactttataggaaaggtcagccaggtgcagtggctcactcctataattccagcactttgggggcggcaggggaggggtggcagggggatcacctaaggtcaagagcttgagaccagcctgaccaatacggtgaaatcctctctctactaaaaatacaaaaattagctaggcatggtggtatgtgcctgtagtcccagctactcgggaggctgaggcaggagacttgcttgaacccgagaggcggaggttgcagtgagccaagatcgtgccactgcactccagcctgggcgacagagcgagtctccatcttaaaaaaacataaatacaattaaaaaataaagatctgtaggacctttgaccatggggaggagaaaaaggaatcaaggatacctggacggaatatgacttgttctcctgagaaaggcaagatgtggaaagagtaggtttggttaaaggataaggccattgggcagtagaaatcaacagttctgttttagatacagtaattctgagctgcaaattacatgtctggcatcaatatagggaagacagctagtacataaatctttcacttagaggaaaattgaggctggggatatacatttagcagtcattggcatatagatgtcatttacaccatggagactgatgtccaggaagtaagcatggaccaagatgagaagaaggatggagaccagtcttgggcttactccaacatttaaaggtgggaagaggctacttgggaagcctctttctccagagaagtaagtctgaaaaatggtgatttgggaagaggaggccctttctctattcacaggcacgggtcttcaagctcttgccaaaacacctaacattgagggtaagtgaagacctttatgaatccttctctgccagtagagtatgagcatttgctaccagctggtgcaaggaagaagctttgtctcacttgaaaatgtataagcttttccccatacattttgaatagtatggtaaaaacacttttgatgagatatatagatattaattccttccttgaggcaggaggactaacgggaaagttttcaatgtccgtctggcctttagaatctaagaatcccaaagtctaacctagaaagaagcagcagaatatcagacactaggaaagagcccttctgtttcaggaaaagtgccaaaacatgggcctagagaaaacgctgggccccaggactgctgctgactaaatagtaggctataaatgaagggaattatttttctttattcttctgcctgtagcaactgggctttgtcacctagaaacaatagcatcatttttcttaggagtcaggatatataataaaacattgctctgaatcagcagggtcaaaaaataaagtcagaaatgtgatgttcatccaacagcctgttcaattttcagtttttggaaaaaatgtctttatatagatatgattgtctgagattacctctgaatatattgtttggggagcttgctgcacagttaatattgcagcaaattatggaattctctcaataacagcacaaagaaatctgcgtcccgatggaaagcatttatggcagtgtagggaaactgtttcaacaacaaatgattctgttgtattttccccaaacagattttcttacctcttgatgtctccacctggcttctgagttagttttaagtggcagaacaagtgactcctctaaacatgaaggtttgctgtaatccataattcatattatagggaaaaattttaattataaggctgccacaattttcaagagtttcttaaaacaagagacacacagaggccttttggaagactgacatttagaaaaagccagcttgagggtatattggataagaggtattggggagtaaaaacactttcaggaacaaggatttcagataggaaaagcattttttaaatccttttgaaaacaagagatgtatttggttggataaactgctgattttggacaattgttataagagacctaatttttgcctttatgatcattatttgcacatattctcctcagagactaaacccatgaccaacagcgtgtgctaacttggacacaatgtgattcagtgacttaaaccataggaaaagtggactccaacatattttcctataattacctcagatagaagcaacggacaaccacaatgttgattcctttggttttatatatagtctctaatcaaaacaccttaagaatattttaagtttttccttctgcttggtaaatttctggtaactctggaaaaagatgcaaagaaaaggaccaatatggaactgctggaacgtagttgggattgagagggagtctgctcttctgtaaggatcgatggtcaactgaacgacttcaaacagccctgcttgctaaggtgaaagtaagagaaccctctaggtctcctagctcctccattcccttaattggttaccagaagcatgtggagtctttaatcagaacccccaggcaggcagtcagttgcataacaccatgccttatggctgaccagtataaatctggatacttcatccatggttaatgaatgaagtgtccagatttatactgttcagatcatcctaacttattcaatataaaaatcaccagaaatacaattttattaaattttttctatgtcccaggtgctttactagatgcataatttgcaggtatttttttccaatcttgaccataattctgcatgttaagtatgattatccctattttttaaatgaagaaactgaggctcagagaggtgaagtaacttggccacagtcactggacgataaatagcttcctgaagaagaataactggtgaatttgagtagaaagaaatacatgatttaaactgtagttgttttcagactcaaaccaaaagtcaggcttgacaactatggcaaactttagtagaaaacaaagtgactatctcaggactgtgggaaatatggaaagtggacagtgaatagcaccattagcacagctgtatttgcttctagtcctgccttttcccaagtctactgtaatgcttgtccttggcttggtatttggttaagaacgtgggtattgttgctcaaagtaaaggctatatatctgtcaagatgctaattagtgctggagactagatccagagtttcagttacaataagctctggtgtgtaccagagtcacttgtgagctttacaacccacattcctgggccctgtcactcctagatcttccagaggttgttgatggttcttagggatttgtatttcttaacaagctctcaggtaattctgatccccaccaaagtttgaaaattattgctatcaatgttgtttgggaagatgatgtcttactcagaaatatgagtaaacataataaagtatagttgcaggtcagacaaaaaattcagcttgtaaggaatgcatgaagggatgttcatgaaatatacatttggcctgtccacttttgtcaggattacttttttcctgtcttgatcaatgcctactttctcttttgtctcattaatatttgggtcaagagaatattttatcaggtctccagtaagtacgttttcctagttacctaaatgaatacagtttcatagagatcattaaaatgtaccaagtatataaaagacagaaatttggttcttaaagctgactctatatttttgttttgtcttttcaaaagtgctcattgcaatgggaagctgatctgaaaatctatccatcaaaccaatctggtctcttacaggccgtggagaccctctggggatctgggatgctttcctgtcattgcaatgacactgaccggcttttgaaccttgagaagggccatgacaatgttccggcagtaacatttatttatacctcagggctctcgtctttcataggtcttggtttgttatcacagcccttgaaattgtaggaaagaaagtgtcaagaaggcaaatgaacttctgctactgggggaattatacatgaatgtaatttgtacctggcactgatgttccaagtgcgacgaacacgactgcagtcacagaatctttcaggccaatggtgcagccaaagtgggaagccaggtctccaatgaaagctgtcagtaggccaatcatgaggatggagacaatgaaacacgcccagccattccagtattcagtaggggggacgaaggcaaacaggaccttccagaacacagtcagaaagtgcatcacgtaatcgaaacaggagggcagcttctcttccccacattcatcgtcgtcatcatcttcccctagagagaatggaaggaagcacatttcatcacaacctgtgttgccgggtcttcctctctctcaatctctcctatctaggtcggtcatccctccactctgtgacaggaggccatgagaggtgggtgaagtttagggttttccaagagttaatcataactaatgaattagttatcaagacactgaaatgcctcttacctgtggctcattggtcaatggcaaaaacttaacccctacccagttctgcatccatgcaatcaacacaccctttctactttcacatctggtaagacttgtcacttcagagaaatgaaaatgatttattccaaaaggctggcaagccctgtgtcagcctgagaaataaccctcttttgaagaaagaaaactatagatggagttctactagggttcttttcttgcaacttgaagtccaactctgggttatataatcacctacaggataatgttcacacagggccgttaatcatggctctgagccttgcatatttctccagcgtcatctcctgcaactatttcaaactcaagccttggaattacttgccaaataattatatgccaaaaaatgaaatttatttgcatttttccaaaccagatacactttctcctacttttgttctttagaactaaatgtgcttggcatatcctaatcgctccacccttatccttcctcacccatcctttaagactcgcttcctctgtgatgcactctctgacctccccccaaacccatgctgggaactccttctcagaggagcttcccaacacttgtaactctggatcagtggttctcacaatgtgcttcctgagcaggtggcacagagaacttattagaaattcaaatgatcagtcccactgaatcagaaattggggagggggtggacagcaagctgggcttgaacaagccctccatgtaatactgatgcatggtcaagtttgagaaccgcttttctaaattgtacatgttcatgttctcttctccagttgactgagaacccttccagggcaggaattcatgcatctttgtgtccctgctgtttgataccatctccagcatgtgaacaaaggtggttaagtatgtattaaatgaaggagtgcatgcagaaatttctattgactttatataactatgcaattacctgatatatatatatcacaattttgccaattaagtcatattatcagtgtacaaagaaatgcacaaagcatgctatttaaaggaaccaggaaatcaataatagtaatctaaaatggagatttcacttatgtgaaaataatgcccattgacatgttttaaaatgaggatattgaatgtcaacttttcttgaagtggtggcaaatacatgtgttatgtggccattttggaaagaagaacatctccttgaagtctttgttgacccattccaaccttgtcatcagggtgctactttacttggtcccactagtgcagccggcagtaggtggggctgcaattttccacctgaaccacgtgacctgagatggccagcatggagcacacatgtatggtcttcgtgagacactctgtggtaggcaagccattgggtgcagatgatgattgagaagaccctctgaaagcacaagagatttgagggaaaaacccctctcagaaaacatctaaagaggaatgtctggatttgtcctctgtcattttacaggaaaagagaagaggcaatggcctgctctttcatgagcacatggttggaattatatgaatacactttgggcgtctgtgaagaaagcagcctcatctttgaggctttggataaactgctgggagaagccattgcagatgagtggaatagcctttggagaactccccagtgaggagcttgagtcaggtcagctcatcagaatgtttgtgagtgaaaaagcattgctgaccgtttgctctgctgttcatgcagtatttattatatcaactttacctggaagcagaagatactttttaataaaaacacctggtatgggctgcactgtgtctccccaaaattcatatgataaagctctgtcatcacctcagagtgtgaccttatttggaaatagggcctttaaaaatgtaattaagtgaaaacagagccattagggtgagttctaacccaatatgactggtgtccttataataggaaattgggatgcacagggagataccagggatgtgcgtgcacagaggaaagaccatgtgagtgtccagtgagaagacagacatttacaagccaaggagattggcctcaggagaaatcgaacctgccaacaccttgatctcagattttcagttcccagaactgccagaaaagaaatttctgttattcaaaccacccagtctgtggtatttattacagcagccctagcaaactacagcagcccttcagaagcctctctatatcatgacgtggaaatgtaggaacaattactcagtgtttctattacctactcttttttgtttgtttccttatacatttcttcttttttctttcttttactttccttaccacttctcttttaccctacactttagctccaggtagaactccatgttagagatgcaattctcagggtttatttgaaggaggaaggaagaagaaagtcacattaatacattcccattcccaggctctcctcttacccactccccattccagccggggctgagaagggtgcatatactcagaaaagttgagaaaaagcactaggttttctagttatatttattttggatcctatcctttttaatttctatatttgtgaacattttataatttcacagggcatatgaataaaatgctttggaaagcattttaatcaatcattcacagaaacatgaactatgctgccttttctctacaaaattacttaatttggggcatctaaatctcttattttgaagacgaacaagagaacaaataatgaagcttctcagaagaaatgccatttataaattgagagtagacattatatttgtcttcaagatggaaataacacctttcccgtgagagatgtacacaggaataattagatcatgtttgtaaagtgtctgagaatatttcaaggtaatgattatcatggtagttatcattatttccctccatttaagattgttactgtgtttctccatcattatttgtttagtcaacatgctaggtcctaaggttacattataggtttttaaaaacaaaaattaattttgccctctgaaattaccttcatgatcaattaatgcaaaatgtgtgtgtgagtgtgtgtgtgtgtgtgtgtgagagcgagagagagagagagaacgtgtgttctttctgtaggcttccaatatcacaaagaatcttaaatgttttaatgcataagtctggaatgggaggcccatctgcttttataacatttgaaaggaaagtggcctcccatccttttctctgggatctcactgctctttataaattttaatctccaactcagacatcacttaaatattaaaaatgaccacggactgccatgcatgatgcacaattaccctgtcttgggaaaggacaaagaaatatcatgttcatccatcaccatctggactacacttaaaagtctgttctttctttgtgaagagtagtgaaacattaaaaaatcctaggagcatcttttatgtgacagcaaaaatgatggtaggatgcctgttctgtggttctgtatgttcaccagcctagggttcctggaggctacataattctttcaagtcccttctctgtgttagaaaagaaagacaggttggtgggtttgcttttatagaatcccaagtaaattcctcttatctcagaatcattcttttcagctaatggaaaataacctgtatttgattaacccttcctattgccttttaaatggcttccctgatacacactggacttcttaaatataactacaaaagtaaccaaatcattaaaaatgcagatagtgcacagggtgtcagttcagctattgatgtaacagtacttggaccgttcctgctcggaaacatgagagcaagagcatcatcagcatgactgacggtgaaagacaaccccctgggctttgcatatatctttcttttaaagtaaacaggtgtttctttacgtgtctctctacctgctcagggcttgaattcagggagagctctgataaccagaaaaagagactgctggaaggtaatggacacgtgggtcagaagacttaagccactttatagttctgacagcttgttttggggcaagacacttaaatttcccaagcctcagttgctcacctgtcaaatgagtttcctaactcccatctctcagagctgttgtggggattggaagaagaaatgctcaagtcctttataaaactatatgcatctttatagacaaatgtgccatattccattattgttacttgtctgaaggaaggcagtatatcaatacaatgtgagtatcctgatttcactgagtatatattctgtttgaatgagccattatcattcatttccccaagctgcttgcttttaagaaaagaaagaaacaggaagggaacctggtggggtgtctcttaaatgacaggcactaagctaaattctttcacatacctgatcttatttcatccttaaaataacactgcaaagtgggcattattaatcccattatacatatgaagatcctgaagttcagagaatttaagtgacttgctaaaataatctcacacagaatttaagtgactgagttgggatttgatctaacagtccagggaacattttactatagaaaatgccttatggaagaaagtagaggagttcagtatcacatattgattcgaagtttgagtcggaatttttttaatgcctagtgttatatagatacagtggtacctttttttttttaggaatgtgaaaatattgaggtgccataattaatatttgtattctaatactttctagatacgatttttgggttgtttatttctttggcagagccagccataagctctttctcagacccgtggggaccaagaaaacatgggaaataaaacaatcaggtaaaagcaggggatcatggtgtgactgttttggaacctctatttttttctatttaaacatttgtttaaaattttatcatatgcatttgagattagcaatgtcatgttataagatatatttagatagtaaaattattatagggaggcaaattaacatctatcatctcatctagttactttttcctgtgacaagagcagttgaagtctacttatttaacaaacatttctaatacaatttcattagctttagtccccatgtggcccattcgatctctaaacatgtgcatccttcctatctgctattttgtatcctttgacctatgtctctcattgcctgccccaacccctgcccatagtaagatggtaaccactgcttcattcctatcttggtgtatttgagctcttttcaaacatatatattttccacatataagtgagaccatgcaatatttttctttctctgtctggcttctttcacttagcataatgtcttccaggcccatccatgttgtggcaagtggcagaatctcctttcttaaggttgaatcataaggaatctctcctttagagtgtgacaagttcttatttccatttctggttgccaaaggtcaaccatccagttctgaatcaaacatcttggtttgcctctagctcatcacccttgaatttgggaaagtggcctgaatcatcacaagtctgtatgtaaagcggtctggaaaatgtatgctgctgttcatctgcggatgtgtctgactttcgattctttccaggcactcagtaggctttctcctccagaattatgacttttttgcaacctgacatacagtaattacaaatcaaattctactctcctgttacatatttctgtttctcttttctttaaaggttctgagagaatcgtaaagaataaaagatgaaagaccttagcgatcagctaagaaaaataaaacagaatggtgattcaattgatacatttttgttccctagtttgcatctgtatatatctgtttgtgtatgtgtgagaaagtgtgtatgcatgtgtatgtgacgccataagggccagcagtttttactgtcttgctcataaaatgatctgaaacttcttttctttcttttcccttttacatgcttttaccttatgtctagtgacaccttatctcttcccactcttaatggcctctgccactaaattcagtaacccaaagatttattcccaaacaagagttgatctctcttttttttgtattttggagatgtgcaataaacatttctctataccttaattggtgggaagtacttaacatattctctgatgcaaagtagatgatgtcaacaacttttcttctaagtatattggaagacacttcctatcaacgatagctcagaaaacaataggttcgaattcctagatctatgagttgccagtgcacagaagaaaatgtaggcattttcttctaccaactgaaacgtgggtcttagaaaatacctgagcttaaagctttaggagggttttgcagtgtgccaagttcaaccccggcttaatgtgaatttctttaaaatttctctgccgaatggttacttgtgccacttctgagagtttcagctattggggaactcataatctcacaatccaggtttagagtctctggcagtcagctcaggctgttaggttctactcatttgtccaggccccatcccctaggccagtggtctccaaactttttggcaccagtgactggttttctggaagacaattttgatggttttgggatgattcaagcacattacatgtattttgcactttatttctattattgttatgtactcaccataatgtggaatcagtgggaaccctgagcttattttcttgcaactagatggtcccatctttgggggatgggaggcagtgaaagatcgtcaggcattagagtctcataaggaatgcacaacctagatccatcacattggatattaatactattgtacataaaatttgagttcaagtttgctatatatttgtaacttggactactggactgttcttggatggagaagacactatacaggccccattagccatccctacccgcttcttccaagccacagctaatctgtgggccatactgtcccacgggactagtgctacttcttaaggggtttgggccaggtgatgtgtgacagtattgtaaagggcgtcaagaaggcaactcactctctgttaataactttcaaacctggctgaaatgaatgaacatctagatgaaatcatccacaaaaaacagaatgcttacaagcttaagccattatggtctttgttggggtggttaacatagcacaagaaatatttaacgtgacagaaatatttctcagcaaatgtagccactgtccaaatgaaaaacggattcactaaggagttctagctccatgcaagttcgattattaccaaaacaaatctgtttaaagctgaaaattgatggctttagtgtctcttgttcctaaaaaaaaatccgctatatgaattgggtgttcctaaattacagtttaatgtaattagtcatgtgtgtttttgccccaagcttggttgtttataaaataactccaagttagggtaagaatcttgaaattcagagtgttctcttacccttaactaattgtaggactgacagaattccaagctcccgaaatagggaaacattccctgtagacttgaatacctaagaaataaggctttgtcaagtagaattggtactcagcaagtgtagatacctcctgctagtgtagatggtttagttacagtgggaagtatgtgggcacaccaggttctaagactggcctgaggactctgataacactttgtaaatatcaccagctgtgtctaaattagcctcctgtagtgtgggaagctgagtcgtgaagcaactgtttgggcagtgataaccctataatttttaacagacatatcaatgttatgtcctagagaatgttaacatgtatataaagggtaaatgtatacccaagtctgctccacatgcagaggggcataaatgctgcccagagcctcttaagatgctgctatgattcatctatgaatgcaggttcacttactgagtgttacttttatgcatgtaggtaaaagtgtacatcccacttagtcttcatcctcccaggagcctgctgcagtaggtattattttctctgttttagagatgaagaatctgaggctcacacaatttaaatgacttgcttatgagatctaaaactctgtcacctcgctacaattacatgacccatggtttccatagagaaaaatctctgtggtttgtacagcaaaaattcattctgataaaatgtaagctcacttagcattgttttatgaaaagtgtaatggggaaatgtctctcctccttaaattaactctctggatatgatataatacacaaaatactatattgttctttcagagaatgaatggctggctcaattttattcttcctggaattttatttaaaaaaatgcatctttatgcaaatcctctattcgtgatttatttcagcctcattgggaagtgggattctcctcattttggtggcaaacatctgtctctctgggcagcaaatggaaaggacgctggctctacagcaatgacaataacactctcataactcttttcctgatctcaggatctcctgaatggactctgttctgaacatagggtttgaaagttgacgtttgagcaaagtggtgatgcaaattgagtaacagtctaatgatggcctcggtttgcacaatacaaagtgatggcagttgctcaaggcacccctcatctgcctgttcctctttccttctttctgttgtgattttttaacgagatctcagtaaacacggccctccactgaccgtaaggtcccatgatttacttgctcttggccacctcacagatcctgtgtgcctcagtttctccttctggaaaatgggcatagtcaaaaccaactttctcttttgtgctattggaaaggtataaacaagatttttaagagaagttatatgcttacatatagtaaacttagttttggcttgagggaaattagctgattggtggaattcagatggagcatctccttccctcactgctcctgaacacttctattagagggtaagtaggctaaggtgggtgctgacaatcttgtttgtctgtctgccatggctttcttgtctctcataaatagtaaccatgcatcacgatgttgtgatgtttttcttcaatatcagccatctggaaaatctctctttccctcctattgtcaataagtcagtggcctatcttttttatttggtcaaggcctggtgcatattctattaagtctgtaggtttgaactctaaaatattttgggtcactgttttgcacctcaagcccaggctgaacccctaacctggacctctaggaaatcttcaaagggaatgggatggttggaagactgactttattagtgccactcatttctttagtaagtatttattgtcaacttatgtatcaggcacagttctaggcattgcaaatgcagaaaaataagatccctgatctcatagaatttccattctggcaaggggagatagtaatcaaagtaaacaaataacaaatataatatgtaataatttcagatactgatatgagttatgaatataatgaagtctggtgactgggaggccgagaaacccctctgagcagttgacatgtgagctaagactttagtgaggagaaataatcggatatggagggaaagtattccatgcagagaaaatatctcatgcacaactgtgtagagaacagaaatatgcctgtgtcctactggcattaagctttgggaggcaagtgtgacaagatggaaagaggattgacttgggaatcagaacttgtgggtcagggtgggaatcccaacttcaatttctccatttcttgtaaatgggttcatgagtagctactgcacgaggctgctgtggggcttatgtggatataaaacaactattcaccaattgggagaccatttggtcactcagtgctgctaaggtgttggtcaggaaagcttcaatctttgctttgtctaatcctaaggcatcacatcaccaagaagcccattggtcagtaggtaacatcagagggcagacatggagtatctgatggttaaggcgttggttctacaactccagaagaaaaatgagcaatgctttatggtgcagcaggagccttgggttctaaaacagtctctctgtgatcttggaggagactccctctctctgttctcaggttcttatttgttaaaaaaaaaaaaaaaaaaaaggcaaggggaggttagaatcactgctcctttccagctcggggccaggattctaagatgctctatctaacaggccataagacacaacacccagccagacctgaccaggcaaaggcaaggcaagggagaagcatgcggtgggatgtatgtgccaaggttggttcacgcgagtggcttttcattgcaggagttggaaagacaaggtctttatcaagagagcaggctgtgaacagcaagaagtaatgctgccagtcacttttatgtggctcctctctgcctatggagagtgtttgtgtgtggtggagggtggctatggtttctcttccttccacttctttgggttaggctgcaatgtttcccctactgaaaacagcatacaaaggctcccgactggggatgaaaagtcccctcatgcctcacaccttgatttgcaagcaacaactaaaactgtattcacattgcagcagcccatgccaacaaaagagctcttggacccagtgatggcacattgtttgcagagcagagctgctgccaccccagacaaaactgcgttagagacacgacttcgggcatacaaataagagtgctgaatcattctagagcccttcaatacggtgttttcctcaagattttataatacgcaatttaagagaagaacagaccaatgagccaatattcttttcagaaacatcagctaaagcatatccagaggccagaaaataattgctttttttctcccaccctctcgtacttccacctttgtttctggcctgccttgttctggaagtggaaactgtagctacccgattcaacattttctcctgctactgctgcatttttagatcgacagatatcctaaatttgctttgctcacctactagtatgtccctagaatatctcccataaatagtttatatctggaacttactctgtctttcttcttagtcatgtcctccgcttttcctcttaggatcatcattatcagctacataacagtgaaattttactaagaatacttaagaacactgagagaaaatgtcattttatatttgcatgtccaatttgcaaatacacagataaatatatcttatgtgtacaaatatgtgaaagttcacatctccatgtcaagtgatatgaagtttgacatagagaaaacaaatgtctcaaactccttttgaaacatggcgtgtgtatggtgcgtgtgtgtgtgtgtgtgtatgtatttatatagattgttttctagatcagacacagtatgatgatgtcttttaatccagttatatacggattggaaaactttaattcacaaataaatgtattcattctttataaaacaaagacttagcattgccaagcgctgtcttagtgccaagcactgtcttaggtgttagagaaatagcgatgaacagggcagatttgcggttgttgttgcttttttttatttagattcttcctacttctaagaggacttgagcagatctgttcctattaatagagcataagatattttaagacaaaaataggacaaaaaatgtctgaagcagaaataaaggatgcttttagtcacctgagttgactgaattttgaacacgtagattaaaaaaagactgtgctttccaatggccaaagcaatttagaaaccattgaattatatagttatgatcttccagttgcaaggtgacaaaaattaattttctagggaaaaaagcttctctttaggaatttatcatgttttctttaaagtttagtgagtggcattgtgaggttttataaaagataaagtactagctttcaaatgtcatacattaaagataaaaattaaaattacagataagttaaactccaatgagggcagttttaaaagaggctctgataagaactttaagatttactttgtgatatccaattctcatcaaggatgaatggctattgaattcacttaatgtgaccattaaacagtgtattttaagcaccaaatgtcttaagtgacatattgtgaagtcagtgtaattacacactttaacatgtattctaaggtaggtattgcatcttgattaaagttagagtcctaaatttctttctttttattaataaaaaggaaattctttattgggggcatgacatgcacagaaagtatgtatttcttgaaaggtacttgaatcttttgtatcactctcttacataaattctggtgcagcaaacaaccttccaatatatagttgtttatgtgcaatgaatacaggttagaaaaacctccaacatagtaaaacaacagataaatagagttaatgtgaggcagaagaacaggcgtgagacttgtagtttggatactacctctgcagttttttgttttgagacacagtcttgctccgttgcccaggctggagtgcagtggcatgatttcggctcactgcagcctctgccttccaggttcaagtgattcttgtgcttcagcctccctagcggctgggatttcaggtgtgcaccactacgcctagctaattttttttttttttttgtatttttagtagagacagagtttcgccgtgtagaccaggctggtctcaaactcctggcctcaagtgatccaccagcctcagcctcccaaagtgctgggattacaagtgtgagccactgcacctgacctcctctgcagttttgaataagatgggtctaccaagaaaagcagggtggcagcttgggtgggacactcagcaagacctggatgtgtaataattacacagaagccaggcatggtggtgcctgcctgtagtcccagctactcaggagggtgacactggaggatcacttgagcccaggagttcaagggtacagtgagctatgacatgccactatgatgtgccactgcagtccagcctgggcaatggaggagaccccatcttttttaaaaaaatagaagagagactataactgagatttcaaatttccaaattcaattttgtcagtacatttcaaaccgagaaaatgtcctaaatgtaatgaactagcttacattttaaaaaaatatcacttacaaggatggattggataatttaaagatacctgtgaagtaaaattagtagtaatttgtgtgataatttagaactctaaatttcaaatagcagttacacggaaagcaagttggcattttatttatgagaatgaagggtctttaagagaccctttagtatttccatgtcctaaagacaactcacaaggtcatctcttctaatgctattaactcacaggggaggttagaggtcttgtccagagccccataactaattggtggctgcaccagaattcattgaactcaagtatctagagaagccaaagattccaacaaataaagaatttaaacactttatttgtcatccatgttatatgtactctgtatcacagagaatgggaatcttttaactctacactgaaacaaggaataagagctaagttggatggcagcagtgttgctcatatctcctgttggtttcaaataactactatttgacctttgttcctacctttttcaagcatgccagtgattccaagcctgaaacaacctacctacctagataactaataatatcacagagaaagagcaggagcttggagaaaaggctgggcattgattccattttgtttcataagacctgacacaatttctagctccagatataaatacaattcctacaccacaaaaacattccttatgatgggatttagtctggactttctaggaaatccagtaactgatcctgcctactttctaggactgattctattcttcctggtccttctgcacttctgtcccaggcttgcacactcatttccaaacccttaccttccccatgtgtaactgagattaaaagacttgttaacttcatcccttttgtcctgaattaactcatctgaaatgtgagcacttgaaacctaaactaaagttgtaggaggaacacctaggattgagctgaaagcctactggaattagactcacgatgatggggtttcatattccagctaatcacttgctagttgtgtgaccctacacaagttacgtaaccactctgggcctcaggatccatagttgttaactttgggaaaaatgacatagctcagaatataggtgaagaacagaaataatgcctacaaagtaccagccatgtcatagaagccaaatggtaacattaaacaaaaagtgggccacaatttttaatttatttttatttattcttttttttttttttttttttttgagacggagtcttgctctgtcacccaggctggagtgcagtgttgagatctcggctcactgcaagctctgcctcccgggttcatggcattctcccgcctcagcttcccgagtagctgggattacaggcacctgccaccatgcccggctaattttttttcttttcttttttttttttttttgtatttttagtagagatggggtttcaccgtgttagccaggatggtctcgatcttctgacctcatgatccgcctgcctcagactcccaaagtattgggattacaggtgtgagccactgcgcccagccaaagtgggccacaatttcacactcatatgtctttgacaaagttttcttttttgtttttggagttagggtcttactctgtagcctaggcagtctagtggtgcaatcacagctcactgcagccttgaactcctgggctcaggtgatcctactgcctcagcctcctgagtagctgagactacaggcatgcactatcacacccggctaattttttatttttttgtagagatggggtttcactatgttgcataggctggttttgaactccttggctcaagtgagaaactttcttaggacagttctacctacttttgctcatgagactagcatccttcttcatgaacctcagtcaacatatgattttagacaaaggaaaattatgaatgttgatatcacataagaaaaagggcaaaatgagaaatcccattggtaacaccctcctcctttttttggttgtcttctagacacactgaggctatgtcaaatctgacacagcagaattattattattattattattttttgagatggagtctcgctctgtcacccaggctggagtgcagtggtaagatctctgctcactgcaagctctgcctcccgggttcacgccattctcctgcctcagccttcctagtagctgggactacaggcacccgccaccacgcctggctaattttttgtattttaagtagagaggtggtttcaccgtgttagccaggatggtctccatctcctgacctcgtgatccacctgcctcggcctcccaaagtgctgggattacaggcatgagccaccgtgcctggccctagcagaatttttaactgcttaaattggattttcagatgacctaaggctaccacaaggattaagtaatgacaatttccccatagtaatgatgttcaataacagacgagatgctgaaaagtctcctgcttagaccagatttcacggcaatcccttgaaactcatttgaggtaccatttttattaagacttttagagtagattagccttcaggctgatagtcaagtgaattattgtccaggggaccactgagttgacagtattttatattaaataattgaggatattaatccacaaagcatgcatggatggactgatgacagaagcgtcctttaaactgaactagtatccatattggactggtgggctaaggtgacatgccctctacttatttatttagctggaactgggtcactttaatttgctgtgaaatgtagtgagtgtggacaggtcagcagcatgcaccagctgggcctcatgtagaatgtcttcccttgtactgtagaagattccactggcattcccgagatccaattatgtaacaggaagataggcacttctgaatcatcatctcacttggctttctttgaggctaaacttcaactctcctctaatccccttccttctagaagaacagaagtgaagtgtatgctgctattgtgctgaatatttagtttaggcaagccagaggatgggcaagatatgcttttccattgtcaaaatccaacgggccatgaagcaaaatccccatcagggctactgtaggactataatggccatcgacagagctcccatgtttcagtattggatggtatcttagagctagcctagtccaactctctccttttcctgatgatgaaaccaaaaatcagaagtgttaaattctttgccaagattatacagttggtaagagacagaaccaaaactgctggagtttttttttttttgagtcacttttgagtattctttcgttataaagatgccaatacatactatgtctgatatgcaaatggatatgtcaaaagtaaaacaatttcaggaaactctttaatgctggatatttaacattaggtaaaagaaagagggaggagtgtgttgacttcaaagaatgtcacaaattactaggcaggataagcctatgggtgcacctaggaaaacaaattcttccctttgttcttcagggaattgactggcatcctccccaaggaacttgtgcactggactataaggagacctaacaaatattaaggaaaaaaaaaaaacatttctatttcaagctgcggctccaatatccaaacaaatatctactatataatgtgcatgtctatgtatgcatgttttgtgtatctttgtctttgtatgtgtgtatgcctctgtgtacgtgcatacctgatttgtatgtgtgtgtctgtgttcgcacaatgcatgcatgtctctgcgtacctgtgtatacgtgtgttctacatgtgtgttcactcaggcctcatgcacagcaagcaagtgcacccttcatgctggagagactgttgggctgatttgttgcctggtactgccccttaacagttttgcttcttgagcaagtagttacattgtttttccaaacctcagtgttcttatttataaaatggtatgcatgataccatgaaagaaagaagttaaccagtgtgtttttagtcccatagctattttattaattaaattgaattaactgcatttgcacaaaatttgatcatattttattataggttctataatagaattgcctcccaaacaaccaactttggcgtttccatgtacagatggcctttgtgaaaatgcatacggtttaaattaattcttatggcagctctatgaataaagcagttatctctactttacatatgagcaaactgagattctgaggtgtgagcgaactgagatcttgaggtgtagtaatcttcctggagtcatccagggaggttttggaaggcagggacacaaacccacacctgtctccaaagccagccttgcaatcattctctcctttgcctcacctctgcccaaagctgttgtgaagaacaatatggtggttgtggaactggcactggcatcctggttccctttatccagctaatgtttgccctcttctctgacacacttgtttcccttgatacctcagctggcacacgattttttagagtcgactcaccattctgccctggtagaaggagagagatttgggaaaaactcaaactggacagggaatgctggcttcatggagaagggcatatgctggcacactttaacagcacctcgtggtcctggacttgccttgcaagttttgacagccattgaactgcagaacccactgttcctagtgttcaacccaggaagaaacagaaggagaactgccaggatgtaactgcttaatcgcttcctaatctctggattctcataaatcctttaactcttcaaatatggaattaaaagaactgggttggcagaatcattatggtcacaggaggcccaagtactgagctatgaaattcagaaaaagcagagggacaagaagattgccacagggttgactttgaaaccagtttgaatacagttactgagaaagaaaagcaaatccctatttacaaaattattatttttgtttagcgagatatattgagttaattttgcacagaaaattgcatagcaaagaaacctctcagtagagccctttaaaagcaatttaatatttgtaataaggcaaattgtactgactctcaactatttagccatgaaattttaaaatccaatgaaagtctgacttcaataaatgctgctttacaaattttattgcctgtgtaacagcctaagaatactgacattctttagacagttaaatttaatcataaagacaaatactcaacttttgaaactgcccttcatgtaattgcgtataatttggtgcttttaaaacatgggtttgactttctgatatgttgtttctcaaaattgtaaataaggtcaatttacccagcagcctgcgaatttctaagcaattgtgccttatttccaagcggtcatttagaaacataaagcacaatatattgtatgacaagaagacttgagaggtttcatatctcagttattaacaattcttcaaaagctctaggcaggagttagttccatcatgaaatgatgacaccatggccgcaggtaatgtgacgcggccagtctctctgtgagagtagggagcaattttcctcattttgaaatttccttcttctaaagggcagtagatagcacactggaccagtcttcattagatataggatctaaggtctgttctaaagacatgttgcctctctcagactcagattcttccttaattatcgtaagataacgataattataatattaaacacaacatatgaaagtgtttgcaagtcaaaatccacctcttttaagtaaggcagtattaacatctttatagttgtttctctgtatacctattctcaccagaatcaaacacatgacactggccttgttggcagcataatcccattcactgtttaaagctgcccttttctattgctatagactggtcatagaatgtttccttgttcttgagagtcataaaactatgtgaatgaaccaacgtaaaccactcctctgctagaaaagcaaatttggccttaataggtctattgatggggtcatctcggccatctctctgaaattgcagactctatacgtatttcctgttcccttccacagctttgctttcctctatgacaaacttatcatcataaatatactttactttaatgtatctgtctgatttactgtatcctccattagactgtaagctccacttgggcaggggtatttgttgcattcgctgtcatgtgccttgcaccaagaacaataattgacatagaaaaacgaaggaatgatggccagcttatggttgttatacaaatgctcatatacctgcagctaagaaaacagaaatgattagaaatggttcagtataaggcttaggatgcttttaatgttttaattctaatatgtcaaggcccataaaagagtttgttcatttttaatattttctactattggcttcgtcagcagtttcttattctagaaatttttgtctgcttagttgtgtctgtgaagagggagtatagctcatgcctcatatattaagcttagatttatagaaaaacataagaaataaaagagagtttacccctccttctattagagcttatatgcaaattccaaatccactctcctgagcagttacccaccatttaatgttcataaattcccactatatattcaattgcaaaaaaccaaagcaagattataaacacactaataataaacaggcataaaatttttactaccctctcttctcacagcacttgggagatgtgtcaaattaccctgtggcagactggaaaaagggatttggggtagaaatcatggcccaactgctagtgacgcagtttccaaattttacagcttgggaatcactacgtatttaggaaactctacctttgttaattcgttgcaactgtagaagatgagcctggagggatctttaaagagagccagtgtagatggagcagaagaacaggaaaaaaaatccaaggacggggttgctttcatgaatctttaagagggactttcctgtatcgttatacaatcacacaaagagtggacagggtttgacaatacaggaagagcacacctctctctctatttaattccctcatgtttctgactccgtgagtttgaaaaacacttcattttgtaggaacttcctaaataaaactctgtactttgcttgtgcaagaagaaacagaatgtaattctatttctatttctagagccagtgcaaacacgtatttgttgcatgttgttgaagagagtgtaaaatgatgcagatggttgtggtcaagtgtcttagtgtcttccctttccacctaggattttgctgctttttttcttgaccttgacttggccacctttgtgctgcttacagggaattttccagacaaagcctagtgattggctattcgtgaattagagacacaaaacgctttaaatttatcttgtctatttccagaaagatgcaatatagatggaggaaaatgtcatgtgtgaagacatttgcttcatctagatagtcaatttagtctttaaaatgtgcatacattaacaaataaacttatttctcccttaattttgccatggaagccctttggtgctttgccatagaccaagtagccacagtaggaaaactcagctcagattgggcaattttaatttataatatgcagagaaaggcactcaccagcactgacagtgatagcttcaatgaactgttctctccagctgttagtcccaaccacaagggccaggtttgtcttcttaatgagtttgtccacagtactctagaaatgttgaaaagaaaaatataaatgctgggttcgctaaggcctcaggaaatccaagaccttgttgattttgaaactccagagttatataaagggtagcagatgttaggctcaaaacaacagtattgacatcaaacactgttatgattatgcaaacaagcatggtccttagttggaaacattctgaaatggaaacttctttgtagcaaatacaagtctccttcactgactaatgaagaatagcctcagtgtttagaatagcagatgctgcaaaagcccatccatccccctgaatgctttgccaacttgcttctctgctggtttcatctgtagtgtttcgtctgcaagtgaattaacatatgccctattcagcactacatatctgcgaatagccggaagtgacagattatggaaccaaaaaatattgctattgtattttgtttatcaatgaaatgtagccagataatggagtctccaggttgcctgctgcatggtcatcaataaatggatttgtctctgggtactattttgtcagcctcttgcctcttagagaatctcatgctcaccctattcctattgcaaacaagaatacacaaaaatacaagaaaagttcagttcttatggtttagggcacgttgcagtttaccttgccctaaatctcccctgctttactggcactgtgctgcataccccttatttttctttggaactttttaagcaccttgttttgtacaatcagtactctctagctttctaaattcagttaatgtaacaacaagagcagccaaacattcacgagaaaactaagtaagcagatggactgaaagcactactgcaagtcatggcaactacagggagaaaagtcatttccaagacactaaggctgctcatcccaagaaactaccacagtgactagtctacgaaacatccacacttactgtcagagcatccttgaatttccactaattgcaaagaggcagaaaacacattatttgtcataggtcgaaatctgtatatgttttatgcaatgtacttgagtggactatggtttaagagagcacatttccaactaactgggagtaagcaaaatgctatctaaagggcttgtattaaaggccaaaaccaaatcataatatcaagcatgtttgctcaagaagagtcattggaacagacttgaaacattgagaagataataagcatgaaagggcccatctccaactggctcactctgtattcatgacattattcttgaaagaattgtatgtccttacggtgatgacctttcagcttccagctttgtgtctagaactgctggtgcccctgataacagctgtaaccatcactgctcttggccaccataacttgaagcacttgaccagcatccatctttcttttctcaactcagccacatctcatcaagtactctgaccatcctcactgctacaaattcaaagtgccttgtagaatgtaataagaaatgacctcgatttttcctaatgtagtggaaacttgggacagttctctccaaagaggcactctgtgctgaatccatgacagagtatcccatcacctgggaaataaacaattgaacagataaacttctctaacattgagcacagactttcctcaagaaatagctgctaaagaacaaatgtttaagataaactaaacttctgtgtgtaaaactcagggtagattttaaactgtagttcatgttaatcctgggggattatagtatagccagggttcttcctaggacttaattttcatatgtatccttccttgacctatgggaaaaatgggagtgaataaagatatagttcagacacctgaacttggacactgttgtctgtatttacctaggaggttcctaaatgcttgtgatcagtttttcactgcactagattttcaaaggcttgtgaaaacctcaccctcagcaatgggtgttagtaaaaccaggtcctcagtcacaccatagtaaataagaactcagtgggtaaagcagagtgggccattgaaaggtaccacccagatttgggtctctggtacagttctgggagctctgagtaagttctttaaaatacctatgttctagtaaaagagatttcttaaataatataaaatctaggctgatacgtaagggcagttctaaaacatgcccctaacgtgccttgtaggtattaatggtaactatactgatgaactttgaagagatgactggaaataatctatggaagctatcctacaaagataagtaccccaaacaactggtttcatgtagagacttggggcactttcaaatggtcagatcattatagtggttaccagaaagggctttggacccaagaaggctttgctgcctggaagactgtgcccggccttgcttaacttaatgcttcttatgggaagttactatgattgctcttcctgtcatgggtgcatggaaggggaaggtctgagatcatcccataagggagagaacacacaattccccaggagaacccaggcaaagggcaggggcaagcttgcttcaggaataccaacccatagactctctgctacagaaaatggcactcagctctctgattccaaatgaaaagagggtgaatgaggaagagggaggttgaacacacatggagaaaagatgagtagatgggtcaccagaaatggacagtctgagattccccgacttctggaattacagggaacttgtgcacattccaggcatggttgtgcaacaagccaagttctgtgtcatacaatgggggtctaatgatcggggtctgcctagaaagcattggttccactgtttacccccggaccccctcctcctatggaaatgtgtgaaagaagagttaacagacagattctcagtggcctaaaggaaaaagattaattgcatttttatcttaaaatattccactttaatttcaaagacattttgttttccacctgtctcctatcaggcacctccatttgtgaagtaaattaaaaaataattaatggatccagctaaaggaaaagaggggactattatgagaagtccagataaaatctgaaacttctaaattggtggtctgattctctcttttgaaaccttcattctggtgtttcaaacaggaacagtgtctgcttttgaaaagtaagcaggtaaaatactgctgtgctctgggtttgtaattctggaaagcaagagaggggatgcacatttcatatcccactgcagaactgaactgtttcttcccctgtggtcttcccagatgctagaaccatgtagggtagaagggatgggaggggacagagggagcagctaaggatcaacaggaaatttcacttcaaagtcttaagctccatccccaggcccacacattcaacttctgcaaaaatgacttttatcatctagagaactgagaatccaattttatcagctcaactgtaaactccggttgcaggcactctgcattcggtatattgactgtactaaaatgtccttggatctgaagaggatgattaaatataaatgagagcttgtcaatgggatgttccatagggagatattactatccccctgcaaaacaaaagcctcctaattttcagcagtgtgaatgccttgctctgacagatttattagcattttcaaatagaacttggtttcttccacacataacaatctcttaggattcacctttgcatgttccttgctgcccctcagattaaaccttccctttggggcacctctgaccttgtgcagtcatagatgtctcctgctgggccctggttcggatgctgtttggtttacaggactccttggttcctgattaactctataattccaatttggccccaaaggctctcaattcacaagccagttcctgaaattacatctactactctttccaggtggatcttaagctttggccaaccctatgaacagtttctgtcccaaggtgagactggctcctggtgggcagtgttggtgagcataccttgaattcataggattcttcaatgatcacttccaacttggtgtgctctcccaggatggggcgccccatttctgcaatgcgcctctcctcttcctctttgctggtcagtggctgcttgtcatcatattcgtctgtgaaacggaagtatcagagagtgagcactgtgttctgtttaatttggaaatccctggatcctgccataagaaagccaaggaggaaggaagccctaatgacctactaaagccccctgggtgagatcacgatgctggagggaagagccagacagacacttggcatgtaaggcagcatatcactgtgagagcaagtgattataacatctcacaatctaagctcatgcaaaagttcagttgaggaaaagtaatgtatggggcatatcactgagaaaagactctgcctgtacattgtctatggtaagggagtcacgcagctattccctgtgacgctggctcagttggctgtttgtacacattctttcagcacgtgaccaaagggaaacacaattgaaagtgctagagtgaccctcagagatggcggagtctggcctcttcctcttcactttctaggggcaacagaaaatgcctgaggcccaaagagatggggaacaggaaattctgactttagcctctctcttgccaagagaccctattgcaagttaaacagcaaaacatccattccatatttctgtgagacgcttgggctccagtgctgcttcagtctggtgcaaagccaaaatttgttaggaaaaccttggccatgttaatcttaaagtaaacagggagggcgagggtgaggcctttcgggagttaaaatactcactcaccatgtgagcacaattatttccagaactaccatgtagcttacagtccaggagaggacggtgggtgctgaggaaatgttaatggatccaagagcccattaatgaggggaagctcacagttggctctctctttgtgaaggtcattaggataaatcccagactgaaaaggccatgcatataagaagggcaaacactggtcctataattacccttatcctttaggcccagaatgctgaaacaagacaagctacttcttctcagatttaagtggaatgaacattgtctccaatgaaacattatctgatatggaaagacctcagccctgatggcctcatttctaggacctctggacaaagtgcctccaacagggggctgttgactaaaaagacatgcaataaaagggatgtttggtcctggcttcctgcctggtgcatttaaatattagcttctgtagaagtccatacctcccattacctccaaagacccatggcctcccccctgctgagggaccacgctatggtggctccattgttgctttggcagctgttgcagggaatgaatggttcctaggctagctgctcgttgtgagggcagggagtgaatgagctagaggcagtgccagcatttaatatttcaagggtcaaaaccaacaaaaggcaaaagcagaatgtagcatattgattaattctttagtatacattttatagtgtcatcctaaaagcccattttaaaatctgctttcctagcctcagagattacagggcaccaaataaattagttgcagactaaaaataaatgattttggactggccagaagctgctgaatgttagcagaggcaaaggagaggggcaaggagattaattttaactataaaagtggcaatattttttatagtaggattgggaagttatgacccaagggaaggcaaagagttctggttctccaagatttgtccttgcaaaattatgtatgtctagtcaagagaggtggctgagatacatgaagtgcaatttatccagcactgaaattaataatgttgattaccactgctttgtgatccttgaacccaggataatgttattagtagttttcatagcagtagtttatgctagcatctttgtttgaaactttggctgaacatggatgagttgaagacttacacagaacaagaatggttttctcagaagaaggaatattacaacttggacatctatttaaactgtgaagctattgggggagaatatttattatggccttctttttgtagtttacttataaatgacaagctgcttttaatgggactcaaggcaatctacctagaaaaaatagagaaattacaaaacaaagctgatgtggtagcattgttaagtgcagcatttcatgaaattaaactggttttgatcatggtattaaataactggacatggaataagcaaatgaagtcaaatcatacaatgagtgaaaaggttctttcttttccaaaaatccttcagtccttctgatcaggaagaaatgcttaattcggtgctgttaggtctgtaactagttcctagtatctcgacttttgtaccttttaagataggtagtcaaaatagttctcaggtgtagagcacttgccatcatctagctagaatttaataacttttttccattgtaaaaattttttaattttactttctatttgtggcaaacgatactagttttcctgtgttagtgacttaaagttttcttttaaaaacaaacttaataaagtataaacatgaggcaattttaaaaattacattaagtaaatagtatagttggtatgcaaccaaagcagtatgggaatgacaaaaattaagaaatatagtgttaacttatttcatactaacctaaaaaacagtaaggcacactgtttctatcatttgctacactcttgcttcaaagggacttagatttcttaattccacacttttatccctttatgtattcacctggacaagcttcacaattttcattttgttaaatcttatctttcaaaaccccacctcttctggcaggaaataactccctattgatgagtgagaaggtttatgaactaccactctaaccttatattaattccttaatattcgttgtgtgtatagaccatggacattttcatagactgtttttaaattttttaattatctttacatataaatatccagcacataaactcactgagatagaacaataagtttcattgtgctttgaaccatccttgtatcctctggcacctattacaatatatggaatatagtaggtgctcaataagcatttgctgtgtgactctccaactcactgttaataaagcctcttagttgctcaacccatacaaaacggatcattttttcattgagcacatctcattgtactccataccatgtcagcacttcctcctctactttccaggaacttatgatgtaatggggacaggactagacaatgggcaacttctaggcatgataaggactaggggaccagggttggggaacaactcagttggcctaaagggagtcagggaaggaagccttcctttcctgaaggaagcttcaggaaagaggagctatttgaagttggccttgaagcacatatagaagattgccgcccggtgaaggtgatggtaaggatagataggaggtggtggaatgcggaagttcattccaggcagagagaaatcaaagtacaatggtacagggtcatggaagggtcagggcagttttgacttaagtatcataaacttttatttatatgtaactgagaaatggcagctgtatagattctattattgctctacagttatactgataaattcacatttatggtctagatttttgactggcaaaaatgagagccaagtctaatttttaacaaaactgttttctgtctttagatactttctgttgaatacggaaatggtttaacagcatttttaaaattttaatcatctattttgtttccttttctcttggagcattggatcaaaagcagatcattttactatggttgaggtcagtttcatttctttacttctgcagagtgagataatatgctgtggttttagttttctcagatggaaaatatactctttctcctcctgagtgcacatgcacacttttaaaattcaccatattttattgagaagttgggaataaattacataacatcatagtcttaaccaatccaaacaacttaaagatcaaatgcataattaacagccactgctaaaatcaatattgacaggacataaaacagtcctggaatagaatcaccagtgggggatctcccttctcctgagtaattgattttgcaagcaatagcaaataataaaagctaataggtacctggcatctggggaaagcagcattttgagaaagctgtttctaacgctctctggttcaagctgtattttgaagcagagtcagtgtaagaggtgaagtgctgagagtgggaaaacaacacaacccataaggtccatctcattatcaagatctctacctcaggggacactgttgagagtcttcaatgtagtcacattttaaaactgtacaaacaacgtagaatttggagaggcggacaaggccagtggtgggacaatttgctccagatcattttgatcctccactcagaactatgctgacaagtcagaaagcagaggtctctcctgacaatttttagcatgtggctggcctctttgattggaggctaaagtgactgatacagacccaaatatcattagagatgatatttgggctctaaacctgtattagatctgggatagctgtgtaatcctctagtcaccctgtcaatgtcatttatttcccctgtggagaaaccccacagatgtactatcatctgggcatatctggctaacatcatgttgcctgggggcagcaagggcaggctctgggaagaaatacagctcagctttaaaagaaacttcatggttgggcaccatgactcattctggtaatcctaacacttggtgaggcagaggcgggtggactgcttgagcccaggagttccagaccagcctgggccacatggtgagaccccgtctctacaaaaagtacaaaaagtagctgggcatggtggtacacacctatagtcctagctactcaggaggctgaggtgtgaggatcccttgggctcaggaggttgaagctgcagtgagctgtgattgattccaccactgcactccagcttgagtgacagagagaatccccatctcaaataaaataaagaaacttcattacacttgggataaaaactgatgtgcgagaagaaatatttccaagaaatctggaatacattaaaactcaggaaagagaggccatgggatcagtcttctctgcaggctgggctggtccctactcagtgctccttttctgccctcacgtgcttgtgttttgttgtaatccaccgtaccactggctgccagagaagctgcagcattatttagcaatgttttacagaggagaggggctaaaatgcatgactgtaatgtctctaacattaaagaactctgggaggctgtggttttcaaggatcatgatgaaatgagtacctgcaatggtgattacagtagagagaatcggatgttctctagcatgaaccttcctgaagacaggttggcctagcaaaaggacaggcagaaaaatcagcagaatggattgcattgatttgctatcagagctttgtggaattagtaagctaaacatcacacccagatgcacacatcacaagcaacgttagtttggggattcaatgatcataggtcacccctaggtaggtcacagaagggagctctggtggaagttactgatggagatcactgctcagagatgagcgagtatttcatgagccaaacaagactgtgtcaacaaaccacaagccccatggtagtgagtacagccagattcctacaggtatcttaaatgatgtgtcaaggtccttcaaggtaccgcttgcagaagcatcatggaacaacaaaaggtatagtggcaggtgtcgtggttggcaagccagtcttcatgactgaattgaagtaataatgtttttaagtcaaccattatagaaatagtgtactagtgattgggaagcctattagtgccaacaatatagccttgtgtaggccatttctccagtttctccccatgtaaaatggtgataatagtacctgctctgtctaagacaggcagaatgttatgtacgcctgtaggttttgcagaggtaggccatcgtcacagcaactgtttggataacctagggttaacctaggcctagggggttctcattgaactcctggttcagctgacttccagattcacttgctatttgcctctaccaagagctacccataactgacctgggagtcatgagatttgggattcagtgccacctctgccatatgcttgtcatctaaacttgggcaaggtctttctcctctctgactctcaggcttctcagttataaagtgaagctgaatttgaacaggctttgttcctccagcctacagactgaagtgatgaaaacattttcaactgtcagaattttcatagtttggcttccttaaaaagtcttgtgtcttattaagtctattatgtgctgagcataataggattagaggagtaatattaaataggtatactgactgatttttaattagagaactctatatcttagaagttttggggatcaaacttacattcttctctccatagtgagccagaatacttaatttattaaattattcatgtttatatggtccagtttccccattctggggtacttctcacttttcacttaactggaagtcataatgatggaatttattagatacatgtgggttttgagtagaaaaggggttcaatgtataatttcaagatgcaggtagaaataagctagaggagaggaaacaggacagtgctgggattagaacagtcatcattaatttcttcaaaccttcatttcctcccctatgtgtgagaacaatgtcttactctataagattggtgataaagtgatatgatgaaaaagaaatatttacaaactctaatgagttataatatttagagtgttaccttgtcgtatgactggaaggtcaagggggaatgagatcataggcccaaacaagggcctttcaatgaggcaaggtctgggaacaataggtaaagatctgcagattccaaaagcacctccaacacttaatgtccatcactaatgagatctctgaaatattggtattaggctgtggatcagacgattttttcaatttccatatattctgcttcaaatttagattttcacactcagctgcgcaagtccatgtaaaagctgcaggcaaagtcccagggctagattaattcttcttactgcccctgcatctcaaagccttgactttaaagcctccaactgacttccaagaaaaaaagttctttagggcttgaagctgcttttcgctgtagacctaagttttagaactgtcctcaggagcatcagtagagagtggctcctaggcattctggtttgatttaggaaaagaagggtcatgtaaagtgagacgatttcttagaaagtaggaatggacaggccagtgtagaaattcccaagttttggaacattctcttgttctaactgcattaatttcaagtcttaggaagaggtgatggtaataggaaactgccatttcagattacagtttcagccataggaagaacttaatgaactaactacatgaaatgatagaaacctttgtaggaggtgattctgtcatcttggatgccagttgtggccgaggcaggaaaagttggatattatcagacagatattatagaatttgatgtaaagaagttctgagaaaagaaaactaggatcccattacctgagatattaaaagggaggacagttcaaatgacatagaaggaaggcccttaaaacaaaatttgggccaggtgcggtggctcacgcctgtaatcccagcactttgggaggccgaggtgggtggatcacgaggtcaggagattgagactctcctggccaacatggtgaaaccttgtctctactaaaaatacaaaaaattagctaggcgtggtggcacgtgcctgtagtcccagacactcgggaggctgaggcaggagaatcgcttgaaccctggaggtggaggttgcagtgagccgagatcgcgccactgtactccagcctggcaacagagtgagactccatctcaaaaaaaagtcctgacacattcagtaataaaacagaaagatattcaaacacgtcaatgtgtttttgacgtgtggctacagagcatcctagtagccacaagtttttagttagggtctctttatcagatttcacaggatggaaggtgctgttggatagtacactatttctataatggttgacttaaaaacattattacttcaattcagtcatgaagactggcttgccaaatttataccttcttcaaatctcccagggataactcatttatccttgggtgatagaattagagtgtttacaaggggacttcaagcagttaaaatgatggaatgagaaaaaggagataaaagtttaaaaaaaggagtataaattcctgcacttgacttaaaaaataacctttagtagtgcacagttggggacatctgacccagaagagcttcagatgaatcagatttaagaaatccaacacaaagacttgtcctgtttaacattcttatccctttcaacttctgtgtgtctcagagtctatgaatcattttgtcattaaatgccatgtctagagagaagcagtggagagcaacagcccatgtgaaacggcccacatgaaactgcacatatttagaaaattctacttcggacagaatcacattggaattgcttgttcatgagtttacactaacagtggattaagttcatcccaattcccaacatagtattttcatgatcagaaatttgaagtatattttcttctaaatatttttgttcagatctctgatttcaaaattttgatatctgcacaatatattggaaaattttgatattggcacaatatattggaagatgtcacatactgatatagaatgtaggccattaaagatatcttcaacctacagcttcagacagacctactgtttaaatatttatctctctaaatgtgcacagatgactctaaaagggtgagaagatatttagagacaacagaggatgctgtaaggaaatatctttgttttgtacacaagaatatagttttagagttgtgctaaataatgcaatcaacacaggctgagtaccattctaaatttaaatgtttgaaactttttaattttgacattttgagtttttatagaatactttgtaatatgcttcaagtggcagaaatattactcattaccatgttattaatactaaaacctaagtccccagagaaaccctcagattggtgtggtgggatgaggggaaggctctgctcaacatgatattatattatgtattataaattatatatttacatacataatttatgaattaaaatttatgtgttaaagtgatgtatttttacgtattttctcaacatgtatttttatgtattttctcaatatggcatttatgtgttattaggatcctgagcttggaccacggatccatcttggatgtcagcttctatgtttctctgaggctagcaattgtgtcaccttattctagagctctttggagcctctatcagggaactgtacatcattagcactatgtgaacatttgtaaattggtcagtgtcaaaatatgaacagttacagtttttccatatgaacagcttataaacacaacacacacacattattaatttgtaaaacgttaaatgtgtaaaaccagcaagagcacaccatgtgccacagttaaatattaatgcaagttacataagatgtaggtttggattgatggttaagggtatttggggaaaaataaggaacattaaaaaaataagtcttaccaaacaggtattttccttcattaaaagcaaataaaaatgagaaattttttttaatgtaataacatctggtgagaacagacagtaaaagttagatagcattagacttgaaaaattcatacctgttattgtgaagccacctaaaaaagaaaaaaacaacaacaaatgttataatttgacactctacataacaaataccagtgacatcagactgcctgacaacccacccaaggtacttgccaaattatatttacaattaagaagactaggaaaatgttcatgactgaatcactaatcgttcttttaagattatgagatttaatgcacaaatttaattcttgtgcatacctaagaaatcaccgatttttcaaaaggttgtactaaattaaaaatgcaatataaactatttgaccttgacaaaatgaggtcaatggccctaaacaacaatcttgctagcaagtcaagagaaataaaagtcacagagctactgtatcacctgacggaaatggaaaataatctagaaaaatggaaaggaaatgcaagaaatgaaatgcttaccaagctcattcaataacagggctgtgaaggaaacagacaaagacaaacacagaataagagaccagatgaataatgaaagtaagaggaatatcagcagaaagaaatccaggcagatctgattacagtggtagggagccactgctaaaaatgggtataccccaaagaaatatagtgatgggaatatttctgaataaacaatcccaactgaaatttctgaaaatgtgtgtgattgaatacatacgtatatgtgtgtgtgtgtgtgtatatgtatttcaccttatatataatttctttacatttaataagacattgctagtatatatgtttatacctagtatgtaaatctagtttaccaaatacagtggaaacattgtatgaaattcattcttaacttgatatgagtgaggcttcctcattaaatattgcctcggatttggtcaatccaacatatggaagtcttaaatcacccaggaactcaggtatcacaccttttattcagtaagtacaggtgaaacatcctgggacattccattttgggttccctgcctggaaagaaagtttagcccaaggtaaagcactatcttgggatgttctatttggatgatattttgtccaccaagaattgcttatgttttaaaatccttaaagcttaatagtcccaggaattaacacctacttgtgtccttatctgtgacttctgtacattattagataaccagaatccttctagtggacatatcatcccaggaaactgacagggcattgggttggggggagggggacgtataatttgtctttcagcttatgtgctttaagcccagaatgtactgtagcactttattttagtaaaagcaaccttgctaaatatatcaaattatttcctgagttgaagacgggaatgttacagttacttttttgggcccagttttctctctaatgatggtggcattagaggatactttctaaaaaaagtcagtaatttattaatagtgacaagaatccacttggcgggtgtgaaactggatagtgctattaaggaattttaatttgctgttacatgagagcatattttactaaaacggcaattgtaagagcagaatccaagatgctcctccttgagataaagttctttggaggaatacattgagaagaaagtgctttctcctgtatgttaatgaggcattttggatcccatcttttaagaaatcagcataattttctggtctctttttcttctgtctaccatctatggagcatattaaataggcttcattaaaataggccttgagtgctccttttcccatcactccaaatactccaaatactccatcttgaacttgattaacacagaaacatacgtgttttttccccaccagcggactgtgaggccacaaacatgggatgaacgtgggataaattttcctatgtgtctacatagcaattagtcctatatattttatttttccctctacttgtaaaagcataaatttcttacaaagtggcccatctcattatatcatactgctctcaccaattgtttgtatgcaactaataagagctattaatatgtggtctgctcattttacacaataagtaaatcaccagaattccttttaaaatggccaccattagaggataattatatgaagccctatgaacaattcagaataaaaaatcctctgtaaagctgatacaagattgctgtctttcctatgaaatatatgccatatattaataatcagcaaaatcggcataatctagttataaaggacactacttttattttttcttttttttatatgtgttaataatttactaattctgtaattatcaagagattttggagcataaagctaggtaggctttggtttcatagatatggtgccttttaaatgttgtatttgatgatataaaaatatgctaaaatgagcactagaatattgaaaatactactctttaaggatctttgttcttattaaatatttttaaactgtgttctccaaagaagcctaattatttgaattctgaagtttcctgttagttgccattagggtcatctactaatactaataggtattaagcagtttcttttttccagctttattgaggtatgattgatgaggtattaagtcgtctttatcactaaaattttagggaagatttaataattggagtgacattttagaataaaccgtgagtagtgaaaaactaaacacattcttttatgtaatcatttctgaattacagaaatccctttcagtgttattaaatctggttgcaatcaaggttagttggcatttcctgaagaaagtgggcgttgcctgttgcacttgtgaattagggaagggaaatgaaattgctaaagcttcaaaggcaatgaagtatagtacttggaagccgaggaagaggagagagttaagtgtgagagtagggagacacggagagagaagagtacaatttctcgctggtatgtctttgtttactctcacacctttcattcctcttcttatccattttggttcctcaagcacaagggagaaactgcactctttctcatattcctcacggtcaaatattctaatggtaatgatcttcctgtgggaacacaagacaaaggcaaaacaaatggttggagtcacacgctcatgctcttggtgtccaccaagctgaatgttactgtgatgttatggagggagaactggcagcacatgggcctcctgaagtatgtaaaagggcatcttgggtactcttggctggcccccattaagttttctttgctaatttatcactttcacgaattattcccgcttcagttagcagtcagtaggtaccccattttggggtattttggcatggcattgcatggcatctgcagcaactttcccagaaatggatgcttgattgactgccctgaaaattaatctctcagacgttaatgtgcagcgcacctaacgctggctgatgtagctacaggcctgcctactgtggctcagcatgagatctgtgccctgttacataggtggagggatgtgtgcattgtaagtcatgttctgaagagtgcaggcatccaggggtggcacaggccagcagaagctgttgggctcagccctggagcagctcccccacctttcttctcactcatctccaccaggcggggctctccaatctcaaggaagaaggtcttgtttttctcatactcctcatcatcaattaccttgactgatattgttttgctgaaacagagaatagaaattgacgaacaaggggaagaggaaagagaagagaaggaacatagagaagaggaaagcaaggttaaccagctgcactttcagacaaacagtaatcgagaaacttctgtactgtgagttttttcttcaagaatgggtatcagataggtatgaaagatcagagatttcacccaatgcatagctcccctgagcagggccacagaattattttaggcaaaatatagcattcagtattaataggtttgtcatcatcataaggaggaaaagcagaaaaacacagatcacaataataagaaaagaaaaacacattaatttagtaaatgccttaaccattggattgtctaagctatgccctggaactcactcctttagaacaagtcaaaaaatcccatcaagatattaatagaagttatctctgagcaattggcttacaggtcattttttttccttcactgtgctttattatagttccaaatatagtatttttatcataaattgttattaaaataataaatgaataaaaatatcacaaagaaaatatagtcaagttatttcaccccacccaatgtcttagaatcaaactcttattcaggttagtcagattctccagctagaccacagcaggaagttgttcacgttttgtttgtctttctaaagatggaagctgtggcctcacaacagctgttgtgaaagtggggtggcagcaggtgcgagtcatgatgttgtagttattttcattcttccaaagttgagttttaactttctatgaaacatgccatttacactactttcaaacatcaccgatacaccaaggtgttttgattagaattcttcctgtaatccaacctttaacagttcttgccttatggcgctatggctatgagtgactgacaggcaggtaggacaaatgcaaatattatgcaaatctcaactttccataagcattcttgatgactctgaaaataaaccaacctaatgttaccttataattaataagggcttaaacaattcatatactacaactaacttattagaagcctcttaaaccctgatttgtcttgaaaaaatgtttccagtaacattggccaagtacaattctgatcaatgtttttgaaacaatgagtgtttgtagacaacggaattttaacagcatggccattctttaattttggtggagttttttaggtcttctggaaggaaattggcttatgatcttgtttttattttatttatctgagccattaagtttcattagatctatgcatactaaagaatatcagtcttctttcctaatatgaaggagtcataggtagaagatgcttttaattctctgaatttcccagcgcctaatgccaaatgcttaagtcttgctttttggcttagcattgtagacctgagaccaaatgattggttctggttccctgaaacccaataacgtactctctgttcctcagctaaagaacattcttgaatgatactcacattccaatttctcactcctaaaaagctgcagctcatgaaactcctttctatctcatttctgtcctcaaatactgaaatatgaacacactagatgaacagctataagtgactaaagccacaatcatcttttaaagagtggttagatatttacaaaactaccaacagtatgataatgtccagttacatgtatactgtaaacagctccttcctgacttttagaattattttttaaatttgcatctttagtataaaaaattattctgctgtgactaaactagaatatttaatttttccctaatatccaaaaattataaaatattagagaaggcacaggaggatggatgtaaggaatgattgattatttgataattagaactgaatttgatgttgtaaaatagatcaaatttgctctacacaaaactgccaaatgtctgtcctctttgtcaacaaaacttacgcattttgggtattaatttccatctcacagtcttgcaatcttaaactttagtggtacatttctacaaaaacaaacagcatggtgagaccaagggtaggaaagtgttgatggacaataatagggccacgctactgttctctgcacttgatggcccaacatccattatcaagatgcttcattgtagggtacatcaaactgaaacccctcattgtgagagtcacgttgcaatattcttgttagcattacttaaaaacatctgacgttatatttctccatcttgtatttgcaacccaccctgcatctcatcacatattttattggattatagaagtaaagcacagtggggatggtagaagtagccttgctaatagggtgaatgtttgtgtagaaaaggtacctgtttcatgttcacaaagcaacttattcacaaataaataaatcaccaaacaacatattgtttctaatccttggtgaatatcataaatatttaaatcttttaatagctttattttctttctttttttttgttgagatggagtctcactcttattgcccaggctggagtgcagtggtgtgatctcggcttactgcaacctccgcctcccaggttcaagcgattcccctgcctcagcctcctgagtagctgggattacagatgcccatcaccatgcccagctaatttttgcatttttagtagagacagggtttcaccatgttggccaggctggtctggaactcctgacctcaggcgatccacccgccttggcctcccaaagtgctgggattacaggggtgagccaccacacctggcctattttctatactctaagtagctgatgggtgtgggaaacacagttatatagctccacacaatttgtttgcatataaaataagcatttatgatttatcactagcatatccctagtcataggatcacaattcttagaaaattttgaagtacttgataactatgatactggaaaaatcaaagatgaagaaaaagaaaaaagtacttttgtaggtgcctggcaaagacatctaaaacagatggaatttgcataatggcatatcatttcaaaatcattagtaatggaatcaataatgctcctgacaggaagagccactaaattatatattgatttcactcctcttgcacagtaaagctattaataggaaacttgattattaaaggacatttcagtggatctaaagtggcaggatgaagtcagtccttatgaattagccctttaaatcaacagaggcaaaaatcagaaggcactggtaatgttcaccttttgcttcagaacagaacaatttctccccttagcaaaggtagctgaggtgaaataaaccaatgtaatttttaaaggaacacatccttaggatgtctccttttcaccttccagagcctaatgcatgaaagatactgctaccacttcttccttcacaggggatagtatggggttggtttggtgaagatgtcgttattttggcttgataatcagcagaagcatgttcctcacagttctgcagtagaaagaatctcaaggactgacggaaccttgaatgtcctccagttggccccattgccacaccaatcccatgtccacaggacttttgcactgtcacaaggactccagctccctgagaacctacatccattttggctgttctgttctgtttaccaacgggaaacatagctgttgctacttcttttctttaaatagacaggttaacaaaatcaagactggaactgttgggtagacacagtccttcatccaaatataattcttgcatttttactgcactgataaagaacaaatagaaaaactggtatcatgcaactttcaactattataattattataaagacaggaaaactcacttcttttttacagcttttcaaatttgagcagtatactataaaaactgtggtttctggaaactagcaaagcagttacaaatcttacgatagcattgaaatatttcttaatatggccaaaatttttatggaagtacattttggttctatttctaaaaaaaagaaaaagaaaaaaacattcggttaagaaagatcaatttattcagtggaaaaatacagatcattccttttgaagttggcagtgccttttatttgatgataccaaaccaacatctatactttacttcccagtctctctcttatcttaggtgtctcaaaggacctgaacatcttcaaacagactaccaaggagttcttatatctggttttgactcaggcagacagtcagaaaagaaagaaagatgtggctttattaatgagggttgaaaaagaaagtctcttcaaaatatattttagtttctcattgttaagccaaagtggtaccacagtctctttttcaacttaagcctcaatttgtccttctatggtttcttttctttaagtctgcccttgatgttgggagaagatcaggaaaggatgaaatggaggattaaagagaagagactcctccattttagatccttacacaaaagattttagtgaggatttcacatatttagatgcttacagttgctttttgtcttttaaggtttaccctctccttagatattctcagaggccagtggaatgataggctctttgcatttcttaattcacagatcttcataacagccctagaagtaattcctactacctgcgattgacagggaaaacaatgactctcagagaagttggtaacttccaaggtcacaaagtgagtctcctgtgactggcttcaggaaccaaaacctttcaatcatatgactcaaaattagccactaggtcccttattcattcaactgtgcagtatttttatggccactttaaaggatctggatcattaataacgagttttattgtttcgtatttacattaacaaagaatgactgtatgaacaatgatagaatttcaattctgtttttaaaaggactgcagcacacgttatattccatgatggctgctttaaaaagttaaatcattgaggagataaaggtttaattaaaaagagcgatgagcatgcaatggctcaccaactctgaggactctgaatagttttaaccagctgtctcagcatcagcctcacctaaagtgggggacttgttagaattgcagaatcataggctccatccaggcccacagaatctgcattttaacaagatccccagatgactcttatgtatgctgaagtctgagaggcaccaatctagagtggacaatgggttcttgttattaagttggatgataaaccaataggctggtagtagttgggcttgtgttttggacccagctgcatattagaatcacctgtgggattttgcaaactagaaatacctaaacccactccagatcagttaaatcaaattctgcttgtgggagcccagcatgaatatatttaaaaagtttctggataagtgcagtggctcatgcctgtaatcctagcactttgagagatcgaggtgggaggatagcttgagtccaggagttttagagcagcctgggcaacaaagtgagaccctgtttctacgaaaaatcaaaaaaacaacacacatgcaaaaaaaaccagatgggtgtggtagtgcttgcctgcaccccagctacatgcgaggctgaggtgggaggatggcttgagcccaggaagttgaggctgcagtgagatgtgatcatgccactgcactccagaactgcgagacagagtgagacactgtctcaatcaatcaatcaaccaataaaaatgtttaaacattaaaagttttttaggtgcttctaatatgcagccagggcttgctttaaaaggatacattaaataataatatacataaaataaagaatatatagaattgtgagacagtaatagtccaaactaaattttagatctaattagcaaggtaggtggaaacatgggaagatcattttgttttgtcttttactcctgctcttttctggattataaaatgtacttaaagttgttttcccctctcaagaaatgacggtctctgcaggcaaccttaatagtataggtgagaaaacacctttagtattcaggcatcagcgtttacactcatgcacagtgatttccttctcaagaaagtgatgggagctctggcgatacgtttttacacaacagtgattatatctggaaagtagacaaactaagcatttcagttgccgcagaagacagtaatgcctcatgtccctgccacagagcctctgagccatgtcaatgaagggccatgtcgggaactggaactttcccacatgtaagccatcacaatcccagactccagaaagacctgacccaggactgaccacgcatgaacctggcaagttctctgaccacaaggagtttgaaatttaatccacagtacacttgatgttaaaagcttcaggataaactcctcttacagcttacaaagacaaactaaccaaaaacaaaaaaaaaaaaaaaaaaaaaggaaaagaaagaaaaaaagatgggcaaaggatctgaatggcatttctccacagaagataaacaaatggccaataagtacataaaaacatggtccacataattagctatcagggaaatggaaatcaaagcatctgggagataccatgtcacacccactaggaagactacgataaaaaagacagacaataacaagtcttggtgacaatgtagagaaattggaaccctcatatgctgctaataggaatgtaaaataatgcagccactttggagaagccctcaaaagtttaaaagtagaattaccatgtgaaccagcaattccactatatgccaaagagaattaaaaacatgtattcacacaaaaacttgtgcatgaattttcatcgcagcattattcataatagccaagaagtggaaacaacttaggttcatcggctgataaatggataaataatatgtggtgtatccacacaggggaatattattttgcaataaaaaggaatgatgtagtgatacatgctacaacatggatgaaccctgagaacatcattctaagtgaaagaacccagacacaaatggctacatgttgtgtgattacatgttataggaaaagtccagaataggcaaatccagagacagaaagcagattagtgattgcctcaagctggggacttagagataaaaggccgggtggggtggagggagttggtgactgctgatgggtatttggaataatgaaaatgttctaaaattgattgtagtgatggttgcacaattctgaggacatataaaaacccaactaattgtatattttaaatggttgaatcctatgttatgtaaattatgtcttaataaagctagcatttaaaaaaataagctttaggctaaattctagtctttagaaaaggctgtttccttgggtgagaaaaggttgtcagaatgtttggagttttcagtaaggagtttcaaattttgctagtacagccaaatagaaaactgtgatttccacagttttcatttacatgaaagctaagcgccactgctgtgtctgtctgtaccctactcctttcctcaggattttgcatagaatgctggttgccccctccaggatcaaggactaagttgtactttgacacactaagcagttctggtggctgttacctcaggctggcttccttgactcctttcttttccccaaaatataaggtattatgaaaatgtcagaagcagcttttcttgcattgtgtttactataaaagcaaaggaaatgattataatcataaggaggcctgctgcctttgcaaagtcagtagctctgttcatatcaccttgggcattctctagttcttttgttggcatttatttcttactacctacaggagatgatgagcttgccatgggttgcctttgtatcacttggtttaaattcctggtgcatttttaagcctttttttcctttcaaaagttgattggtgagttgcttactgatttggggttagggaaagggaggagcagtcagagaagatccatgcatatattatcattttctgtaagtgacccaaaccaactcctccatctagtaaacatttcaagtggaataaggacaggttgctattcatattatttctactaatatttttacatcatttttagattactggtgagatattttgggcatggattcatttggggggatagtcataaaaacaggactgaatcatgacttaaatctattgtttcctttctcgaaatcttgagagaattaatccagaagtcaacattacccaggtttgtaacttggctctgctactttctagccaaggtatttgggtcacttctggcatccttctaaacatcaatgttgtaaatctatcaaatgaagataatagaacttacttcacagtgattatgatgttcacagtgttgtgatgatcaaataatggttatcatcatttatcaaatatggataatgaaattcgcaggttattgcaaagattaaataatatattgcatgcaaaaattattttgtaaagagctaatgaaatgttaggtactattattcttattagttgaaaaggagtggtttgttttgcagttcttgcctgcctgtttacccagttactaaaaggagcaaattggcagatggtagagttgtgggtcaggaaatattcaatggagtaataagcaataccctcaaatccactctcatatataactttggatcaaatcccatataatggggcatccaagtccagaatccgaaactcaagaacgcagggagcacagctctgccaggttctcattcaccactagcaggatacgcacagggatctgaagtcatgcttttcctggagctcctgctatgaagcctagcctgacaaacggtggtggtgctattctgtaatttaaatagactccaaggacaagagttgctaaagtagctaaaccaaagtaattctccaggaggccttgttgtccgtgccctgatcttttggtattgtcaaatggttattgaaatcattgcttcaagcagagcaagagacagcgacagctaaaatcctgctgttcccagggagaccaagggagctttagagagttctggagttggggttttctaacataaccttgccctattttactttcctctgccaactatggaaacttaatggcaaccagttcattttgtcaaatgcaaaataagaataaatttagttctttagtctatgattttagcaatcaattgtcagtgtcagtgtccaaaaaacaaatatatgagctacttttctgtccctagaagacattctggttgactactcgaaagagatactacagggatccatagttattgtttttaataaataataggctagtctgtctagtatccccacaatgttctatgctattatggtaggtttcagagaagatcaggtgagtaagtttgctaagacaaaattacatgggtgtattaaaaattgaccataattttgtgatatataaaatgtataccttaccattgcctcactcttctgcagttgataaacttcagccttaaggagggtaaagcaataaggacctggggtctgttacctacacatgcctgctgagaccatttctctgctcagtgaaaattaaagtggatcaagcatagggtaccatgttgaaatatggcaaaatagatgcaaattgattttttattgcttaaaaatactggcattttgcaaattctatgagagggtcacatttaacaaaacgatggcagattcttggcatcgtcaaacttattagttaacattcttataagactacctatttttctataatctgagatcttaactgtactccttaaatgcagattctctagaaaataatattttaacaaaatgttcaaagtttaaggtaacgtttaaaatgatttgtggcaaagagcatcttttctagaaatgaaacacatcaacatctttgtctggttcagttttagaaagatcagttctccatttgccactgcctattacgagaatttagaatgacaatgaaattgatgctgctggatttcagactgctggttgcccaaccttttcaaaagctctcttcgtcctgaacattttaaacattcctggaaggtcatcagactcgttccagagattatttctacctttggtctttcttcctatgttacgtttcttttttcaaagtaaaaagtgtcaaggaaaactctggaaggacttcactcctggcatgttataggacagcagctagaatatgctgaaagcatctctgtcagaaagaggtcagctttaaaataagaacaccaggaaatgagctgggctttcttaagtcttaaaattcatattctctttctctgttttccctccttccctctctgtgtccctggccacaaaatgcacagtggcaaatcaatctctgtctgcatgtactcttgtaaaacattcttaaagatggatgccagatattttcttgaacatggctaaaagaaaccaataattagtgaattggtgctgatttttaaatttcacattttaattttatgtctaatattttattggtatttcacattagattaggagacaagagaataggaccttaggtattagtaaagctaatttactaatatcaaggggtagactagtagaaatcaataccagatttctttttttaaataaaatttttgatgtatccctttggctgttgcttttcctgataacctggataaaactaaacttgattctaaacagagttctgtccttgtctatatgaaacatcataaattgccagaaggaataatagtccgtattagccagtttatattccatgggttctttctcactaaatacaatgtggattgctttaggataatgtatattcttttaaagcatcttcctgcatattattatgtttattatcgagacggagtctcgctctgtcgcccagtctgtagtgcagtggtgcaatctcggctcactgtaacctctgcctctcaggttcaagtgattctcctgcctcaacctcctgagtagctgggactacagaagcatgccaccgcgcccgaataatttttgtatttttagtagagacagggtttcaccgtgttggccaggctggtctcgaactcaggtaataccacccaccccagcctcccaaagtgctgggattacaggcatgagcccctgtgcctggcccattttcctgcatattaaagtaatacttgctaattattgcaaatttgagaaatgcagaaatgaagaaaaagtcacccataatcctatcactagaaattaacattttaaaatgttttgttttagcttttaatgaagttgccaagaatattatgaatttttgatgttcttctatggatgagctacttgggcttagctcttttagaggccaaagtttattttcccgacaatcctcctcacatgcttgggccccactctggactcttaatgtagaaggtaacgttccccatcttctctttctattggcttgtatggaagttcttgtctgaattctgccatatggaaaatgttcacatacatttttaaaaggagaaattctctcctcggtcattactaaccttttggctggttttgctggaaaagttttcaggattcatctgccaatgttgtttccctagaaggccatcctggctacctcgctaagcatcttatttgttctgtaacaaaaaattcttcatgctaaatcactcgcaaatgccatgctgcttagcgcccttctgctaatcacccattcccaagtttgtcatcaaaatagcattagttattttccactcaacttcagccctcatcttcccaagccctccacttttcattctagaagcacaatctctcaatccttaatcacagaaatctccctgttcacttctcattatacacatacgcaaactgagactcagtgaaattaaccaatgcctcaaagctagtggatgccagaattaggattaaaactcatcttcagactccgaatccacatctgttatttgtttattctgccattatcctagtgtttttcttctcgatgctgctaaaatctaattcaccactcttcatagaaaacttttctttttctcctctctttttaattaagtaaaaaccgatgctgataacagaaagaaatgcatgattttctttggtaactcagtaccatttcatcattgtccatcacgctgagggatgccttataaattcaatggctcatgcaatgcaaacaaatacttcctttagtaaggatggctgtgttgaatcttggcctgaaagatctttgacctgaaacaaaactacaacatccacagaaacgctacataaagtgtacaggtaaaataatagtcaataaaaatcaacccctagtcttattattattctcaagtcttctgggcatcccacttagcagttgcctgtctctccactttttcttccttcttcaaacatagtcatggtatgcagcccctctctaccactagacgtggtcaataactgtgtgtgtgggtgtgtgtgtgtgttttccccttagaaaatctatttgcacttttaaaggaatattcattttctaattcaaaagggggtaattgtgaaaagaactggctttacaacaatgtggtaagcttgtaggcatagttgagtagtgtgcctctatatggtgaaatactccttgaatgtctaatcccaaacaagtaattaaatatagtataaactacaaagtaaaagtcactaccgacaaaatatcaagggcatcaatatgcctcctgttttctgctttctgctgctactttctactccttgcaaggtccagtgatgtacccactaactgtggactctcaccgaacttttcactatagcacttacttgaatgtttaaatcttttctgggtattccatttagcttaaaaaaacatcagttatcattttggagttcatattcttgatagaagggatccaaacactttataggtaagcatcacaagataaaatcagcaagacaatttagctatttactggtacttgcaatttaaagcttaaaatcaaaattaaccaaaaccagaacagactttattgggtttaaactaaaaatgtgttttgctttctttcccttttttgtttcttgtttatgatggaagtttccccagctagactttatagaaccagagcaggtttgcaaaatgcaaataatgacactgtttaacaaaattgaaccactggaccaaacagtgagaaagtacttgctgagcaattcctgggttaattacaggattctgatgagctacatttaatgtgcccattgattgtagacgaaaatctgtaagtaagctttgaaaatttttttaaattttattatggatcatgtgtagttcagttagggctcaaaaaagcgaatcttcacccctatttcagcttttgacccagacataatcttatagggaaacgttgttttgaggatttttattagtttgtaaattttgtaggaagtctgtgcttttgttcagagaatcatgtaggtagagaggacctacgggatctagatttgcatttgcaatagagttacagcttttagcagcattatttagtcacttaacatttcaatttaaatatacaataagacaaattatatgtaacccacaaggttaatatggaaaacaaataaaataatttatataagagatttttttcacactttaagcattttcacatgtgctttcattattattatctaacttaatcgcattcttgcaactgagcaaacttagatttcttgattccaacaatctttctagtaagctaaagcttcctcagctgtaattcaaaaatatatatggggcattaatatgaatattataatattcattttggaaaataagagttttctgtgtgaatgaaaaagcaatgatttctgacacctatccatggatctccttttagagttttttttacatttatataactaaagcctttcaaaattgtagcagcagatacaattgactgctagaacatgagcaaatactttattaaatatttatgacaatttcttattgaattttaacatttatattaactttaatcatggtacaattaagtttaacttacatagaatactaacgcaaatggagaaatacgggaaagctttgcagggcatctcaagggtgggtctatgtataatgaataaatcctattcaataaaatatacagttttactttttgtattatttaggccaggaaactcttagaagattattatggattttcccctacatattaacttgctgtcttggtgtaatatttgttggtcctgaatacttttttttattgagttatctttgagtttgtagaatcatcaaaatcctcttaatagatttaattaaattgctttcacaaagttagacttcctgagatagagattcaaagtttggtgagactggtaatggaacagaagagaatccatggaaatacaatcctgggtcttcagaccccctaagaatgtcagctcttcaggcagtactgtctgtattcaacagtaaccatccgccacgggataggacagcattaagtatgtgtgcattccccgtgacagtgagcacagtgctggcacatagtgtttgcgtaataaatggttttggttgactcactgtctgtacttgagtttgtgccaatcaatcaaggtatcttacatttcttagtaaaaggcagcttacatatgttttagataaaaagatagggttcttaatgttgatctcaccatgacagtaagcaaaatgaatggtgtgtaggtgattcaagctcatgacctggacatcatgaggaagggcaagatgaatttatcagccacgttttagattcctgcaatatgttattccattcagccattccacaaacctttactgagtatccaatttttgtgactggcccacattaggcattggggataaaaagaggagtacgaattcacagcttagagaagggataggcatgtaaaccaaagattatgcacctctatgtgtgttaattgtaaatatgggctctgtgctgtgtgagcacagtgggtggggaaataaacagagacttggaaaggcatggcatgtttaagaagcatcaggttctatctgacttatgtttatggtgtgcacatgtaagtggtagagggttgatgggaggtgagtcaagaaagagagcttggagacaggagaaatgctaaatcatgtgggcataattttgcaagaaggagccaatgggcctttttgattatggactgctattatccaatttaacttttagtacaatcactaactctagaataaagcttgtattgtagtgaaggagagggggcagggaagcagatgtggagaagatattatctcctggactggcagagcctaaagtccctgcctgaataattagccaggtacccctccagcagcatactttaaagaagtgtctggccccctatctccagtctagatctgtcaaagctgaataaataaagaaaagttgctttaattacttttctgaaatttctccttcctgaaaacttgtctgtgggttagagaaaacaagttgaaattgcatgaaatgctttctctgagttcctctgccaagatcaatttcttgtagcacgatggaggtagtaaaatacgaattctgctagagaaaacatcatgagattgtaaaactgacctgattttcatgaaaagaaaatctatctaccataaattcagatctgagcacatatttcattttatttttatcaaccgtgagtaggtttggcaagccttatgacaaaatgatatctgggcatatatgttaagtttttaaaggaaattatcaaaaactaaggtctcaggttaatgatttacatggaaaattgctatcacattacattatcttctacagtatttgcaggagaactggtgagagaattacaaccaagatgatataatgaaatgaaaatttacaagttgaggtgtgggaaagggtaaaaggataacactgagcgatcactaagaaaaatgactcaggttactcagtaagcaatgtgtgtgtgtgtgtgtgtgtgtgtgtgtgtgtgtgtgcgcgcgcaaagaaaacgagagggagaaggaaagagaaatttaaagacagagatagaataaaatgtcttgagttttatgataagaaatagccacttaatattggaggcaaatgaggtctaaaaagattggaggcattaataaaattaataacaccagttcctcgcccttctttgtgttaagcagataggagcagtgagaggttgaaggccaaggtgatagcaagggtttggtagcagcaattatgtcatatcctagggccagggcctaggaccacacaatgggatgagacagactggaagaggccaagactggaactcaacccgcccactggagtagtgcaggtagtaggatatcagggagtctgtacaaagccaccaaagatggaaggtccattccgaagaaacaaaacacagaacccagaaaatatggaaatctagattatacagaagccaggtaaaccactgggtgagatgggcaagaaagcatggagctgagtgatgtagaatggaggataaaacaggacagatggctgctcatagcatcatgtagcagagttctgtcattatctgttctccaaagggactgatcacaagaagaatgtgccttcatttaggatgaactgaagtcttgaaatcaacacagggaagcaaaaaccagttagaaagtcaaatatgactttcaggcagatttcaggaatctagtagtttactgcttttgtttctgagtatctggaagaacacatgtgatatgcagaaatttgatagtaaagtatctggtaaatgaaagactggacttttggaactggagaatagttcagagaccgatgatcaacaagcttattgggatgctgaggctcagaggagagctaggctcaggcttgtgaagttcctcctgcttaaggtcacggtggagtggggctgagaaaattggttgggatcagtccagacttgtggagaactggaggaaaggaatgaagctgagaaagaatttggagaaaaattgaaactttctacctgcttcctctcaaatctcttctgtatgactatatctttatgattatctataacttctattaattatttaagtaaatagtgtttgcaagggtccgaacatgggagaaagataataatatgggaggttaaggaatcttgtggggagaagataataaattcttatcttgatatatttaatccaagtcatgatgggaaatgtcttatagaatgtatattaacagcgtatttgtacataacagatctggagtgaagacgaagtatctggatggcaagactctctgtatatttgtcatgcattctgaagtggtaattgaaggcactgatgtgagctaatagacttttttccaaaggagtgaccttaaaagaaaaatcaaagaaatgtgaaatccaatattgtaataatatcactggtaagagtgtaaaagagtaaagggaggcggggagaaagggagaccgagaggggtgagttacaggaaggctgagaaatgctagggtccttgaagcttagggtaggatgtctttcaacttgaaggaggaagtgctaatatttaaaaatcaggagactaacaactttatgggggtggggggaagggtcacagtttgggctgagaggaggctattaaaaataaaaccaaatagctgacttgtgttgtgatttgaggaaggacaaggaaaaattttcaagttgtaatgttggtggtggtacgctcaaagagttttaatacaaaagaggagttgaatgaaatgacacatggtaggggcagttgtagtgagtggtgactttccagagaagttgtcctgagaaaactcaagcatgcattaaaacttaagaagtgaattctcagtaaatacaaggctcatttcaccttgagaaatgagcctctgaccttgtgaggtcctcagttttatggaaggaacataatattagaccagtgggtcctgagatccagctggctacttgcatttcctgtgaagctttagaaacgaagattccttgtcgttatcatcaaatcagagcctctgcatgcgtagatgaaaggtgagcatggggaatctatagtgctgaaaagctcccctaatatatctaatgcaatgatccatcaattggtgttagggaaatattctactagacctgcacctactcccaggttaagaggcttaacagcaaatatcattaagggccttaaaaaataacccttttctttcattatctgtctcactccccacatttaaaccgctcatgaaatttacacttttccatgacgctttcttagattgatcaggtgtcatattcaggggatgaaagcaaaaggtagttctttgtggctcttgtggattcttcacactgtattttaagagagaaattttctatcaagtctactctcagtgcattgattagtggtaaaagtccatttattatctcacagaattactaagtctgtagcatattctgcagagggggtgttctttatggtagatcgatttgttctgtaacttgtataattttccattagaagatgtcatggaagtgctcctgttcatatcccacacatcagtggctgcaaatcaaatgaagcctgttacttgttactgtagaattggaccaggtttgtctgatactattccatgccaagccatttgccccagttcccatttgggggccagatgaaattattttgagtgcatttcgatagtgatatccctcctgataaatttagcatttactgagggatccactttctacgcatgcatgtaactgctattttccctgagctcagagatcgttggcagaagtgacagctggtgcctcgggatggagctataattttatggtgcagtgtctacggctggaaatgcaactagcaaaccacaaatgccaaacacatcataaaggaaaatgttccttaggaagtacttgccaatttctgagcaattaattagtccctaacatacacactgacttgtatgaataaaacagcctaggaaattaatttaattaagcagacagttacgataaaattaggtgctttccccctttagcaaaagatctctctttcatacccacttctggcttgcatcctcactctctggtaggtctgcttccattttccaaactcttataaggactctaaaggaaattcagtattcttagaatgagaggaaactgactggttattccaagtgaaactgcttgtctcccagacattttcctgttgaaattttccccagcttgctacaccttttctccactttctatggaaccaagagagtggtagtatctgtgaggttcaagataggatctattgacaaagctccagagtggtagtatctgtgaggttcaagacaggatctattgacaaagctccagggaagaatgactgtccagaaatgctccttgggaatagcttttgtggaaagaaagcagtgcctccaccccacatctttagttctggcagctccctatagcgacaaagtgaatatagatcagaaggacaggagtgcatatcagaatggaccagatgaggaacagcagaggaacataagattcagggcagctccaaacttctagaaggacttgccaactctggtcagttgaaaaagtcattatatgaatatcttatttttctaaaatgaatgtgtgttagattaaatgaaagatataggaagggaacatgtgaacattggtaaaatatagggattagaagtaaaggagggattagtgttttggaagataacggtagcaaaaaacctcaaaacaattgtgtttgaaatcacatacacactggcctaattgactggacattcttacatggaatgctactaaccagagttcttgtttgcatttcccaagcctagaaagatgatatataattatcaccattatatatttatttagtgtgctctctgagatgcccaaaacacttggtgacatatttaattaattcatatcacttctataaaatatttcaggtatttaatttcagttgctataagaaaaatatttattgatttcttttttaaaaaagactgcagttggtaaaactgacccagagtataaatacagaatgaaacctgcagtgagaaatgaattccacagtaatacagataacaaggagaataaaacccaaagtcagagaccttgatatttgattatcttcagttgtttggaatgcatggtttgagcatgctcatgagaacactggcatgatactgggtaggttccctctttaaggcactaactactctggagagtgactccaaaatgtggtttcccactcctcattactatgacaaatttcacattaactcaattgtcagaccctttccctgctgatacagggttgaagggttggcttggtgatcaattctttgagctttcagagagattttgcagcttaatggaaagctaatttaaggaaaaaaaaaaaaagaagttgaactaggatttgctctagggaccataacatgaatgttctattgtaagcttcttgatggaaggcattatattttaaaatcctatagtaatacaattaataaatacagaaaatgccagctgatataatagaaaattgttcaagactccaaaaattaatctgatcccatttcaaagtgaagctaaaaagatgtccatgtttttagttgtggaatttagagtatgtgatggggcctacttggaatcctagtagacagaggaattaaataataaaatttgcattactcagatctatcatagtggtggaaatggacactgctcaccttgtgagccttgaatgaatcaatgttggatcactggcttgcaatggatgaagcttggcaggcgtggtcttcctgaagtggcactcctctagaccaacacatgatactcttattccatcataatcatactacagagaatagacccccataaggaccataaatattgtttgtctgtactgtactgcaggtgatcaaaactctggcaaccaataggatttattttctagaggacagatactactccaaaacaatactagatcaaaaaggaaggctttaaaaattacacagaagtgtttgtggcaaagatccctctttgtatgtgtaggactataggtattaagattcggaagcaagcagaacaagttctgctatactatttgccaggaatctatgtcctcaaaattcctctcctcatttagaaaaacacaattacaaaaactcagccatagagtttgcagtttgacatgttgctgattctacatgataattgatcacttcaaaactgacaggacttacattaggctcttgttcttagttttagttttaacaggggaaccaggaaagaaagaaagattgctcatcagtggccatatttggcaaaggcaagactctcttcccccaattcattcatcctgatagagattgacacagaccagatgttattccaatgttaaaattacattgttttcataacaaagtcagcttatattactcttcaagagatcacactaatgctcctttgtatactgttatgaggagggtgagttagatctttccagaggacttgccaagcacaaactataagaagagttaagattttctcaaggcattcactagctggcttacaatctacatatctatgtgtctctgcagcacatagaggatttcaagtcattgatatatatatatatatatttatatatatatataaatatatatatatttttttatatatatatataaatatatatatatatatatatatatatataacctcttttagtaatttctgatacttagaagaaattacaggtacttgttcttcaggtaggttgagagctagcgatttcattggctagagcttttttgttgcttattttctttgtcctttcctctcaggtcatggtgaccttaaattatgattccaatgcttaagagttttatgtgtgctatttttcccatgtaacatctggaacttggaaggtaaaaattccaaatcaagggccagaatccatatgggctcagcacatgtaaaccataattttggaagcttagtccctcttagcccccttatcattgctgcattcccacttactatatcacctctgtggccttgatggcaagtttgggaactgagaactcctgaaaatgccaacaagcagtcatcttcaggggattctaatagtaaaaggccaaatgaagacattccttgctgaccaagtcaccataactcttaaactattgccgtgagccagaagaaggaatttttttcttttagctttagagactttgtccttaattgacttcatgcttcttattactcacaatattcatttttatatagtcggtttatattgtagaaaacaacccacttaaatatttatatatgataaaactggtgagtatgagtgagattataaaacaagttaatatatttaatattacaaagaatgctaacatttctttatttccacacaacactctcttctcttcttttattctcttctctttttgcctttaagcaaaataaaaaagactcaaagtaagggcgagaattataatgccaaaatactcaggaatatcattcaaatcttgaacggagacccccactccctcaaaaaaaaaagaaaagaaaaaagttatccataaataatgtacttctccttcaagattactaggttatgtaagataaatgccaccattttctcctcatgctacttaatctaagaagtcttatgattttctgtttttcaatttcttatgttttcaatttcttgtgacttgtcaaaggtatgactggttgggttctaatcaatatttttctactcattcaacactatttggctctaaaaccaaaacaaaattcaatttacaaatatattatttttgtggtaaattttagattgtctattactccaaaccagagattttaatgctaatgtttgttttgaggagaaatgagaattaagcttgatcttgatgatcaaccacagcaaaattatctccagttaggaaacaccagtctaaattgaaggtatagtatgtctccactttccctgaatgactacatggtattttactaagctttgcctttgtaagtacacacagaagggttcttgactattctggcttgaagaacttatgctgaaatgagtcatgtaaaccatggcagagagtcacaaaactggaaacatggaaggctgtatggtcatagaaacaccttaccagtagagtaccctgaagaagacttcttgttagcatttgcatgagttcttggtccccaaacttaccatcaaggccacagaggtaataaagtcaatgggaaagcagcaatgataagggggtcaggaggtcataacacaaactattggaggagttaagattttctcagagcattctctagctggcttacaacctacatatctatgtgcctctttgcagcacatggaggatttcaacactgaacatttgaacattagatatataaaagcatgtgtatatgcatgcatgctggtgtgtgtacacatgctggtgtgtgtacacgtggaggtgtgtgcaccctagaccttttttgctatactatccttagaggatgtgtttccaaagattagatcagcaccatggagcaaagtgcaaggaatgaaaattaatccagtgttaacagctttatacagtaagaagagtaggtcaaaatgtttaaaattctcattgggatctatgaacaattttttatgctatcctctccacctcaaatgtcctacttccacatccttgcacgtccaaatcttgctcaatccttttagatatagctgttaggacaccccttcacaaagctatctgtgatttatcactcagaattacctcttttctgaatttaccatcagatttttttctgtaaattcacatggtatagatcacttcctgacttgtatggtgattatgtttctacctgattgttaatagtgaactataaacatcttcagaacaaaatccctgtctgcttcaactttgcatttctgaatagaaggggaaacaatcaagaaatatttactgaatcaaaatatataatggtggccatatattttatcctttttttctaagctaatagcatttctcccactcttaaaaggcatatgcagaaatcaccaagggtgatgtgacagcataacattagcaaagtttaaaagtacacaagagctaaactgtggatacccacacaaacagggagagacctacttcctggtgtcaatgaaattacagctctaaagagccaatatgtcatttaatttaaaagtcactgttcatgaattgcaattaccctctggcctgcaagcatgtgttcatagctaagaaattttctctatgcccaggtagaatatattgctggcttttccaggggaacctaatgccaaatagaatggcacctacataaccaacttgaggcatgctttaaaaagtgtccctgtgataagccacaagaaatgacagactatgttgaggaactcagtgactctacagccatgctaggcttggagcccactcagacaacaacatgggattgttgtttttaagccaattgctcacagtcgataaaacaaaaggattaaacttttgacagactttccctattctcaccaactggctaatgctagtgctgctttgctcaggcctccttaagcatgtttacttgcaattccttccaaatgtcacttactagaaactgcattcctgattctggaggtaataatcctggagacacagctttcatcagctaatgggtagtgactcagagtatatccagagacaaacaaattaaagagcatggaagattggagcaaacagctaaagaactttgttgtgatatatttagaaagcaggcattctgttccccaataacattgtgctaatattggtgctttccatttactggatttgattgccagcaaaacctaaacagaaatgttttacatccataaactactcccaaatcattggtctgaaaaaatgccattctgtaatatgcctactgctaacacttccattagttgctcaagagaaatgcaagaatagcttagaggagtcttagccaaaaatatataattctgacatatggagaaaaccaatgcaataatttacaaaagattaactgttaaagtgctgctaaaggttggggggattactttaatcaaatgcctgcattctaatatggtgagggttattttattttgagacagggtcttgttttgtcacccatgctagagtgcagtgacatgaccatggctcactgcagcctcaaccttctgggctcaaatgatcctctacctcatcctctggagtagctgggactacatgcatgaactaccacacctggctaattttttaattaaaaattttttttttgtagagatgaggtttcactatgttactcaagctggtctcaaactcttgggctcaagtgatcctctagccttggcctcccaaagtgctgggattataggtgtgagccaccgtgcccagctggtgaaggttgaaaacaattttacaaaccacatttaagtgaggaagaaaaacatgtagaaagatccctgtgttctttagatgacatttgaaaaatgcacacatgcttttaaaagccatttgttgcacttactcttcaggaggtatgcttaaatgtctgttcagaaaacatcttaaatttgggatacattgttctgtcttttaagattgctttagactgctacttactttaaaagaattgtgagattactctaggtgtatgtttataaaaaattcaaagttcagaaaattcctgtaagccccttaagagcattttaattgtagcatttttcctatgatcctttaagaaaatccgctacgggttttcagattatgtttccaccccagttgagagtaaccacaatgacaactatgtactgcaatttgcagcagaaatgactacacatttctgcccttagctgaaagaaaaacaaccatatggaccttgttcttagccagcgctccattagctaattaaatttacaaagcccaaccagtaagagaacatggattagccccattctaatgactctatccctttggcggagctaatgttgtcttgtttcagagcagactagagaaacttgacttactttgaataggtcagacaggttagtccaacagaaatacaatgcaagtcacatatatatgcaaaaagataaaggtgaaaatttaataataacttttatttactcaatatatccaacatatcataatcttaacatataattaatataaattttaagatttttatattctttttttcatactaaatctttgaaatctggtatttatggttactgcacttcttaatgtgggttagccacatgtcagtgatttaatagctacgtatgactagtggctaccatattgaatggtacaggattgagtggtgagatgtgccattccatcttctttccattgttcacactcataatctatttcaggagtacagtgcttcacttttcatacgtgcatatcagctgggcatatagtcattttaaattctgaattaacctgaagatgaaagaacagtggccaacttatttccttttaagaaaaactgtctctagttaaaaatacaacatgcataagtatgtgaggtaatgtataattattaatagctcaatttagcctttccataaggtatacctatttgaaaacatgttgtacatcataaatatatagttttcatcaatttaaaaataaataaaaacatcgtttataagtctaaaaagtgctaggggcaaaataaggccctctctctagcctattgacccattttgaagtaaatgattacagctgtggaatgcttcaaggaacttaaggtatgatgtgacagcttgagtttgaaagtcttctctcgttcttttttatgactgcatagtattccatggtgtatatgtaccacattttctttatccagtctatcactgactttgcagggacatggatggagctggaggccattatccatagcggactaacaaaggaacagaaaaccaaacaccgcaggttctcacttacaagagggagctaattgatgagaacacatggacacacagaggggaacaacacacactggggcctttcaaatggtggaaggtgggaggagagagaggatgaggaaaaataactaatgggtactaggcttaataactggatgatgagataatctgtacaataaatctccatgacacaagtttacctatgtagcaaacctgcgcttgtacatctgaacttagaagttgaaaaaatatcttgaaaaaaaaaaaaaaaagaaaaagtcttctcctaaatttaggcaacattctatttcagttgagctgtgtataactggcccatgggtgcagggatcacgttttcctacctagaaagggaaacatgatcttacaaaggaattatttgtccttgtatgatttggtgacacaaaaattctcattggggcatgaaaataaaatatatttaatgaaaagatttgattggaaaaagtaaagttacagaaaactaggttgttttcagagaattcaacaaacttagggtgaataaacactaaagttctacttcacaattataattgaatcaacaaatggatagaagctatgaagaaccaattaggttgtgtccttacctaatttctggaatgctagtgtgaataagcctgtgccatgacaaatatcagaactgtggacaattattgaattttagtcttaaaatcagggtactttcctcaacttctagaatcaaaagatgtcacttcatcatcttggaacatttattttaatctgtcctgaatgtaattatttgatcaagctattgtcacaaaatcctattaactcaaagagtgattgcattattcactccttactcatttcttgatttcagtgcttattaaatgaaagttttcaggcagccaaaatgaaggataaccttaaggattcttccttctttttaattttaggaattgtatactgtagtttatcataacaacatatctaggctgcagaaattcagggaaggcctgaaggttttaataaaaattaaaaacaagacccatcaaatgatccaaacacttcctttgcttatcttaaaacacaagaatcagaaccagcagaatgagctttaggcctgggaacaaaatgtcagagataaaattggtatactattttcacccctacgatctacatggttgagggggtttgaaggaagtgaagaatcagatatgtttctgaaccaggactcaaaaacaagttttataattgcaatatcttcttaagagctcggcgaaaatggttttcattttcttcttagattcttttaagaggtgccacattgtaaatgatcataatggcacaaaatgtgaattcatgtggaaaaaacaggcattaatgattctgaatacagaaaagctggattctgaagggaagaagtcttaactaatttacttcaaagtattttccttatgatgtatgaaaaagaatgataagataaaaatctatttaattaagaccaaaaacatctctgtaggtttaaaataaaatttgtacgtggtaagaaagcattgtgtcatggttacttatgggcattttttcttggttagtgatacataaaataatggtatatacaatcaatgctgtcttaggttcaattaaagatgatgtgactcctacatctactttatttcctagggcctttttttccaagtgatatgttccatccactgggagcaattttcagctggccagacaccttcccattatccccgaagcagtgtgattttatccttttacatgaacaatgcccttagggagaatgacaaagatactggctttctgaatggcaatatattggatggtcttatctataactttctcatttttcctatacaaatgttgggttctatttcttgaataagttctacagaactcatgattacagtttcataaaaaaaaagtgatccaaggtataataaaatatttttttaaccttgggttttcaatataactactcgaaatgactttaaatgctacacaaaatatatttttatattaaacaaatccacattaagaagatgaaaataatataaaatgattgcttaaaaaatatgggcataatgtccccatattacagattctggctccaagtttctaagtcatataatgggaatcatgtcttctggaatatttggtttaacggtgtgtagtgccagggctagaaaatgtgttaagttggtgaaacaactaccctttccctttttttagtatttctagagtgttaccctttggggctcccaccagtttggaacctgttttacttagagtgttttctaaaataaggcaccaaaatatgtgctagggctgcacatattcaaagtatgctgcagctctgggaagttgggcagattgaagtaaccttagggtccgtgaaccagacctccttcacagccacagcactgcaagagcttcctctcttcttgtaaaccaagctatcaaagataactgttacatacatgtatattcacctctgacacctacagccaaggaatgagatgagaacatgaaggaagaagttaggcgcaggaaaaataaagggtgttagtagtgtccagcttgtagaaagaactcaaattatgcctcagtccagtgagcactgaagaaaattcctcaagtttctctctgggcctcttgctttctagttccagctctctttccatagtcaaggttccaaaggcccacctcctctcctcatcaaatgctttttgcaaaaacagatctaaaatctcagatatacacatgacagataactgcttgaatttctcttaggaatcactaggtacttctaaatcactggagagtcaatctgaagtcagatgcatactccctgaatattagtctttcaggtatcactgggcaggaaggggagggaatggagagagattctgggccatgtgtgtaagagggagggcagcttgtctgagaatccaacaggaactcccttttttctaggcatcgtccagagattttggttacaatacttggaggtaaaattatatagagggtaatggttttctctttggcacatcaatcaactctgctctatgatcctataaacaggaaagagttgccaaatttgggcaccagaggaatccttggggctctcagcagtctcctcttcttaccacaatgcaaagcaaacaagagttgaaatgagaaaccagagggcaattagtgtcctttttttccttctcctctcatgtatccatttaggctttaatgcactttaaagaattcagaacactgagcaccaataaatgcttacttttcaagggaaaagaatccaagaatgtcaaatttggaggcctttgagatggtttagtccagatgtcagacatcattcatttagtaattatttacaaattcagtaattatttacaaataccaattatatgccagacactgttctgagaactagctacagatcagtgaaacaaaagaagaaaaaaaaaatccttgtcctgtccttgagatgagacaggtgcatgtaatatataataattaaagtatttagtatgctagatgtgctatggaaagagtacaggaaagctagggagatgaggagtaatgaggtgagagatggcagttgaaatctgaaataggatcatcaaggtaggcctttctgagaatgtgacatttgagaaaagagtgtgaggaaatgagcaagttagccatctggattatttgaaggggaggcaggggcaaagacagtccagacagtacacatatgtgctaagacaggagcgcctcacctgtgtaaggtttaaggacatttctatggctggagaaaaatgatcctggaggaaaggtgagagttaagagtagagtgaggggaagtggttggtggggccagatcacatgggccatgtagactcttgaaaggacttctgagggaaatagggagccactggaggattttgagcagagaagggatataacttgacttatactttacaggatcactctagctactctgtggagaacagattgtagagataagggtgctaccagggaggctactgtggttcccggcaaaggatgatggtgcctcaggacaggatagtaacacttaggaagacagagtatagagtgatagacgctggcccatgggtagatgtggtcatgggagtctgcggagagtctcttctgattgcttctattttctcagggagacaggaagcaaagcaagatcatcagctgacagtaagacacaggaggggaggcactggacatctgaatggggagaagaaggcttgactgaagtagctaagacagtggcagaggaaatggactagggaaatacagattgacttatgacatcatcaagtgcctactacttaatattgcctctgtatccacagctctcaaatctccaggcagcctctattgattgatctgagttggcagatgagttggcaggtgagagaatgtatatttgctagttctaatctaatctaattctgctttagtaaactgaggcctagacagtgccttttaaacatctatctatctttggggagggtttaaattatgaattaccaatcagctatggctccagtaaggaaaacatatacagtacctatttaaatatcatgtagcaagagggcctgacaactaatgctcttgggaattgatgctataagagaagggtatgaagagctgcagatgagtgcctgaaacaagagctttattaacacagcaggaagaagatacctgctggctggattttcactgaactcatagctctttgcatttgggctcaaggtcttaatcttctacaagtagtgacttcagtttctaaaggtttcaaggggatcatccagtgcttgtcttttgaatagactggcatgacttttaaacaggacccaaccaaatcacatttgatttcaagaaattgaagggataattaagaaagtgttagtcactactgaatgtagtgtatatgctttcttcggaattttaaggggggagaaaggcccattaagtcatcttaaaagggctcttgctgtaaaatgaaaggtggagaaggggtaaatctgaaatgcaaatgaatttcctgtttcaccagaaattcagtattatctaatgaatgctgagtaattgaagcacttattgtcatttctgcacccacactgggaaatggtttctgacctttagattccctactcttctgaattgcttctcatcagctctctctttattctcactcccactcagtttacttcttggaaggcctgttgacctttacctttttgtcatgtacagaatacagaatggttatgtatataaggtatcattaacatcataaggctacatgcaattataaaagaagatgagggataacttacacaggacatagtccttgctagattttatcaagaccctcattttctagtggtatatcacctttggaaaagccaggccattctgaagtaggtctttgtctttccagtctagaaataattgttatgtcaagttcagtgataaaatgaatggctgccattggctgaggacccactgtggggcatggagctagtgggcatctctccagtcatctcacaacaaccttgctcatctcttccttttaattattttactgtgcatactcatgagatctgaaactcatgtacgttggcacctttaacataactacactagttcttcctataaagttttctaatgatagtggaacttttaaattcagtttagtttttgacattttatttgtctttttgagaagccagtaggacttcaaaatgttgggcttttccaatagacagctaaaaatgtagacctgaagtttacaaaaatgattagagctaaaggtatagatgggaaagtcatcaatgctgaagtgatagtcattatgtggaaatttagcaaaggaaagatacttggaggcatgctaagtggttgaaaaaggcatcttggaagattttcatgtttaggtggtgggaagagaaacacaagccagaaaagaatccctcagggacaatgagaaaagcagagcagcagaccctgtgaagttatggaagtgaaatgaatggatcctgaaggtatttcaaatggtttggactatcagggccaaaaaagaacttctggaaatctggacttggacaaaatcagtcatccttaaggggctggattcagcaaagaggtagatgaaaaacccaggttctagggtcctcttttatttcatgggagtgatacagaatccggatcactttagaaataaagcaaaataatttttctgaagatgtgaacagtgaagtgatgtgtctgtcacacactaaaaacataaaagatgatgcatgaataaaatagggaacagcatcactagttaatgcccacataatatcataattctatacctaatccaaatttgatgaacaaaatatatttagagcataaataaaacattttcaattgttcataatatattctccaatgcactgtatttgtcttggtttgaaaaatccataaagattttatgtaatttaaataagcaatgaagagaggaagaggaggaaaaggatttcaatatggcccagagagagagacagagaaagagacataaatcccagttaatctaagggaagacttttaagtcatagttcctcattctggcgacttatctgttacttatttccaggtgctaaacagaagagatgcaatatcttttttttttttttttttcctgagacaagtctcgctttgtcgacaggctggaatgcagtggtgcgatcttggctcactgcaacctctgcctcccgggttcaagcgattctcctgcctcagcctcccatgtagctgggactacaggtgtatgccaccatacccagctaatttttgtatttttagtagagacggggcttcgccatgttggccaggatggtctgtatctcctgaccttgcaacgtgtctgtgtggtcctcccaaactcctgggattacagatgtgagccaccatgcctggccgagatgcaatatcttgaaggcatcagggatcctgttgtttctcttcagatctataaatctgctgccttctgaaggcattaggagcacctcaaagaaagcaagatggagcattaacaagtgaagactcttcttcttttcttttctttcttcttgcttgctcttttctctttctgcatcaacaatttcaaattcttgggcagagtattgcttgaactcagagttcctgtttgtgcaacagtgctgccttctgctatcagccacatgtagacttagttgaggagtcctatgtgtagattcataaatttagggcaacaaagcatgtgtgtgtaggggggttgggcaagagagctaaggctaagtcagggccagaagttgcctgtaagtagctctgtaaagcacccatgtctgatttgtggaggtgacatcatcattagctgcagatcaatactgaccagaatttaaggtactatgccatagctttaagtcttcataatttaaagatgactaagttgtctcttctctgtaggtctctactttgagttagatgacttcagaaatgatcacacatttcatgtcaaatttccaggcctcaaattcctgttcccagtgatatgagtacccacagataattcactggtaagatcaccgagtgacccaggaatgaaacctaccattgaagatgtttatttagagctgtatccactgtccacagccaagggaaatagccttttctagactggatatatttgaccagtagatggagtaagtggatcccagaaccaccaactaaccacccagaacctgctgatcaatgctgttgtctttcaatattctatcaaaaagggacaatgccatcaccagcaactaaatcttgagcttaaggtgcatcttcggcaggtgaatgtcatgtgtgacagttgctcatggatgaatgaataaccgaaaggggcaccagcagtagcaaagtactaagatactgaggaaacttggggtacttaaccaaagtcccttcatttcttcacaattatgcttaacaccaaccagcccagcatctgacaaacaatcccaaggacattttttcccccgtcatctcaaatattttttcaaaagtgatcattttactctgtgttttggtagaaggggcgaagtccactttgcagctggtacaacagaaactagagctgcatcaattctctcacactgccaagcctttcttctggcagaagcgctggggatattacactggggataattcatcaagcttgctttgggtgttccaaatttgcaagctgtggctaatttccagagacttcagggcaataatctctgctttcctaaaagaaaaacagtaaccacaccacctttcaattaaatgggtcatggaaaatgaatagccacagatgatcacagatattcagaaatcctcagaaaacctaagtgtgtagccagtggtagaaatgatgactgtgtggctgaagaagtcccatttgatgagggctaggaatctggcatctgcgtctgcctccacatttgtttctccccatacattttccatgtatgaatatgcacacacatgcacatgtgaagcctcacatgttcaagaccaaaacatattgctggatattaacaaaaggaattatagcctcttcagctatgaatcaggtgaagttttcctcacagtctctggagtctgctttgcccacagaaaagcagacttccttcccaggtcagtaagccatgctggagagttgccctcaaccccgcaactctccccaaatatatctgctgtcttttatgctttccaggccccgtgttcagaagttgtttagcagatcatttctttgtacactatctttttttttttttttcctcttttctgagatggagtcttacactgtctcctgggctggagtgcaatggcgcaatcttggctcactgcaacctccgcctcctaggttcaagtattctcctgcctccgcctcccgagtagctgggattacaggtgcccaacaccacacctggctaattttttttttttgtatttttagtagacacggggtttcgccaggctggtctcgaactcctgacttcctgatccgcctgccttggcctcccaaagtgctgggattacaggcgtgagccactgcatccggcctgtttgtttgtatattatcttaactcatataatggatcagtatttttttgagaatttccaggccaacattcagaagaataacatatggtaggcattttaagcaattaatggataaaggaagggatatttgagggctgtctcatcccaaactaccttagttttttactctggattttcctttctatggatatgtcaatgattttaccggatcaattctcatggagcagtggactagtttgggatggtccctactttcaatttcaggaacactgtaaagtcaaacagaaccttatgagttttatatttgctagttctttttgtgctatgtatttattatatgtgtaatttaatagtttcaattcttttctctgctaaagtatttatgagttgtagcacagagaaagagctcaatatatgctaattattattattaatattattatctttagagataggatcttactctgtctcaggctggggtgaagtggtgtgttcatggctcactgcaaccttgaactcctggactcaagctatcttcctgcttcagctttcctagtagccgggtctaaaggtacacactgctatgcccaactaattttttaaaaaatgttatgtagaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcacggtggcgggcgcctgtagtcccagctactcgggaggctgaggcaggagaatggcgtgaacccgggaagcggagcttgcagtgagccgagattgtgccactgcagtccgcagtccggcctgggcgacaaagcgagactccgtctcaaaaaaaaaaaaaaaaaaaaaaaaaaaagttatgtaaagacaaggtcttgctttgttgcccaggctggtcttgaactcctggcttcaagcaatcctcctgtatcaatgtagtgttggcattacaggtctgagccactgtgcttggcctatgttagctactattattattattaccttataattgctaaagccatctacctgaaaatctattccaatcattccatagttctcagctccaaaaccagtggagatttgttttttcataatcctaccaaactcctctgcactggtgtcatatctgacaaaatacccagaattaattgccaatgggtgatcatgggttgacatataagccttcccagtgtatgcttttttttttttacaattttttaaaaattttactttaaactctgggatacatgtgcagaacgtgcaagtttgttacataggtatacgtgtgccatggtggtttgctgcacctgttgacccatcctctaagtttcctcccctcaacacccacccaccgacaggccctggtgtgtggtgttccccctccctgtgtccatgtgttctcaatgttcaactcccccttatgagtgagaacatgtggtgtttggttttctgttcctgagttagtttgctgaagatgatggcttccagcttcatccatgtccttgcaaaggacatgatctcattcttttcatggttgcagagtattccatggtgtatatgtaccacattttctttatctagtctatcattgatgggcatttgtattggctccatgactgctattggaaatagtacttcaataaacatacatgtgcatgtgtctttatagtagaatgatttatattcctttgagtgtataccctgtaatgggattgcttgatcaaatggtatttctgattctagatccttgaggaatcgccacactgtcttccacaatggctgaactaatttaaattcccatcaacagtgtaaatgcattcctatttctccattgtgtcgccagtctctattgtttcttgactttttaataattgccactctgaatggcatgagatggaatctcactgtggttttgatttgcatttctctaatgaccagtgatgttgggcttcttttcatatttttgttggctgcatgaatgtcttctttaggaagtgtctgttcagatccttcgcccactttttgatggggttatttttttcttgtaaatttgtttacaatctttgtagattctggatattagatctttgtcagatggatggatcgcaaaaattttctcccattctgtaggttgcctgttcactctgaggatagtttcttttgctatgccgaagctttttagtttaattggatcccatttctcaattttgacttttgttgccattgcttttggtgttttcgtcatgaagtctttgcccatgcctagatattgcctaggttttcttttagggtttttatggtttggggttttacattaaagtcttgaatccatcttgagttgatttttgtataaggtgtaaggaagtggtccagtttcagttttctgcatatggctaaccagtttttctaccaccatttattgaataggatatcatttccccattgcttgtttctgtcaggtttgtcaaagatctgatggttgtagatgtgtggtgttatttctgaggtctctgttttgttccattggtttatatatctgttttggtaccagtaccatgctgttttgattactgtaggcttgtagtataatttgaagtcaggtgcatgttatttcttgacctgaatctttcctttgggcttcagtttttattaggcttttcctttgtcctgtatagtttcttggatgcttctcttctctacactcaaggttttctttctgttgttgttgtgtaggcaacacaatagatgtcatcttttgggaggcttcctaatgctgcttttggtgttcttgtgagctcagaggattcctactttagagtgaactgtaatgtcaacctctaccctagacaatgagtaggaaccatattcaatagaataagaaggtgaggctttgctaaaattatcccatctgtcagtctgtgaaaccagtagtttgaagattgtaatcacaacattgacacacataatgttaatttcaagcagttacataacttaattgataagtcaatctaaatcatacctgcatggcaacagaactagggttagaaagtgaaaaatattgttaagtaaccatatacttctcttagatttgatctggcagcagacatttctgtattctgagataaaatagctgtggtaaacagattgtgtgaaggcatgcatttgcatccaggcctacaggaccaatattaagagaaagggaacaattaatttgtctcagtggggtagtaaagagacacagccttcagagtactatgggaggttatatttcaacttcttacagttagtttgtaaatctaactgtaagactggcattgttattaatgaaagtttcagctaagaatgaattagatctaagttacactttatcagtatttattcttcctgctacctattaagggcacctgaactgctaggcttacataaaaatgtcccatttcctgttgctagctgtgctttcctttgataaactcattacaaattgcatgtaattactgtattgtgaagaagggagtggcaataaattaggcacagaatttttgaataaaactaggcagctagaaagactgtttctaaataacaaaaaatttgatatgaccaagtaggttaaaattaccattacatatttgattggtacaaaattaattgtggtttttacaattactttttaacattttgccgctacttttactattttgccattacttttaatatggcccatttttaatggcaaaatctgcaattaattttgcaccaacctaatattatcgtatatggaattttctgtatataaagcaaagggaaaaaaaaggaggcatatagaccttagcttatgtactttatgattataaatgattacatttatctagtgaccataatgctttatgaaagatgaaaacattcttctgggggaaaaaaaaaaaactaattaacatccttgcttgcagagattggtagacctgtttcttctattttagatttcagcaggacacctctatcgttggatgaaaaatgctgacttgcatgttctgggaatctgggctcaccccgaggctaatagcacagtgccctggctgtgtgcccaacgtttgtggcagggagttacccctgagtgctttttttaacttacactaaagttttgacttagaaagcaatattagctagtgcttcacaggaaactgggctttccctctgtaacactcaaagtcaaatcctatttcttggtctgatataatctccataatcataaagatctttgttggagaagttaagcagggaagactacatgtaggattctcctaatcttggggaacccaagttttgtgcccctttcaattgggatgctggagcggagttgggtcatggagattaatctttagaggtgtgtgttcatagaggagaaaccattgagaacaaggaaaaaggaaaagtggagaagcacagctcttgtttgaccttggaggctttttacatggaattaaaattcagaaactggctgaggttacaaggagtaattgtggcaattgcctcatccctactgtcagcacatggcaaagtttgctatggacagaattgcagggagttctttcaaaacagttcaaaatattgtcaagattttcttcaatttctcatcaacctttaagagctcattgaagacattagatattttgtgcccaactcaatgttgcagagaatttcagggcaagagaaatagaaatgaagttgaaatatacccatgtagtttccttcagcgatactatctggtatataagaaaacttacaaacattttttaagaggcctcaggcattacaattataagtttttttcttctcttcagacttttattctaataagttgttagccaatcaaacaagcaaaggtgttttaaaatacttcagtttatagcaataatgatttttaagtttgagaaatagaaaagaatcaaatcagtatcttaattagcaaaacctagttgatgagagagatgtgctttgtttgctatgcatgagattgcttgaaaaatgtgatttagctccaacagagcctccctactataggattttttttttttttttttttttttttttagaaaatcaatacatctttctgtcaaaatttggttagggcaaaatttgactaaaattgtgccaaataaataagatttttttcttatctgagattgatacatctctatttcttatgtataattttttatctcaggccaatgagcccaaagtttcttggctcttgttatatctttgaacctgtgacctttcaactggctagcaatgggcatgaaaaggagaataattgttgctgaaacaaaataggcttttttttttttttgaggaaaaagaagaaagagaaagagacaaaggaaaaggagaaagacaagagaggaagaagcaggaggaaaacagtggagagaagaagaaaaaagagaaaaaataaattacagctatctgggcttccatgggagtgccaactctgacagctgagacatctctgacttggctctttcacctcttgtgcaagggaagaacagcactatttttaaaggaggtcattagtgagtcatgtttaagctcaatgcttagccatcatcgccatttgggtgcttgttgggaaggtcctaaattgagcggcctttgggcacagatctctgtgcactttgtttgccacttgctggctagctgatctggagactagttgaattttgcagtttttctgttttattttcctgacaaagcagtcgttccattaagaaaaaagcactcagctattaatttctgctaactcctaacctggtcaatgaattataagaatgtgcagttttatgtctattttagggcatggatgtgggggtggtgaaaagtcttcttggcttggagctctctctatttgtctcgctctttctagttcttttttgttcatccttttcctgacaggctgcttgatgcttacagaatgatgcaagattgtaacagattcagactagatgaggaagagaaagagcttagtaaaagcccacttcttaatagttgaatttttttttcttcaaaaaaaaagtcctatcaaccaaaaaaaagctcaggaccagacagattcatagccaaattctgccagaggtacaaagaggagctggtaccatcacttctgaaactcttccaaacaacagaaaaagagggacttctccctaactcattttatgaggccagcatcatcctgataccaaaacctggcagagacacaacaacaacaaaaaagaaaatttcaggccaatatccctgatgaacatcgatgtgaaaatcctcaataaaatactggcaacctgaatccagcagcacatcaaaaaccttatccaccatgatcaagtgagcttcatccctgggatgcaagggtggttcaacatatgcaaatcaataaacataatacaacacataaacagaaccaatggcaaaaaccacatgattatctcaatagatgcagaaaaggccttcagtaaaattcaacaccccttcatgctaaaacctctcaataaactaggtattgatagaacgtatttcaaaataataagagctatctatgacaaacccacagccactatcatactgaatgggcaaaacctggaagcattccctttgaaaactggcacaagacaaggatgccctctctcaccactcctattcaacatagtattggaagttctggccagggcagtcaggcaagagaaagaaataaagggtatttgaataggaagagaggaagtcaatttgtctctgtttgcagatgacatgattgtatatttagaaaaccccaacgtttcatctccttaagctgataagcaacttcagcaaagtctctggatacaaaatcaatgtgcaaaaatcacaagtcttcctatacagcaataatagacaatcagagagccaaatcatgagtgaactcccattcacaattgctacaaagagaataaaatacctagaaatacagcttacaagggatgtgaaggacctcttcaaggagaactccactgctcaaggaaataagagaggacacaaacaaatggaaaagcattccatgctcatggataggaagaatcaatatcatttaaatggccatactgcccaaagtaatttatagattcaatgctatccccatcaagctaccattgactttcatcacagaattagaaaaagctactgtaaatttcatatggaactaaaaaagagcctgtgtagccaagacaatcctaagcagaaagaacaaagctggaggcatcacactacctgatttcaaactatagtacaaggctacagtaacaaaaacagcatggtactggtaccaaattagatatatatatatataccagtggaacagaacagaggcctcagaaataataccacatatctacaaccatctgatctttgacaaacctgaccaaaacaagcaatggggaaacgactccctacttaataaatggtgttgggaaaactggctagccatacgcagaaaactgaaactggaccacttccttataccttatacaaaaattaactcaagatggattaaagacttcagcataagacctaaaaccataaaaaccctagaagaaaacctaggcaataccattcaggacataggcatgggcaaagacttcatgactaaaacactaaaagcaatggcaacaaaagccaaaattgacaaatgggatctgattaaactgaaaagcttctgcacagcaaaagaaactatcagagtgaacaggcaacctagagaatgggaaaaataactgcaatctatccatctgacaaagggctaatatccagaatctacaaagaactttaacaaatttacaagaaaaaaacagccccatcaaaaagtgggcaaaggatatgaacagacacctcttaaagaaaacatttatgtggccaataaacatatgaaaaaaagctcatcatcacttgtcattagagaaatgcaaatcaaagccacaatgagataccatctcatgccagttagaatggtgatcattaaaaagtcagggaacaacagatgctagagaggatgtgaagaaataggaacccttttacacttttgttgggagtataaattagttcaaccattgtggaaaaaagtgtggcgattcctcaaggatctagaactagaaatgtcatttgacctagcaatcccattactggttatatatccaaaggattataaatcatgctactagaaagacacatgtacatgtatgtttattgcagcagtattcacaacagcagagttggaacgaacccaaatgcccatcaatgatagactggataaagaaaatgtggcacatatacaccatggaatactatgcagccataaaaaaggatgagttcatgttctttgcagggacatggatgaagttggaaaccaccattctcagcaaactaacacaggaacagaaaaccaaacaccacatgttctcactcataagtgggagttgaacaatgagaacacatggacacagggaggggaacatcacacaccagggcctgtcagggggtggggagctaaaggagggatagcagtaggaggcatacctaatgcagatgacgggttgatgggtacagcaaaccgtcatggcacgtgtattcctatgtaatgaacttgcactttctgcacatgtatcccagaacttaaagtatatattaaaaaaaagtctgagtgtcttaagtattagtcattgctatttggatggtttcttttccagggaaaatattaaaactgtcttgtacctctctattccttttctttctccctaggttttggaaatcactagtgggtaaaaaagaccaatttgcaactaggctctcatgctctgttgaaaactatgtcacaatatcacaatactagatgctgggctcaagacagcaaacagaaagcagtaagttacacatataaatgacaaatatctgattcacttcaattaagtaactatttttttttaatcacaagaactgctttttcccgaatctgttggattgtcagtgtattagaagtgagcatgttctaatttataataggagaagttggagaggatgagcaagaggtttgccccatttctgtaaccatcagagacaaagcaggaggagcctccaaaaattagagcagaccttgccctaaaatgacataagtagctatttaagtgatgtgggcccagcatggtatagccataaatacatccaccacaactgtattaaaaggcctggaatgttcgcttcgtagggactcatacatgatgttgctcggcagtgaaatgatagctaattgtctagtgcggtggattactgtagccaatcacttagcaccatactcttttaattgaatagcaaacgtataggcttgggatgagatgaggctgtctagtatgggttggcatcctggggaggtctgaaaagacagaggcccgattaaaaggcttcaggaggcagagtcagagaggccaacagtgtactttgtctctcataagatttgcttggaatctgctcaacgctaaaagcccctatttagaactggaggttcccaagagatacatttccatcattttgtgagaaaagaggcagaatacgagggagataacacagacgtcatagctggagaataagaatgatttaatgtgttcttggcactgtgctaagtggcttgaggttcacacacctcatctgatccatggttaccatggctgtgcagctccatcatccacggaaatgaaaaaaatacataattgcctacctgtttcaacccatcacccactagacaaactgattgcttaggctttgagttagagctaggcaagtgatatttttaaagctgcacaagtgattctgaattattatcaggcataaaatttgcttattttttacaactcctcaaacaggaatattgcctcatcttctgcagaagatgagttgcaatctatccatctgacaaaggtctaatatccagaatctacaaacaacttaaacaaatttacaaggaaaaaacaaccccatcaaaaagtgagtgaaggatatgaacagaaacttattaccaggcttgagatgtgcttaatttttacaactcctgaagtaggaatactgactcatcttctgcagaaggcgagagtaaagttcatgtttgactgatggagagctagaacctgggcctatcatttctggtttcttggtttttccatttaagacaacagcttccctgaaggtttgaagtcttaggttttgagtaggtaactataggacttccaactgtatcccactttatcctctgagtgattggtccaaaagaaaacaaggaatctacttactgtcagcaggatatacagaaaacagcataggaattcacataccagtggctttaattatggctagttgtgtgactgtgggcatacgaccttgctaagctttcatttccctatttgtatagtggaaatgataaaatgataaacagtatctcaaatttaatttgaatattcaataaggaagtatacataaggtatttaaaatagtatttggcacacagtgggtacccatctatgtgctagttcttgttaccatattaatggctactaatagttttctcttggctagacaatggcatttgtcctattctcttctttttttctttaaacaaaagaatgtggtgactggagagaaggcactagaggtgggacggagttaaagactataatgaatcttgcagaatctctcttgcacccagtaaaaggtgcctaatttctgtgtaaagggctcacgatggaaatcaggttaaaacaaggaacttaatcttaaagccgcgcttgcctatgtctgttaaatcctttattttttcttagacagtgttccagtgggagttggggtggctgatggagacagatggggaggtgaaagcccctcccaaagttgccttttggtgacaccacaacttaagcatcacactttaccttggcctcacttggataaacagattcctctggtgtaattttgtgagctgccagacacagacaagtatgtttatcacttgaatggcaagcttcagcgttagagttgctctatttatacactgctttgcagacaatcctgatgcttttacataattggtgagctccactagcttagcaggcaagtaaataagatggtaaacaatactcttttttctgcacaggcttgtgatgaattctcaagccagctttgcttgcaattagtctggataacttacatattttacattacatgagatgacagttggttttattgcttttcccctaaaagtcgggccttgctgtgacagctacttcacaagcacaggggagcctgctgggcaatgggaagggcaaaggatggcaaattggtctggttccattattgcaatgtaattactcaaacttagccttgctggatttgtgcaacttctctgtaattacataatgatccaaggctcaagagaggctggaggtttggatgcattgcatggcatgtatattcattgtgctgcaaacttccatgacttctagggtaggcattgtggtccgtaagaaattataatgaaggcttggaaatgtatagactgcatgcaggaatcatgcatctgccaaggcacagggaaagtctagaatgccaaggcacttgagaataatctggtttctgtacacagatcttgcctctaaatccttgctctacaaaggagtcaactacagtcactcaggattctggaaagggtctagattcttccaccttgcttccctccactctagaggcagaagagaagagccaacagtgtaggtattaagacagacttacattttgtttccttcagagatgaagtggaagcatctttgactaatgtgtacacacttgaatgtccataagagaagcaaatgcaggcatccaactgctaatgaatgatctaaaagattacttggtagcttttagtataatcctgaaattagttaatggaagtgccactaatgagcatctattaatagaaggcaagtgtagtaacactgctaatgtaatggcctggagctataataaaacatgtgaacaaaacacatctaatactgttctatgttaaaatagctctcttgaaaaacacagagctagaaaatgatcacaactaagagacattttaacaacagggacattacttgatgggactcaccatcaagttttaaatggggtagtggacagtaatacttccagaccctctttccccaggggattttcttgattattctggctgggtatcaaaagttctgatcttttcttagaactctttatataacaaggaactaatatttaaaattcaacatttaagtttgtacttctttatggttctttgttttgtgagttaatatagtctccacagcaaaattatttccaacctgaaaacaggggacctatctatctgtaatagaatatcttccctactgtttttctttctcaccactccagcttgagattgaatgagtaccacactctgtgatctcacagagtgttctgttttcctttctttataccctagtcatagcatatgcaaataaccacatcctttgcagggacacgggatagctggaggccattatccttagcaaactgacacaggaaccgaaaaccaaatacgacgtgttctgacttacaagtgggagctaaatgatgagaacacatgaacacagagggaaacaacacatactggggtcttttggagggtgggaagagggagagcatcaggaaaaaaattgatactaggcttaatacctaggtgatgaaataatctgtacaacaaacccccatgacacaagtttatctatgtaacaaacctgcatttgtacccctaaacttaaaagtttaataataataataataaatctccttgatgaggttctttggaattaggggttctgcctttttgtctctagtcatatgcccaggactaaggcactgaacaatgacagcacggtgctatatatgaccaacaagttagttgtgttgtttagattcagtttgttcctgtatcttaggagaaactcagagaataatgagctactccctgtcttcaaagggcttcaagtctagaaatggttattacccatgttttacatacgtaaaattcagatcatgctgatgaatgaatacccacaagtggaaatgtaatgagaatattcataacgtgggcttaaatttacttttctcttttctaatgcaattatttatttaattaaaaaaccatttgtcttgaggactgcctttcatcagtgcaagtgttgacaaattcctgttcactgctatggaatacagaatgatgaaagtcagtcatcccatatattttcattgcagtgtaaaggttacccaagctttgacatcatatacataatatttttccctgcctgcagcagacattagctgtaagtatgcctatgcaaagatcacatacacaccacaagaatcaaatatgcttatgtaagaattcttatacttaaagcagtatagatagatttagtcttcatgtttatggctacatgatgtggaaaaggctgcggaaatgctgctgtctacattggcatgacattggaattaaagccaactggaggcagctgcagctgtctacgaaacaaatctggggaattcaacagtagaagccaacggctgcagccaaaatcccacagtggaaaaagccctgctgtgggacctggcattggcagtcatgtgttggcatcactgaacttcatttaatgaaagacccccaggtcttcactgtgggccaactccattactgccatattctagtcctcattaaaggtttgggtggcagggagcttttctatgcagatatctgctgccatctatgttgaacgcagaaatggtaggcgagcctcaaagcagtttaaaatccacctgttttgatgcataaatagtcaagtaactagacttgatcaccaatccaaggtgaggtgtcaggggtggaggagggtggaaaaaagctatacctattgttagagaaatttgcagaatgttttgattatatggaagttattcactttacagttccttttgcaaattacatattttactaaattgtctccttttattaaccataagaaaggaaaagcaagcataatcttttcatatactcaagccatcattatggttaatttcataatggtttacatgcagtgccaaaatgttcacatgctagcaaattatttttattttatacataatctaataaccataaccataaagctgaaatgatttctagctttcattttgaccatgtccctaaaagctgtttacctggctgctgatcacatgtaaactgaattggttccttaacaaagggatgaaaattgagtggaagaggtatcaattagagaaactgaatggctcatgaccctactaagttgcaagaatactattttcacaattgtaatgataaaaaataaaaaaatgaaaatgccactgttcaacagaaatatattttcctataaataaatatatttgtaattacagataccaatcacaacttgggcattaattaaacagagaaaacacttaaaaaaaatctgttgttagagaatctccttaatttttttcaaagctgaatagaacttgtccttgcattaaactctcttctgtgttatctgtgcagctgcaaaactttattcattcagtcagtcaaaagttgatattgtttgcaagactctccaatggcaaatctcctaaataagtccttacagctcttcatattttcacaacaccacatcagtgtcattaatgtgcatcatctccacgttccatcctttcctggaaaggttcattatgatcctccaaacataacctaacaactatacttttctagagtgcttctggaactagccaggcaaaattcgtgtgctgtatcttatatcttactttttgccttcctgtattgtgtgcttggttctttaaaaaacagttatgcacatgtaaaaaaagtattaggcaaaagtatgcaggttaaagatatgtacacctaagtctagttactgatgattatagcaatagcaaaagataaataagttcatatcttttttgatggaatcacatatcttttatgttgttattgttctatgaaaaatcttagagatcaactaaaccaaaactcttattattcaaatttgaaactgtagtccagaaagaagaactgattggttacaagttccagagctggcatcatcagagctagggctgcaatccatctctagatccccacttgggagctttttcttaggctccacgctgaaagacaagccatcctatgataagtactgaattataggaaggtctcgctagtccagaaacattacaggttactctaaagattctagttttgctagatgtgtcttgtcttcccctacttttgtttatagaaatccttggctccaaataaagcctgtgacacataagcttcttgctgttatcacttttttcatccctttaacacttcctggaatgctgttaccttcactacctcattctaattccatcagtgcttctttataagcagcccacaggatggctttcattataacagccacacattgcaccttggctcaagtgagaaatgctgcttagatccacaaggtaaaacaaaataaacagttgccttcacctgtttcacaatcttcattctacatcaactcttaatcactataaaggatacacatgataggcgtgtgcaaattagaaatggttcaaagaataaaaatgctactatgtgatcagtttttctttaaaattataattaattatcatttagaattaatgaacatatatggatattcatgtaaaatttaatgcaaaatgttgtaagcaaatccagttctgctctataccatatttacttacagcttacaagaacaaaaaataaatgtactttcataaacagattactatgatggttctgttcactctacatttaaaacagccactttgtcattttttgaaaacttgcctcatatgggagggagttctccacatgcagatgtctgctgccatctatgtggaaagcagaaatagtgggtgtggtttgaaacaagtctcttttgtgtgatgcacaaatactcaagtgtccagactttatcatcaaaccgagtggtaagttggaaatgaagcccaatttttagtgacctgccacctctcctaggccttgcttgattctctgaacgggactcatagcttctacattctccctggcctgctttgccttagggcataagataaggaatgctcagtttccagaagactgagaaatgccacttctacaagagaggtgctggttcttggcacagttgctttctgagctgaaaaaaagtgccatgacatgtacagaactacaatggagttaaattctgaagagtgtaatatatgtatgcacatatattagacacgggaaatgtgcatatgtaagaaatggaaaatgttcattggacttatggcattcacatctaattggggatatacctgatccacatctacaggtctttagggttgctcaggatttcaaatcttcccatttaatctttataggtgatactttggagggtggctgcccatttctctctaaatggctatatctagtcccccacttttcacactcttttttttattttctttgagtctcagttgaactattcattcttgtcttccagaactcacttcaaatgggttttccatctatcatgagtctagtgttctcacctttgtcttacaattaattcttctgcagatcccctcacactgatctcctcccctgagctttggacaattatattctctcatctctttcacataaatcgcacttggaagacaaactcctcaggttaagctgccatctggtgtgtgtatttttcatcaagaactagcaacacccacatcaatagcatccacctttaccatcacctatataagcaacttactttgggaacctatttccttatttcagcattctcatttgaatcaatctagcctaggttagggacactggaaccaaacttggctgtccctggactggcctgggatacctataatataggagggactcgacgaggaactggaggtgtgagagcaaataggaataagatacagtttctgagatgaagaatctaataaaatccaatagaatggggctgtgtcctaagatgaagcaggccaggaagattttagcaggaaatgggtccagttcaaaaaatcaagcaaggcttgggagaggtggtagatcactgaaggtcaaagcacaaaggatcaggatctagtaaacgggctttggaaacggaaaaccttaggagaccctgaacatttcaaaaagacatttgtgctctaccttctttcaaactcttaactctgggcacctacactgtagagatgtaacagaaggcagaagaaatcaggggcatacaggtaggtgtgtcatcttttggttggcacatagatgttctgattacagacagattgtattattttaagagagatggggcatgtgaatatggtgcaagttattttttttttgtcttcagtttttttttcaagggatagcaaggtttatatagagtggtgtgcctttcgaatggcctctatttacacaaagagattggggattaggggaggatagggaagggaatttaaccttacatcctcacattgaatggcctttgtggaagcagtcctaataattttccattactgtccaactttgtattctgtttttttttttttttatatactttaagttttagggtacatgtgcacattgtgcaggttagttacatacgtatacatgtgccatgctggtgtgctgcacccactaactcgtcatctagcattaggtatatctcccagtgctatccctccccccccgccaccccacaacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatccttttttatggctgcatagtattccatggtgtatatgtgccacattttcttaatccagtctatcattgttggacatttgggttggttccaagtctttgctatcgtgaataatgctgcagtaaacatacgtgtgcatgtgtctttatagcagcatgatttatagtcctttgggtatatacccagtaatgggatggctgggtcaaatggtgtttccagttctagatccctgaggaatggccacactgacttccacaatggttgaactagtttacagtcccaccaacagtgtaaaagtgttcctatttctccacatcctctccagctcctgttgtttcctgactttttaatgatcaccattctaactggtgtgagatggtatctcatggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattctgtaggttgcctgttctctctgacggtagtttcttttcctgtgcagaagctctttattttaattagttcccatttgtcaattttggcttttgttgtcattgcttttggtgttttagacatgaagtctttgcccatgcctatgtcctgaatggtaatgcctaggttttcttctagggtttttatggttttaggtctaacgtttaagtctttaatccatcttgaactgatttttgtataaggtgtcaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtatcagtaccatgctgttttggttactgtagccttgtagtatatagtttgaagtcaggtagcgtgatgcctccagctttgttcttttggcttaggactgacttggtgatgcaggctcttttttggttccatatgaactttaaagtacttttttccaattctgtgaagagaggcattggtggcttgatggggatggcattgaatctgtaaattaccttgggcagtatggccattttcatgatattgattcttcctacccatgagcatggaatgttcttccatttgtttgtttcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtgtaagaatgcttgtgattttggtacattgattttgtatcctgagactttgctgaagttgcttatcagcttaaggagattttgggctgagacaatggggttttctagatatacaatcatgtcttctgcaaaaagggacaatttgacttcctcttttcctaattgaataccctttatttccttctcctgcctaattgccctggccagaacttccaacaatatgttgaataggagtggtgagagagggcatccctgtcttgtgccagttttcaaagggaatgcttccagtttttgcccattcagtatgatagtggctgtgggtttgtcatagatagctcttattattttgaaatacgtcccatcaatacctaatttattgagagttcttagcatgaagggttgttgaattttgtcaaaggctttttctgcatctattgagataatcatgtggtttttgtctttggctctgtttatatgctggattatatttattgatttgcgtatattgaaccagccttgcatcccagggatgaagcccacttgatcatggtggataagctttttgatgtgctgctggattcgttttgccagtattttattgaggatttttcatcaatgttcatcaaggatattggtctaaaattctcttttttggttgtgtctctgcttggctttggtatcagaatgatgctggcttcataaaatgagttagggaggattccctctttttctattgattggaatagtttcagaaggaatggtaccagttcctccttgtacctctggtagaatttggctgtgaatccatctggtcctggactctttttggttggtaagctattaattattgccacaatttcagatcctgttgttggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgcgtctatttgagtcttctctctttttttctttattagtcttgctagtggtctatcaattttgttgatcctttcaaaaaaccagctcctggattcattaattttttgaagggtttttggtgtctctatttccttcagttctgctctgattttagttatttcttgccttctgctagcttttgaatgtgtttgctcttgcttttctagttcttttaatggtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgaggggttttgagtgagattcttaatcctgagttctagtttgattgcactgtggtctgagagatagtttgttataatttctgttcttttacatttgctgaggagagctttacttccaagtatgtggtcaattttggaagaggtgtggtgtggtgctgaaaaaaatgtatattctgttgatttggggtggacagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgaaggtcactcaggacttgctttatgaatctgggtgctcctgtattgggtgcatatatatttaggatagttagctcttcttgttgaattgatctctttaccattatgtaatggccttctttgtctcttttgatctttgttggtttaaggtctgttttatcagagactaggattgcaaaccctgcctttttttgttttccatttgtttggcagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacaatttggcatgattttgcagccgctggtactggttgttccttcccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaacattggcccccactctcttctggcttgtagggtttctgccgagagatccgctgttagtctgatgggcttccctttgagggtaacccgacctttctctctggttgcccttaacattttttttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagcttgttttccaacttggttccattgtccccatcgctttcaggtacaccaatcagacgtagatttggtcttttcacatagtcccatatttcttggaggctttgctcatttctttttattcttttttctctaaacttcccttctcacttcatttcattcatttcatcttccattgctgacaccctttcttccagttgattgcatcagctcctgaggcttctgcattcttcacgtagttcttgagccttggttttcagctccatcagctactttaagcatttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttccgttgctggtgaggaactgtgttcctttggaggaggagaggcgctctgctttttagagtttccagtttttctgttctgttttttccccatctttgtggttttatctacttttggtctttgatgatggtgatgtacagatgggtttttggtgtggacgtcctttctgtttgttagttttccttctaacagacaggaccctcagctgcaggtctgttggaataccctgccatgggaggtgtcagtgtgcccctgctggggggtgcctcccagttaggctgctcgggggtcaggggtcagggacccacttggggaggcagtctgcccgttctcagatctccagctgcgtgctgggagaaccactgctctcttcaaagctgtcagacagggacatttaagtctgcaaaagttactgctgtctttttgtttgtctgtgccctgcccccagaggtggagcctacagaggcaggcaggcctccttgagctgtggtggactccacccagttcgagcttcccggctgctttgtttacctaatcaagcctgggcaatggcgggcgcccctcccccagcctcgctgccgccttgcagtttgatctcagactgctgtgctagcaatcagtgagactccgtgggcgtaggaccctcccagccaggtgcgggatataatctcgtggtgggccgttttttaagcccgttggaaaagcgcagtattcgggtgggagtgacccgattttccaggtgctgtccgtcacccctttctttgactcggaagggaaactccctgaccccttgcacttcccaagtgaggcaatgctcgccctgcttcggctcgcacacggtgcgcgcacccactgacctgtgcccactgtctggcactccctagtgagatgaacccagtacctcagatggaaatgcagaaatcgcccgtcttctgcgtcgctcacgctgggagctgtagaccggagctgttcctattcggccatcttggctcctcgatcgtcttctgtttcttactggcaatattccccaagctagagctatgcaatcagtcttctatattccttaaatctgtatagtctattgtaaagttaagtatgagtttctattatataaattaactcaagtattgttcagagattttacttatataaattttttttcatctggaggaaattaatgtatatcattatatatagaagccattttctcctgaaagtaacaatgtaggtactttgatgttatttgcagtgaaatttacctttacagggataactgcagtaaccttttaaatgaacatatgtatatatgtgaacttgcacctgttattgttgtcatggaaacagttccaaaacataagatacaattctattattgaggcagtatagttccccaaatgaattttaatgaaattgcagcagaaaaaaaaaaaagaattttatggaggcttctaaattatttagtaaagtttgccaactagaatctgactacatcataccatagtaatcttcacctaaaaaggaaacaacagtcagcaaatgtcaatcatgcaaaaaggggcataaagtaggtttatttaaaaagtgaacacagtaccccaattctagctttttagtgtctatctttaatattgcccaatcactactcctattgttgatggaagtatatttgaccattagctgtctgagtggcacacaccaagatcactgagttatctggatttttttcctagtttctgtcatctttgggctttctattgacatgaggtgaatagatttagggctagaatgttttaaatgctgagagacctaaaggacctctatttcaacccattgcattacagattagggaaccaatgcctaaaaaagttaggtgatttgtctgaggtacacaagtaaatgtggcagggctgcattaggggttgggtttctgactctcctcctcccatgcacagtcactgtgctgcctcgtgaaatacagccctctctgctgccagttacaactggtgcattctactccagcctgggcaacagagcaagactctgtctcaaaaaaacaaaaacaaaaacaaaaaaactggtgcattctttcataaaggaaagaaatcaaattctgaatgtgaatacctgaattttcattccccacttacattgttacaggagtgaagtacaatttgcttaatgaaataaaatttcagtatcctccttagtgtatgtatctcctcactaaatatgttgattgcatgtagattacttcttttacccatggaaaccgaacgaatatcttaatgtaagaagagtagttttctcaatttgtaaccactgcttcacctcttctgtaatccgaagtcatgtgaatgaaatgtcccaggctcataatgaagccaactgtgaaaccagcgcttacctccaagtcaagagcctgggaaacatctatggagcttagcttaaaactatctgatgatgaattgggactccagtatatcattttgtgcacacagttatggcataatatttgggggaaaggaagccttcacagttataaaatatgagtgggaaatgattatccctagatacagagagtacttattatgtaactgttgttaagggctgacgacatggcaggctctgtgccaagtcaagtctccgacggagcggaggactccccaggctctagaaggcccctgagacagtgtgtcatacagtgatgaggggtagaaaatactctaaccattcaggatgtgattgttttggcttcctctcggctgagcttttggcacttgaactggacccaatgcaacaccacagctgggaaatgacattatttggattggttaagaggagtttttgaagcaaaccccactgtagtattagagaaataaaaaaattcctgctatatccaacaagtcccagagaggctgtctctctattgttcacatgtttggacatgaatgtgcatttatgaacacttttttgtataaatacacagatatataagctatgcaaagccatataaatctgtactactagaataattcattccataaatatttcttgagcattcactacataccaagcacatttttctagtttaaaagtgaagtcgggcatggcagctcctgcctgtactcccagctacttaggagactgaggcaggaggattgcatgaacctaggagttcaaggctgcagtgaaccatgatcattgccattgcactactgcctggatgacagaatgataccccgactcaaaaaaaagtgacccacatgtgtatttgtcacttttaaaatagagacaataaatttcttccgtgatttttaaagaacttaaaacagaggtactattcaacccagcaatcccattattgggtatatacccaaaggaaaataaatcattctaccaaaaaggcacatggacttgcacgttcatcactatgccattcacaatagcaaaggcatggaatcaagtcaggtgcccatcaacagtggattggataaagctaatacggtatatatacaccatggaatattacacagccataaaaaagaacaaaatcatggtttttgcagtgatatggatgcaagtggaggccataatcctcagcgaattaacacagcaacagaaaaccaaataccacgtgttctcacttacaaatgggagataatcactgagcatacacggacataaacgtgggtataatagacactctggactacctggaatagggggcatgggttgaaaaactactttatcagtactgtactcagtacctgaatgacgagatccacaccccaaacttcagcatcacacaataaacccgcacatgtaccccctccgtcaaaaataaaagttgaaatttaaataataaattccttcctcacaggtattaaaaagcacaatgtgagtaaagtacctgatatgtgaccataaatacctgtccccctttgacctcttctttgccctcccctaaccttgaggtgtgattaaccttcctgccttttcaaattctgaagaccacaacagagtagggaaagaagagtgtgaaggtggtccatctaatcccaattcagagcctgggacagacacccatactgaatcctctactttagaaaagaactccacaggctttgagagtgacctgtcacttgtcatagcccctaaggactatgagctttttcaccataagcattgcctatttgttccaatctagtaagatcagatttatcaacagacagaaaaatagatatcagtttttttcttattctaaaaacaatatgtttatgttgttgaatactgggataaaatatagaaaatattaattattcataattcctaatccaagcagtgttccactcaataatttgatctatttcctatagtttgctactaacttcggggcagatctccagaaaataaatattgatggggctatgatgtctccattttgactaaatatattgttatataaagtggtaacgccttacaatttaagtgtgagaaggatgtgtgtgtgtgtgcgtgtgtgtgtgtgagagagagacagagaatatgaatatgaatatgacaatactttggagaaatgtgtccattagaattttaccacaagccagactgaaaacatcaaagatgtttaagtaaagcctgtttagttctttgtgaatgtaattttggaaaacaaactaaaacataaagataaaaggtccacatttcctttcatatttgcaaataaggcttatttcatgaatggtgaaatcgctttgtgtaatttgtaacctcattgttgtcctggattgcctgccatgctgcctgtgtttatgttgcttctccctatggcatgtgctctgagcagacaagggtataattataaatctccatccactaacaagaacaatggttgcatccagcaactcgactctccctttgtgaagctctacagggataccgtcttgaatgtcaaaggtctacaaatgtcatagaaacagctgccaccacttctttgcattaggcatctctttcaacatttactcatggtattgccttacccatctaggcagaagcaaaccaaaatccagagattttaaaatatggtatctataattacaagaaacaacaagaaaccaaagaggaatacaaatacaaccatgccttgtgtttcaagactttctagacttgcttagaaaaaaagagactaaatttttgtctctgggcaaagttagtcagacgagaaagacaaacttcacatgcaaggtatactttttgctgtctccatttttataaaagcaaagttaatgaggctttgatctttattccatagttattaagattattttcctaaatctgagatcattgcagagatatacaaggtagttctgccaaatcattcattcattccttcaccaaacgtggatacgagtgtctactgaatgtccagtaaaagcaggaatacagacattgaaggctcatttcattgcccttagtttctacatatcatagctgtgatgcatggaatattaaggaaacccctaaatctttaactgagttaattcacaacttaccagagctattttcaattcatgaaaataaaggccaggcgtgtaatcccagcactctgggaggccaaagtgggtggattgcttgagcctcaggagttcaagaccagcctgggcaacatgataaaaccctgcctctaccaaaaatacaaataaataaataaactgggcatggtagtgtctgcggtcccacctacttgagagctgagatgggaggatcacttgagcctaggaggtagatgttatagtgaccaagatcaccccactgtactccaaccttggtgacaaagtgagaccctgtctcaaaaaagagaaaaagaaaagaaagatttctcaagtctaagttcagtatttaagaaaaaataaaaagtaacatcatggctttgagcttgattttacctctgttttagactaagaagtctattcaaatggagcctatggccctgtaacctggctctgggaaaatgaacaaaggaatgcaacatcacatcagcactgtgtatttttggaagggtattgcatttttcctttgtggtggattggtccgtgcacttgaaaatacattcacagtgggaaggcaccaactctgctgcacatttatagttgaatctattttttttcctgacaaatattcaagtgggggaggaattccatgtgaatgctctagtgcctccttccctctgatgagtctaagtgctagataaacaaacattatttctaaaacctcaaggggaatacttgaaactggagcaacgtaagaggaaaagtgggcagaatggatagcttctagggagactgtgacatttctgagtaattactgaggggtctagggtctgggggacaacgctcccatcagcagcccttttgttattaaaaaaaatgaacatctgagcaatttaatggaaagtgctgtgaaaacacagctgcaagccttacattcttaccagatcacctcctctaagctttcctatgtagaaattttgaagctttcctggtatctcctcactagggggttaggaagtaagtaaatacactgcactcttggtttagtggtgggagatacattaggaaagcgtcagtgcacatgaagagacccacaggctaacagccatcatttactgagcatctactacgtgagtctccttctgagcgtttccacatctattatctctttaaatttcccaacaacactaaggtaatgacagcctttcctgctgacctatgaaggccaggctgggagttgtccgatgacttttcctgtataatgtcaccccaggggaagacgttactctgatttttccacctcatgtttttccctggcagttgctgtgagagaatgttgtttttggagctgagtaggcaagtggtgtgcatgatatgaaaaaccaaaaaaaaaaaaaaaaaaaaaatgcaccaaaccccacaaactttctgacagaaagcactcgtcaattttagcctgtctatgcaatgatcgaggccttttcctactgctggatatttctaagtgagaagatcctacctcagttttcagctgggctttagctctgcaagaagtgctgccccagtcagccttggggagatcagtagaggattagttagcagagcagccactggagggcactcctgaaatctagaggcttcttcctcccgaggaaagggttgctggagtccctgcctgagactgtgggtttaacaaagagaaggaatgtctgggggataagtcccagtgcactcattctctggaaaaggtctgctgtacatatttgccaagtgataaggaacctaggaaatcaaaaaccatttgacaatttacagtgttcaaaggtagcttcctgactcttgagttacataaatggctatgttaaaaataggcagccaatataattgagcaaccttaaatggcctaggatatgtaccatatgtgatagccatgaaaataatcaaaagaataattcagtataaattaggaatcattcccactccagtggactcagtcttatggaagtggcacataggagaaacttgggattctgtgatttgtgctgttcatgtacaggtctctctctccctagtgaaactcagctctttagtttgggagcctataccggatctctctgatatccctctccagctctaaacatatactacgtagtcacactgattgtccgttaaatacattcaagtcgttattttccttatgacaaaattcacagtgaaaggccacgtgtccaccagaagaataaggtgcaaatctaaagtgggttagtggcattttctcaggacagagtgcatgggaggacaacatagcaatcctggaagttgacagggtaaaacttttggacactctgactctgtgctgtatgtacctgtttgcttctgctttgaaaataactagtaatatacaagatccacttgaaccactgaatttagcaaaatcaggccaaaccagacgtctttgcattaatattgtcattttgttttatattacttaaaaagtcaaacttttttttttttaatcattccttctcttgactatctgctgctctcctgtgatgtatattgtgaaaaacacattttaaaaccaagacagatatctcaagatagacatcatgttcagtttctaagctacaattaaatctcgtagaatggtaagaggtttatatcagactgttgactgctttatatacattactttcattcgagactcatttcatggatgaggaaactgatgtttacataagtcaaggaacttgaccaaggttacatagttataagaagctgagctaggaccctacaggtccatctcagagacctatgatgttaatcattatgccatatgacctgtcttagactagtttaagaaatagcttctcaattaacctctcttcttttaaaagtgttcataggttttaattccttttttttctgcttaggcaatacttaatttttaaactgtgcacatagaagatgaaatggaaaaatgtattccagatgtaggttttatagttgcacatcttggatatggttggttacacatacactacaagcatgtggtacacatctatctcatttttactttagaaatacattctcaacaggggaaacttgaaatacgcaaactgtggtcctgattccacttcaaaacgtctgcttttattgggtttaccctgcaatcatgcaacttttggccagagtcaaatagggcaactaaatttttttcttgagttttacttggtatggttcactgtaaatgcttccaactagtcctaaagacagactttgttcatttgttcttctatgagttttattcagcagaaccttggataacagcagcttagccaaacactgtggggtaatcactctgctcaggactgattcctgtgcagtcagttcttctgcacatcttgccttcaaggtctgccagctgaatgcactgtgtttccaacattgccctccaaacagacctttcataaggaaaagtcactgctacttcattaattccagaagatggatggtgaagtcatattgctttgatatgctttcagactcaggctgttcatgggaagctagaactctctgaaacagaaaagtttttaaattctggctactttttcataggattctattatgacacctcagaggaattttttttatttaagtctgtcattttaaaggaaaatggttagatgtgactagggctgtgaaaacacagtagctaccagtgcctggcaaagtttgtactctaacatatttctgctaaaaaaaaaaagaatattttccattattgccttggattctttcatcttttcttacatgttaagaaacttaatatctgaagagtgagaaatagccattttagtgtgaaatcatgctggggtggaaaggccagcatatttcttatagattagtattataggagagtttggccattttcctgggcagaagcaaggagttggcaccttggaatcaactcttagccatctgaaggctttgagccttggtgagttttccaaccacagggcattagctttctgcagcctggaatggagcgatcactatccccagagagctgtcatgggtgcaggcagtgctcagcttggcttagttctaccatggtcctgaacagccaggctctaggttaagccaaatccagaagtatcttgttttatttcacttgccacgtgtttgagaaggattaatctcagaatatggcagaagccttagcaaagcaactttagaaaacagcatatatatgtgtgtgtgtgtgtgtgtgtggagagagagagacagatctgaggcatgggttttactaatgttattatttaaataaacccttccttatgctagagcaccagatggtgttacaaaaatgaggaaaaaaggctcagggcatataagtcacgtgtcacattagctgtattggcctatgttcaaataataaacattttaatcactgcagtttataactctattttaaattttttgttaatacattaacagtaactgcttacgtatacatagaattctaataaaaatgcataaataacttacaagaggaaagggacttagggattatccctggaagccctcatttcaaaggtgagacccagtagaaacccaatatgcacagaagttaagtgactttctgaaaggtcttgcaggtaattaattatagaacaggactccacgttcaatgctatgttcactattacctgaaatagacttggaggcaaaaataaacttatgtcagctatactcaatgctcagtaaagtggcagagcaatattttataagcgtgtgttccgtgaactcaaatgtgatgttaggtagtgattctgagtcccttaaaacagattgcttgatttatttaaggtatgttctctattacaccaaaaattgtttatggattttttaaaaactgcactccatggagtaagtaccaatttctacacttttgatgacattaagatatgttaagaggcctgaatgttctcaactatggattaaaaataaagtaccaattagttgggtcagttttctacagtgatttgaaattgatttctaagtttccctattgctaatggctgaatgtttatgttttcccaactccaaactcagaggttgaaatcctaactcccagggtgatgggatgagaaggtgggtacctttgggaagtgattaggtcactcttaagagtgaggttagtgcccttataaaagaggccctggacatctcccttgccctaccatcacaccacctgcaggcacagcgaaaagatggctgtctatgaatcaggaaattgtacttcaccagacactgactctgccagagcctagaccttggactttctagcctctggaactgtgggaaatacatttctgttgttataagccacctagtctatggttctttgttatagcagtccaaatgaactaagatatctattgaggctttattgggggaggtaataaaatatgtcatttttttctaggtttaacaacctatattcaattcccctttccgtgatctatagtatgggcataaatagactgtcatgtgtatccaaattaagatgatggtagccaggagaaagattgaaggtgggactactggctgttgatagccaagatctaattctgatctttagggatttaggttcgtttctggttggacggagttgtattatttatctatgcatagtgaagtaaccttgtgatcataatttcagaacaaacaaaaagtcttcacctcgtgatgtcttttaatttgattccacatcaccaggggcagaataagttttatttctagggacattcattgagaacaggatgacgtgctgagtttcagatgtgatcagcttgccaactgtccctgggtcctttgtgtcctgctgcaatatcttctaggaaacaaacacaatgacgtttgaagttcatcaagttcattgattaagctaagatctgcactactttgtcgaaatcttaaatagaacaaaaaatgtttgatgttatatctctcagagctgaaattaactgattaaagagtctctgttatgatgtctatcaatcaagtaaaaaaatagggttttgatctagaaatgcctatccgtttttgaggtatatactttcaaaaccttttgaaataaagagaacagtggttgcaaaacttttaagtatttttactttaaaaaaaggatagaaacaaagcaatgtgtcccattacatcagcatttttcaaaatttagtctctgtactttcatttgcataattttccactttctgtaatattttcataacccttagtgcttaaatgggtggagaggcctgtgccacagtctccaacaaggtgtcaagggagaggaggtgtttctcttctcccaattcacaccatatttagaagcactattctagatgattcctctaaaaatattcaagcttttaggatcttggctttgttttttgtaaattgtacttaaagtcagtgtgactattaccatcaatttgaataagtgcaatgtatttctcatgttgcaggtagtaaaaattgccaacgaatcacttaaatactgagaggactgacaagctataatttattacttggctcaaaatatgtctctactctgtattatctgcctagatcttacttaacacaggaagggtgtagacttcactgaaatgactaattgatgttcaatttgcagattttaattgaaaaaaatatattttgataagtagcagtacttgtttcaaaggaagataccgttatattaaaaagtaaacatccaaatctattggtctaggtctatactcaaaaccttccgggtgtatgtatgtgtgagatattttaaagtaattctaaccaagccattgttctgtaacctgacttaacaagctacagaacaattccttagcttaaattgttaaaggggacattgtgatgacaaataaataaaacgtgttagcagaataaaagttgtctggaaataagtaaatactattttataatttgggggaaagaaattcaatacagggtaaagagaacaggattttggaattaagctgagttaaaattcttgctctggacaacagacaaattacttaacatgtttgaatttcagttttttatctacaagttgggaataatatatgcattacgaagagattacaagtactaactggagaaaacaatctgagaccttggcaaataatagattatccaacttaattccaatattattaaaattagtgatcattagctggcactttacaacagaaatgatctgaataaattttcaacatatacatgctctgataccatgacaggaaaatgtaagtgcaagcgtgggggggcggtgtcaggagactcgtgtgtttataattctgatgcctatctctctgaagagtgactcttcgagttattcttttcaatagatgtacttatggaacataatttggtcatattgtagtgatctgctactaaagaaactttcgcctaactttctcctagccaaggatgtgagtctctcaataacccacatttacccatgagttatgttaaatgtgccttgtgttccactggtttagaatttggggtttggggaaaggcaaatgggatgttttcccagtgtactttagcacaatataggtgaaatcatacatgtatatgcaaaaaaagtacctgtaactgttctgtagttccaatgattgattggatcacaatactaaggagggtcagaatttgatgattattctggctttttgggtggccccaaactcccaccagctatcaaatgaaggcgtcgggggagaatatatacagtctacagaactcgggagagttaaagagtagcaagttccaatcaagaagaaatgttttattcagtaattactttgaagaatttttttaagagcccctgaaaatactggatttctgcaggggatattgcgaaaatactaaaatactaaggtgtgaaaatgattctcttttttgaattaaaaaaaaaatcaatagaaataattcagtgtgtgaggtagataagcttcagacaaagggaaaaaccaaacctgctagtcagagatagatataaaaaagagaaaaatcaacctctacgttatgttgccaaggagactgtgtaaacagacttacacaaagagaagtggctggctggcaatactgctaatgtggaaaatctcttcattgttgtgtggcatgcttcatctcagaagagcaggaaaaggtggcaggcagagagggagaaataacaagaatggaagagtcgttcttccaaaaagggccatctgtgaccctgagagataaacctggcagaccagggctcacatcttagtaaatcacctgtaaataaagcttgtaaggcctgtgcattgtctcatgattattttattaataatactttaacccttgcaatttgatacgctgtgcaaggtagtcttacaggggatcttttcattgagacgctcaacttgtttgttttgtgcttctcaggcaagggcagtgactggaagctgggagagagggtcaacagctgaatctcagcctgatggaggccaccatttaataagtaaatacatgcacggtaagcctcatatgactttcgtctctctattcttttagaagttggtctaatccaaccatatatacaaatgcaattatttctccttcaatattttcattcattcaatatacatcgggtattatgaataaagtccgtgtagatacaagtagtctcagttccccaaaatgtttagagtgtataataccaaaaaatgctattataaagtttagtgagaaaaaagtttgtttttatataaccatatatgcaatatgattacaaatctgctaaattgttgagcaaacaataaatggttaatcagtgttgatggatgagcaaactatgaattattttccctcttttaattttcatctccaaattttctataatgtggttgtatgaatttattcatatagagagaatttacaggtggctgaagtgaatctgggttcagatgttggacttcgcggtttattcttttacagagtttgagataagccagtgaagtctgacaaaatataaagcagctctttctgcatttgcaaatatgtgtgcagtttttttttttagatagtacatttgtattttgattgattgattgagatggagtcttgctctgtcacccaggctggagtgcagtggcatgatctcggctcactgcaacctctgcctactgagttcaactgattctcctgccccagcctcccaagtaactgggatgacaggcgcccgccaccaagcccaactaattttttgtgcctttagtagagacagggtttcaccatgttggccaggagggactcaaactcctgacctcaagtgatccacctgccttggcctcccaaagtgctgggatgacaggtgcacaggtgtgagcaatcacgcccggccaagatagtgcatttttaaatgtttctctccagacctgtcatcataaaagttgcttgcttagaagggggataaaataagatgcaaaccagctcttcttttattggagagtttcaatttaatcagaagctgaatgttagcacatatatatatgtgtgtgtatatatgtacatatacatatatatgtatatacatgtgtatacatatatgtatatatacacatttgattccaataatatatattttgagccaaattttatatgtatgtatatgtgtatatatacatacatgtatatgtatgtacatatatacatatgtgtgtatatgtatgtacatatatgtatctgtatatatgtatatacatatatatgtatctgtatatatgtatatacatatgtatcagtatatgtatatatgtacatgtatatactatatatgtgtataaatgtatatagtatatatacatatatacgtgtatacatatatacacgtatatatgtatatgtatatacatacatatatatgtatatacacacaaatatacatatatacacgtatatgtatacacatctatacatatttacatatacatacatgtgcgtatatacacatatgtatacatatatacatgtacatatgacgtatatatgtgtatatacacatatatacacatatatacacacacatatatgtgtatatatatacacacacaatggaatattgtccagccatagaaaataaaatcctgtcatttgcagcaacatggatggaactggaggacatatgctaatttgaaataagcaaggcacagaaagacaagtattatatgttctcactcatatgtgggagataaaaaagtggatttcatggaggtacagtagaatggtacttaaaagaggctaaagggcctggcgcggtggctcatgcctgtaatcccagcattttgggaggccgaggcaggcggatcacctgaggtcaggagttcgaggccagcctgaccaacatggtgaaaccctatctctactaaaaaatacaaaaagtagccaggcatggtggtgggcacttgtaatcccagctactcgggaggctgaggcaggagaatcacttaaacccaggaggtggaggttgcagtgagccgagatcatgccattgcactccagcctgtgcaacagagccaaactctgtctgtctccaaaaaaaaaaaaaaaaaaaaaaaaaggctaggaaggacagcaggagtgggggataaagaaacaaacgttggtttatggtacaagaatacagttagctaaaaagaataagttccagtgtttgatagcacaacagggtgactacagttaataataactgattttatatttcaaaatagctagaagaaaacttctgcatattcccaacacaaagaaatggtaaatgtttgtttgagatgacggatattctaattaccctgatttgatcattacacattttatgcatgtatcaaagcatcacacatactctactctagaaatatttataatcattatgtcaacaaaaaattaatataaaaaaagaaaataaaagctaattccaactgctaagtcattgataaattaaaaatagaaatgagattggggtcttaagtaatttccttacattaacggtcaaaatgaatgccacaccttgtgagacagcatgcaaaactcagtttcagagctggcatattgaattaataacatatcctttttctatcaaaatgctcttaagttgtaaatcatgcttttttgttttttttttttcaggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttctttctccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtcacatcaattagtcaagaaaatgtgattaccctgagcccaagaaacttccactaaaaagatggaaggaaagactacgtctggtgttctctggcaccatccttgagtccacatgtatttagaagtgaataactgaatttagggccatggtacagaggtgtcagtctgcaaactagaagagcaatgctgacaggccctgggactgttcctagtgctgtatgggaactcagaaatctaaccgaagccacaggatgggtaacgacaatgagactgtgacctggcaatatctgcataatcttgcaagaaatttctaaaaccataagacacacggcatttttacttgagtcctaaaatgaacatccggtgatattggaccttcccactcctaaccaaatgacgtcaacacactcttaaggacacatcacacactctgtggaagagggtaggagaggtgtggaatataaaattccttttttgagacggctgcctggattctaatggggttactctaatgtgttttaagaccaaggctcactggccaagatatactttcatgaattcaagaatgtatgatcattatgatgtatacatatacacatatatgcatttacatgacaaaaaaaatgccagaaggcatgtaaaagacagacagtcctcttttcaaagggtgcataatgggagtgattctatctttacgtctaaagtgttctactggacgcatttaatgttcttgtttcctctgtcttaaattattcgttcccttttggacacattattgctccataataatgctaagtagcttcattttgttgttgttgttttttaaatcacccaacctttcctaatgctaagccaggcaatggagggcaggaaaaaaaaatgtctttagagaaggctgtaggcctatcaccagattttgagctgggctttccccagaacacactttaggcctgcaggatgcctgaggccaagggtacttcctgcatccacagggttggggatgctgagtgcaatccctctattctgccacctgggacagccttttgcattactctctggctgccttcccttttctgaaacttgagaggggagaatgttgcttccctttagaacagtaggtgagcccatcagcaactcagccccaaaagtctctgcagtctcatctgacaaattataagattgagcctatcaagtaagtaaataaataaataaataaataaataaataaatgaataaaatgaatcataacaaatatacatatctgtgtatttattacatcttatcataattctcagcctgaatctaaatatacggtctactacaatctttttaattgggctttagctaaatgcatgatgaaaatcattttcagatcttagctcattggaaaaaagtaaagataaaaaataaataaataaaaagatcttagctcactgtcgtactctagtgccttcctaacacgcaagcatacttcccatgtcccattcacttgcaatcagctactggtggaaaattagatggtcccaaatcagaggaaaccgaagacatgataatgaaactcctgaaaaaatcaatgacgattatggaaattagctgtttaccaccttttttttttttgacctttcctttttttgaccctctaggcagcctagtttatggaaggaacatcatcagtgaggtcccagagaaaggaaaatgactgattacagagatagctattatttccagccactatatccaagagcgtatcagatcactcaaagcacattttatcaacactccccctgtgacaatctagtctttactggagttaattaaagcaattaattcccttccctttcaaagcagtgtgattacataaatagataatttcccaatccaaacccataaagcaagtgatttctctgcatgttcctcagtgtgcaaagcacctaactgaaccaaattgtcctttttctaaatttgaccttcatgaaattctccagtaactttttctgctctgtcttcctatctggttggatggcagaaccacatctccacatggacacaggactgcaagattaataaagcatttcccgcagcaaagatagataatgcctaaactgtaatcacaacgacaggagtagagtgaggaggaaaggagaatggcgggtgcctgctctgacaggcactacagttcccttcaacaatataccagcgtgggtgatgctgacaataattaagcaaacagaatgccaaacaattgtaagaaaagctgtcaaacattttgtgttattatcccctgcacaggcctgtaatttatcatcacagaaaaagcacataaagaaaaatctctaaacagtgacattttgttcaaattacaacccttggcttccctgactgcctacagactgacatctccaaggtcggatgtagtgctcagcaatttgttccttcattaagtgagcatgtctctgggatgggttctagccactgtgagtgctggcatgccaagagcaagaacaaagtacttcccaacgtgtgggaagccacttaccttcagacgtcaaaatgaaagaaagtaactgacattcgtatttccttctcagattggtcctaaagcttgaaatatgatctcctgcaccaaggctcctacctgtcatttcttcctccctctccacccaaaaccctgcttggggttctggacttggctaaagtgtaagggctttgatcttgttggtataaactcagtctttactggccgggcactggtggctcacacctgcaatcccagcattttgggaggctgaagacagtggatcacttgaagccaggagtttgagaccagcctggccaacatggtgaaacccccgtctctactaaaaatacaaaaattagccaggtgtggcggcaggcacctgtaaccctagctacatgaaaggatgacgcaggagaatcacttgaaccctggaggcagaggttgcagtgaggcaacattgcgccactgcacaccagcctgggcaacagagtgagactccatctcaaaaaaacaaaaaacaaacaaaaaacaacaaaaaacccaatcttcctgatgatatcccccaatggttgtaattgaaccagaaagaaaataaaaaaaaaaaaaggaaatacttttctcatccagtttctttagagtttagcacagttctatagattaattactataaattgtgagacataaagagacctcagagatgctgagccagtgagacaggtgtgagggtgtgaggtgttactattagtactttggagaaagtccataggcagtctccaacgtagatttctggatggctcagagttgaaatggaccctagaggtaatagaatcaatcttttcaagtaatgagagaaattctgtctgtgatattcctagctgatgttctgagctggaccacttccaaggatggagataatagaagccttccattacaaatacttggctgctgaaagacctaaacatttgagtcttcactgttttcaacagctccttccacacctgtccaacatagagatccacttaacagaagtcctaccctctagatattgccttatttgaaaaggtaatatcttttaatcccatttctttctatcccattgccagagctctttcccattgctttcttcactttcttcacaatcttttttcttttttaatttttaaaaatagggtctcattctgtgcccaggctggagcacagtgatgcaaccaagctcaccacaaccttgagctcttgggctcgaataatcctctggcctcagctaggactacaagcatgtgccaccatgccctgctaaccccatctcaatctttatacccataagagaaccttttcttagaagcctcttttcttagggtttggaggttgatttactattgccaatatagcaaatctttattttccttaggtttattttgattttttaaaacaatagtctttttactcaaactttggcaaagagtttgggctagtataccaagtaaataagctttaattttctcttggccatgtatcttctattagtttctgcataagaccctcagtgcttccatgtttactgctcgctgcacaggcacctctcactagatggcacttaggatatttttcaaccatctttctgaccaaaattgtatgtgttctatgtctcatccctaagaaagttgatagtgaactcaattggctgattacaagtacagtgtgaacaacttatacctgaacactttaaatatattgcaacctaacaaacacatttacatatcaacaatgactcatttccttagtccaagaaagtgaacacaggcttgattctctctcccaacaccctcccctccttttttctctctctttcattccttataatagacaaatgtgaattatcttcacaacctgttcatttaactctgtcaagctattcctcaaggacaaaccacaaaagggaaccagggaagggctgttcagagctcactgaaaatccagatcagctacagaggtccttagcccatagaagataggtctgtggtctcaacttggaatataaataacagcttctttaccaacctcaccaaatcgacttttaatacctttttttcccataggcttccaacctactctgattgacttaggctgatcagaaacaaaactttaacagtaacgtctaaaataagtgaactttgttttataagtcttccttcttgccaaagctgatgactaaataagttcaaagacatttaaattaatgtcagttatacccacagtcactggaggagaggtaataggaattcaagcttccagtaaagaaaaagaggaaatgagaaagaaaaagaggtgtctttcaactctagttgtgatatagtctgctgaattattgacctttcctttcaaagataagaaaatgtgtatgtggttttttttttttttaatttagacttcctacgtgtaactaaaatctctaaaacaaggtggcttattttacatatctgaagaaagtgaggcatgcaattttcccttcctcatagtccgacctaagagtgtgtggcaaactttgtagaattctaagtttccttcaagaacttttcatcttatttccatccacaaattaaaagggatggaattactcaatgtagccatagctaggaatacagtttagtgaagaacaggaagggagagagacagaaggactcctacagtttttctttacaatctaaatatgttaaatgcatgatggaagcaatggagccaggtcaaaatggcacttgctgtgttgtgaaaaatcctgactatgagaatcttctgtagtagaaaggcaggtcattctatcacaccaactggaaggccagtctggggcgtgcttgctggatgtgtggagatcaattacccacaagtccctgtggagtctcttccataagaaactggggaagcccaggccatcagtattctgcacacacactaacagcttgtgcttgcagaggcaatcatttttcagctcttttcagattctctttcttggttatttttccatcttggctaaaagggtttctcttttgtaccaagcaggggcaccaatctaacagaatttattagaaactgctcgattgggattttgctggagttctactgaggttgaaaatctcaaacaatatgtgatgaaaattttaggctgttttgggtgacttcaatcccaaggtctttcttggctgatttgagttccttctttcagagatttaggcaatgttagtttcagatgggaggtctggtagatcctaaaaatgaggtagctctatgtcagccattcagtggagaaagagcccatgctactctgtatgacaaaatactatgcctttatttgcatacaggtgtgaatgaattatttaaagagaaaaatgtgcgagtgggtactgcgtaagtgccacagtcgttgcactgtgcttttcagtaagtgtgaacattttccttcgcatgtctttttaagagaaagagaaaatgatgatgggaaggattttgggtaagacaagattacttttctactattcttatcaaaatttactattttgtcttcctttgtgtagtacctgtgtaatatttgctccacaattgtaagctccttgaagacatgaaatgtgtcttttcactttttttttttttttgagacagaatctcactctgtggccaggccggagtgcagtggtgtgatcttggctcactgcagccactgcctcctgggttcaagcaattctcctgtctcagcctccttagtagctgggactacaggcacgcgccatcacgcccagctaatttttgtgtttttagtagagacggggtttcaccatgttggccaggatggtctcgatctcctgaccttgtgatccgcccacctcagcctcccaaagtgctgggattacaggcatgagccaccgcacccggccctctcttcactattatattgccaatatttatgatagcttttggtttactgcaagaaacaatgagtaagtagtttgtctctttaaaccaatgctttccattcttctccaggtgagaggttggtatagatttttatgaggctttatcataactaaacccagtggtggactgaataagatcagctggtaaatatagtctttgatccactggaaaatccagcaatatctaacttaaacaacaaatgagcgaaattctaacatttctagtatatttgatctattggtttgtaaaccatcttgaagccatgatatagaaacactaactctgtatttttataaaaataaaacataagggtatgcatttattcattcaagaaacatttcttgagtccctaattgcactaggaactgttcttgattcatgatagaatgtgacagacaggttgttcatggagattttgctcgagtaatgcatatatggttggaactggtgggcacggagtccaaaatagcaattctaggccagcttgccctaaacaaatgatacagatattatatgagagagttgctaaaatttggatcatatttagctctcctcccacctctttcaaacacttactaagtttagggagaaatgtgggaacataggatgaagtggccacagaggtacccaagaatcagtacagtaacaatgtccttagcaaatggccctcccgtaattcctaagaaggtaaaatattttagcattgaaataacttcatgacatggctatgccaactctaaaatggtttcatcatgtaaacagtccttcagcgaatgacttacattttgaaaaacctacagagcagagtgaaaagcatgggctgagcagtcagctgatgaggatgactgaagccatgctccaccatttgctggttgattcaagaggaagtcacttaacctttccaagcctcagcttcacctgcagaatggcaataataatggccaacttgtagagttgttgtgaatacaaaaataatgcagtgcatttttagcatgatacataacatataatagcaacacagtgctagctgtaattcaattggaaaaaactactttaaagttcatatggaaccaaaaaagagcccacattgccaagtcaaccccaagccaaaagaacaaagctggaggcatcacgctacatgacttcaaactatgctacaaggctacagcaaccaaaacagcatggtactggtaccaaaacagagatatagaccaatggaacagaacagagccctcagaaataatgccacagatctacaaccatctgatctttgacaaacctgacaaaaacaagaaaaggggaaaggactccctgtttcataaatggtgctagccatttatggaaaactggctagccatatgtagaaagctgaaactggatcccttcctgacaccttatacaaaaattaattcaagatggattaaagacctaaaaccataaaaaccctaggagaaaacctaggcaataccattcaggacataggcatgggcaaggacttcatgtctaaaacacaaaaagcaatgataacaaaagccaaaattgacaaatgggatctaattaaactaaagagcttgtgcacagcaaaagaaactaccatcagagtgaacaggcaacctacagaatggcagaaaattttcacaacctactcatctgacaaagggctaatatccagaatctacaatgaactcaaacaaatttacaagaaaaaaacaaacaaccccatcaaaaagtaggtgaaggacatcaacagacacttcttgcaagaagacatttatgcagccagaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccgttactgggtatatacccaaaggattataaatcatgctgctataaagacacatgcacacgtatgtttattgcggcactattcacaatagcaaagacttggaaccaacccaaatgtccaacaatgatagactggattaagaagatgtggcacatatacaccatggaatactatgcagccataaaaaatgatgagttcatgtcctttgtagggacacggatgaagctggaaaccatcattctcagcaaactatcacaaggacaaaaaaccaaacaccgcgtgttctcactcataggtgggaattgaacaatgagaacacacggacacaggaaggggaacatcacactctgaggactgttgtggggtggggtgagggagagggatagcattaggagatatacctaatgttaaatgacgagttaatgggtgcagcacaccaacatggcacatgtatacatatgtaacaaacctgcacgttgtgcacatgtaccctaaaacttaaagtataaaaaaaaaatagagcacacatgtcattaatgaccattaattatagcaacacccagaggacagcagtactgtatcattttgcaggtaagaaaactgaggcttagagggtgtttatgagcacaggggaagatacacttcacctttctcttgaagttattatgttgccatgacttgctttggctaatgaaatgtaaatgacagaggaatgtgttgcttcttggtgaaaatcttcaagtcatcttctcttcactgtgccacaatgaattatgtttcagaaggcggattgtccaggatcctgtatcctgaattaaggacaatgtagagtagacgatgggcatgcagcatgagtaagaaatagatctttattattttaggtcactgcaatgtttacagttgtccattacagcaggataacatagcttattctaactttccaaagatgagaaactattaagatctagcattcaaactcaggtcttatggtattaaggccaatgcttttgtactaccttacagtacactgcttattagaaataaaacaccctgtgaatgtaccttccacttcgaagaaaatggacttttctgttgctctttgacttaaaaaaaattaaaaattctctgagcaaaggtcaatggaaaggtagcgaaaaagttggtagaggtgggcagataataaaactgatgagaaagatccattagtttagcagaaccctttatttcccataggttcatgacctgaagattacataggatggagggaggcccttatcataagcctgcaattctgtggctaacaaaatcaatttttaaatgatttatgtgatgtttttcaggaccaaaagagcagtaattcatttcccatgtggtacttggagctgctgcttagatgttgaaaaatgattaatctttatttacagcatggctcccttcatatattactggaaacaagatttgagagtgcaacacttctatagcatgcaattatttgctgaaggaagttccaggcataaagaaaaaaaaaatctactagcagccaaggatatctggacatgcactgaagtaaccactgtgaaaaccttccaaggccaaatgcttccaatctattcagtttgacccacttaacataaaaaagccacattaatttcccaaggggagccactcttctatcaaatcatactaactcctaacttcaacaatgggagaatgaagaattcagaattcttaggtttttgttcccccagaagactgagtttaaaaattttctagaaattggtgcacatagcttacttcaacttaagttgaaatatgtgtgcatttttaaaaattgctataaggatgccttttctgggccaccatatgtagacattcctttcttttaaaactacagaagtaccatattctcaggtctcctattctccatcttgccagcctgagcctaacaggtccaatcacatctaaggaacagtttcacctagggtaaagttcacatttttatgactagctatatcactctgaagcccctagtttagggcccacaataatttgataaggacaggtaaatttccatgtcccttgcatcttgtgatcattaaggttggggtaaagaccttggatatcaaggagatagagtagagactattcttagaccattggaatgagctctgcccattgcttctggacactagaatgttagagggctgtggagaatgatgcgtaatgatgcctgctgttttctctcctatcattttctaggacagattttcccaaggaaacagttaagagagccagactagtcagttacgcactccatactggagaccactcatatgcacattgtgtacctcatccttctccatggatcattgctcactttctctttattgggctaatggtattggttaaactgtaggctgatgactatggaccactattttctgtatcattaaacatggccatatcccttcaagtgggttgtgaataaaattggcactctgcttccaccccaagttggattatttaacaggcatgactggcttattaggaaatagcttgaactggtatgactgaggatgaaacatcttgtcaatacaggttatttgttaggtcccatagaactggatgtacaggtaaatgagggggtgagggctttccctcctgtttgtagtttgtatgtggggttcatcagcaaacttatgaagcccagtttattaagtttcttgggcaaaagagtaggcaaagctgttctaaatagagtaggaataaaagagggctggtaccacaataatggtgaggcaatttcattaactagagtataaacaagaaaacaaagtaacaaggagtttgttgatgtattagcaggatcctggatctttacttgcctgagttatctggatgagtcttttgtctctgggtaacttcagtcataacccttatcatttataagtaacacagggacctgtgctgggaaaatatggaccaatatcctagaaagttagtaacatatacttagtgagtaagcttgtaacacatacgagtgaccaatgttttcattaatattttcctgtcatgccaccattctgtgtactatgcttttcttcttgagtcctgtagttgcctctaagaatgacagtcctgggaaagatgctaattactcaacagagtatttaattgcttgtttgcctcaactcagttgtaagctttgtgaaagcaggaaatatgtgtattgactgtctatcccagcaataattgccatgcctggtatgcagtaactatttgtggaatgaatgaatgaatgggaaaaaattatagattctgtcatttattaatcccctactacagagtatgacaggttgagtgttgtgctacgtgtttcactaaccgtatttttgaatcctcataattctacaaggtagatattattttcctgatattataggagaataaagagcttcagtgagtttcaggtgtgcatcgagcacacaaggaactgttttgcagagagtcccttctctgtgacagtcagggcccctcccacatatttccttgagtagctccctcactgggtatgcaggatgacatgagggagatttgctgacagccacccttttctgttgagcacttatctctcggacagtgggatgagaagaagaaggaaaacacaattgttgaattacgatgggcattttacacattttatcacatttaatcctgaaaagaaatctctcatgctgacacaattcttttaataaaatgagtaatcaaaagttaggagatataaagtgactttctccacagtgaagagccagaattccaattccactccattgtgtgtgtgtttgtgtgtttctttcccctccagtgtcctttgagtgtagtaccattaaaaacttagaatgcttgataatggcagggaccaggtgattcctggtccctacaccatactcactaaagtgaaattcctgaaaatggctctaggaatctccattttcaacaattcactaagtgggtctaatgcaaagtaaagtttgagaaacattgaactaggtagagttgcctctaacatttttcatgcacttggataatactaggagccagaaggtctacaaatggaagaaatcaccctgtaccaagcactggtggtgcatttgcagctcaggatatggggaatgccttggtaccccccattaatgttaataggaatcatgtggataattctctatattccacgctgaaaagtgttccctttaggaccaggagaggctatatttaatcaaaccatctgaaatcctatgtacgtgtataagggcagaaaataggtcacagttggtaggctactttctgggaattattccattgtatcagcaaactccaaagtcctcaaagggctcctgctctcctggctctcagtgagtgacagcccaagaactaagagaggtcagagaaagtccaacacttaaggaaaaaaagttccaatcacaataaaacacataaaacaaattatccccaaaggacaaagtgtggaataaacttgttaaaagctattaacctctcaaaataacacatttctactccagagtaacctcagttgcagcttggagagcagcatgaaattaaggaacacaattcagagaacataaggactccaaatatgaactcatgatgtccaagggttttacaggcactcatgctcctatgaaaaccacgaagatgatgggtctatgagacctgagagagtcagataatctggtgttaaaaagtagtgagtgttcataaggcttccagaactcaactctattatagactaagaactttacttcgtcaatcaatccaggtttttgtctttattatagaaattataggactgttagcttattttaactttataataacatagcttattctaactttccaaagatgaacaactattaagatctagcattcaaactcaggtcttatggtattaaggccaatgcttttgtactatcttacagtacactgcttattagaaataaaacaccgtgtgaatgtaccttccacttcgaagaaaatggatttttctgttgctctttgacttagaaaaaaattaaaaattctctgagcaaaggtcaatggaaaggtagcgaaaaagttagtagaggtgggcagacaataaaactgatcagaaagatccattagtttagcagaaccctttatttcccataggttcatgacctgaagattacataggatggaacattacatgatgaatcttaaagcaagaagaggatatatttgggttaatctggatttgaaccttggtcacgtcttggaggaggaagccactgattgtaagggagcatgaagtgaccacacagaggtggtcactgtgctcagcagcatttcaccttgttactccccaccgctgtgttgcctttctcatggatcactgtgactgttgctgttttttttttctattttattattattatactttaagttttagggtacacgtgcacaatgtgcaggttagttacatatgtatatagcacaaagtaagcagagatatagaaaggtggagaactaaagtcttcaagggcatatggcatgcagggtgaatggcatattttacactatttgctttttggtatgtctgagatcctgatagctccttaattaagataatcaaaatccctagtctagagtgggcaactgtacaaaattcttacaataaatggtcagtaggtcttcaagctagctctcatgtaagctatgctatccctgaggcataaggaagggcataaagccccagaatgactaccactgtgtctatgagacaattcaaaagtccagttttttatgccaggatactttcaatttctccatcataggatcagggaccttccagccctagcttcagatccacagtggtgccagaagcactaccaaggaggatggtgtaggaaggtatattccttttctaatgctgctgtaacaaattttcacaattggtgcaaaacaatgcaaatttatcatcttctagtttgtatgtcagaagtctgacacaggtcttactaggctaacattgaggtgccagcagggctgtgttccttttcggacaatctagaggagaatctgtttccttgccttttccaccttctacagatcacctgcattccctggcctttggccctttcctctatcttcacagtcagcaacattgcatctctctgactgtccttccatagttgcatttccctctgactctacccaggaaaagcattctgcttttaaggacccatgtgattagattggaaccactgaaaaatccagaacaatctcctcatctcaaggacttaatcacaccttaaaagtccccttcgccaagtcaggtgacagatacacaggttctgggaattagaacatggacatcttgggtgggagcattacattattccacttaccacaggtggtaagaggtggtgaggagggaggtttccagagactgaaaagatctaagataagaagctggcagcaggagggagtgaggcttcaggctagagctgtctttccaggacccttgagggagttccggctggttttcctaacgccctctttcattttatcaccttcactgccaccatcgtcatcctggcctatgccctctctcctgaggtataccctaatcttcctcactggtccactgtggtctcatgtactaaactgcttctcctcaggctattttccacacagtagccagagttatccttaaaaacacaatcacagtatgccactcccgtattcaaaactctctaatggctttctgtcacttagaacaagacccccaagcccccctcatatggctgacagagcgtgacatgatctggctcactactcctctctcacgtcccctcccactcctctcccacctcccctcccactcctctcccaggtgttatcaggctccagccacatggcccccttgctgtttctcaaactctccaaaccagcttgtgtctcggctcctgtttctccctctgcatggaagggttgaccccggatctttgcatggttaatttcttcccttcttttcaggcccagatgaaataccacctcctcagagaatttctctgaccacgctcactaaaataccaaccctttctttcactctctaccccctcactgaacctatttttcacagtccttaccacgacctgacattacattatacattgatttgtttgcctattttccacgttgattatttgtctctgccactagaatgcagaagaaaaagtttctttagggcaaggaactccctgggagccaagaacagtgacttgcacattggaggtattcaaataactgttgaatgaataaattcaatgtatatttgatgagcccttttaagtgaaagacaccgtgatataaacagtgaaaagacagacatggtctacccttctttccccagtgtcccacggattgactcattttctttccggagtcaacttttactgatgaccaaagtttatttttattattttatttatttatttttttttagagtcagggtctcactctgttgcccgggctggaatgcagtggaaccgtcatagctcactgcagcctcgatgtcttgggctcaagcaatcctcccaccttagcctgctgagtagctgggactacaggcatgtaccaccatgcctggctatttttttggtattatttatagagatggggtctcactgtattgccctggctggcccggaacgcctggtcgcaaatgctcctcccacctcagcctcccaaagtgctgagattacaacatgagccactgcacctggccaaaacttattttttaattcccaattccatctcatgtctctcctttgttcttattcatttattcattaatccattcaacacatgcttattgagaacttaagctaggtccataatagatcgcagtccctaaaacaagaacatgatcagtttgggagggttcttttcctgatggccattatgtgaagggagataaggagggagaaaggttctacccacactcccactactctctccctcctaccctacagacctcctcttttttccatctgaattcatttgcagacaaggatgaaagccccttagagtaataacagaagctccttaggtaaacaaaatatttcagtaatctaggagtccatagggggctaacactgcagagcctgtgctctgaggactgggtcaggtccctgcacctgtgcagagcctgccttatctgttgagaagctcgcatgagctcaccactaaccaagtcacaacaagcacacagttcgagttcccaggcaggctgagctggcagtgcatcaggcaatgcccttttaacatttttcacttcttgttcaccgctgttcttgcaattctatgttttacttaaagaagatatgctaaataaatggttctaaattagcctgagctaatttcagccttgagctcactctgctgccacagactctggcaagtacgatttggagcactgacacatggcctgtgtacatgacaagatgtcttatgcaaagttagtttgggctatatgtagggacatgcacacactccaaatattcttttgttttgtttttgagatggagtctcactctgtcacccaggctggagtgcattggcaggatctaggctcactgcaacctccacctcccaggttcaagtgattctcctgcctcagcctcctgagtagctgggattacaggcgcgcgccaccaagtccggctaatttttggatttttagtagagacggggtttcaccatgttggtcaggctggtctcgaactcctgacctcatgatccgcctgtcttggcctcccaaagtgctgggattacaggcatgaaccaccatgcctggccctccaaatactcttttttttttttgtatttttagtagagacggggtttcttcatgttggtcaggctggtctccaactcctgaccttaggtgatccacccgcctcggcttcccaaagcgctgggattacaggcactagccaccatgcccagccccaaatactcttaataaactttaataaactaagaagtctaagatgaagcttcctacgaatggatgagtcaagaaaaagctacacaaagttcacatatcctagtgctgctcattaatttgggagaaaaaagcttgatgtgaggagcttgatttgaaggacaaccagtatggaaagccccaaggtactttataggatgtccaagattagatgctatttattaggtataatagggcttttttaaaacaaactcatacctctccacgttttaaaagtgtggcccattaatcagcaattaactaaaataaggttgttaaatgacactacagtaattctaggtcagtctgattttatcctctttctggcttaatgcctcagatagagtgaaactcccgataaggcactcactaaggggcacttgcacaataaagaggagaagcaggaacgaggaaaacatagttaatatgccaagtcctttttttttttttttttccattttagttgagatgtgctgtcagcctctctcttgaccagggagaggtgcttctacttcaccagggggctctgtcccccaaggctgcggcatgtcggtgtttatgcaagggactgtgcccctctctccacagccccagctgcagcctgtctgtcgccttataaaaaaggcatcgagcactgcttttagatcatttcatcatatttgctcatttccttggctgaagagtctggagtcagagggccctcagaagatgtggaacagcccttgtggatggaatagactgggcactgttgctttctagctgtttgttctccatgatcacatttgcatactagatttctaccaaggaaacctgggtacagcatcttatcatatttgtagccccacataaatgtattgagtaatccgaacttgcttattttgtaaataaacacataatttctgggattaaaaataatctaataacagcaaaactaggctgtccagccccacactgaagggcaatggaagttgtgctctaaaattttccagcagtatcagatgaaaagccatggaatggggctgtctctggaaaatgagcatgccagagaaaccgtttaacgcttgtgtgtaggatggggatctgcctgtgtacacttatgcaactcttttgatcatttgctctaaatgctcattaacagacattttgcaaaagatcagatgatgatacaagcatatcaacaggcttccgtttttactgtagggaacccagaaatgaggattgttgttattttctttagaaaattcatttaactgctgatagtaaatcaaaattctacattgccacttctgtaaatataagtgacaagaagttatatatctcccctagagaaagaacagtaaacatttctaaaatttccaagtgctcctacatataatctggttgttacaagtggaggcggcttgtcagaaggtctctctctgtaaatggataaggattgaagctgtgtcgtgtatcactcatgttgtttatcctttatattaaatggaagctatatatagatacaaaattataatggcacagactgcccatttcctaccagcagtaggttgactaggaaaatataagtaatttactgcaaaagtgcatcaaagttgaagcatttttagctaaaatgcaaagctaatcaaattagtattaaaacaattgacaaatggttaaattttcctattcaatttgaagtgaatagaattgtatgctcacattttataattgagttgaagctgttgtattgcagtttttattattatggaacaagcaacagaagtatagacagatgactgagtaatctgtatatacctttgcaggtaagtaactaattatgaccatgaggcacctacaggacagagaggccataagactcaaatttttgttattatctgaccaaaggagagaacttatgttcttaacttatccttaacttatgttaaggatccaaagagttagctgttaactacaagtgtcacttgaaccttaaatgagtatattacttttttcaaacaaactgctctacctatgaagaacaactctgaggtttatctccaaaagcaaagagcaacatattgtgtggtccttagggtagagcctgcgctcatcacattagcaggttgtccgggaggaacgctgggttgaaagctgaaagggctgggtctgatgatgtttttttctttacgtgggttttacatgagcttgagtaacccacaggcctctctgtagtctgagtttccctggctttaaaatgaaggtcatttaaaaatgatcctcgtcctgtctacctggcagagctgttgtgaacatcacatgggataattatgtgaaaggtgctttgtaaactgaaaaatactataatgaggcagggcacaaggcagcactgactcttgaggctgaatgctctgctggaggtcaggctggatggatgttgttggtgaagtggggcatggtggtttcctattccaggcttgagggctgactctcctgcaagtgggacccccgtacccacagacttcacttagtctccttgaaggattcatttgccacagctcctgagtactccatcagtagagttgactaaacaccaaagatgtttatattctaactttcaaaaagtggtatgcagctacttgtaaaaatgaaacatgtgaaatctacttgtctatctaaattttgccagtttgattggcatatttggcaagcttttgagaagactgggaaattgggcaatcatttgggaaaactggaatttgagatctaatgatcagctgctttgccttcttctttcccctgttacaaagccagggcaagaagacaagacagaggaccttctgatgtgctgcctgatctccactggcttcttttggtgaccacatgttccttaactgagtgtctttataagggaggtattgttgaagtatgtggtgacggactgagaaaacaagcagtgagattgttagcattcatatctcacaggcttaatgagaacaacaagcaagccccaaagggtgttaaatagatttggtatattttcctcatttcagagaatgtctattcctaatgcattattctctagccaacagaagaaaagtgcccagcttattccttcttcatggaaactacaggtttaaaggacagagactctcatctatcaaagcaactgagtgacttctacttaaatcaaggccagcaaagtagatgatagaaatattaagggaggttgcagtcaagggcagtactcttctttccttgacttatttggtgtgtttatggtttcaggaaactatcacctctttaatctttcaaaatacatttttaaagaggccattctttttattggacatttttattttaggttgcaagaattctttatttctctgcttttaaaaatctatacttgacattatccatggccaaaatgatttacatttgttgtggacgctgacaaggcccaacttacattctatgagaattttgtggaaaaaacttcaccttttgtgatggttcaacttagaaaggcttgagtcgaatgaccaaggttagaaagtctaaacagaaggacaatgagattctatgtatcagcctaaagatattcatctgaaaaatatgccatatgtaaattaaaaacaatgatggaatcctgctgcatgaatatcacagttcaaggtgcaagaatagaggaagagaaagttactataataaaaaccataatatatggtttatacttataataacacatatttacatggtatggttataacacttgctttgtcagtttgtcactctgacaagttacttgccctctctatgcctgttttttttttatttttaaaacagagatagtgctgggcacggtagctcacgcctataatcccagcactttgggaggccaaggcgggcgatcacttgaggccaggagtttgagaccagcctggccaacctggtgaaaaaccgtctccactaaaaacacaaaaattagccaggcgtggtggtgggtgcctgtaatcccagctattcaggaggctgaggcaggagaatcacttgaacctcggaggcagaggttgcagtgagctgagatacgaccactgccctccagcctgggcaacagagtgagactctgtctcaagaaaaaaaaccaaaacagataataataaaataatagcaaaagtagctaccttataaggttttcataaaaattaggtggaataatcactgcaaagaccttagcccagcatctgaaatgtcataaacagtcaacaaataatggctgtaataaaatcaataatacttatcatttgactacataaataaaccaaaaactaggaacaaaagcaatatacgtacatataaacatatgtataaatatatatatatgtgtgtatatatatatatatatatatatatatatatatatatttgtaacatatggttgcttactatgtgcagggcactgtcctaaggatataaaagctttacatctaaaatgtatttaattttaacaccaacatcataacataaatatgttgttatccccattttacatacagagaaaccaaggcaaagtaacttatgtaagtctacatgatagaactaggatttgaccaggttatctgtaggtatctcagtatttcctgaagtgactgaataatttttttgtttttataaccttgtttatcacatcactggtttttacacttttaatatacaatggttatttttgtagacattaactctataatttatttacctgtatctctaaaaaagggcatcacaggctgggtgcaggggctcacacctgtaatcccagcactttgggaggccgaggcgtgtggatcatgaggtcaagagatagagaccatcctggccaacatggtggaaccccatctctactaaaaatacaaaaattagctgggcatggtggtgcgcacctgtaatcccagctacttgggaggctgaggaggaagaattgcttgaacctgggaagcggaggtggcagtgagccaagatcgcgccactgcactccagcctggcgacagagcgagactctgtctcaaacaaaacaaaacaaaacaaaacaaaacaaaacaaaaagaaagaaaagccatcacaaaatgataaggggagagtagagtaactttgcatattattcattcacatgtgcaaataaaaggatctaatgccaaatgtgggcaaagcgacatacctcagtgtgagagagtaagtgctggaggctaagggcattgtggtctctccttcattttctcttatgaggcacactgatggggtacgtggacttaggacaagatggcacttcatctcgcttttctttctgcataccttgctcttagtcttctactaatgccacaatgaaaaaaacagaaacccccacttgacatctaaactctttaaaaacatgtaaaatttaaatcagtattatttattaaaaggttttttttaaattattatttggtaatgatttaccctaaaattttttgacttctcttcaaagcccagatgcttaaatattgcttactttgggtcttaatggttattccagagccatggaattttaaatttgatctcagatttttaagatgtgacagcttgattattttacaaggccaaaaccctgattcaagcctgcaattttaagaatcaaaactgttttcccattgatgaagacattttgaaatgtgtggtccatagctatttatgagtagtttacagctgttgtctctttgtgcccaagaccatggagaatccaggagccgatctgatcctcctgggactgctattaatatcactttcactttagacagctttgccttcaactagcaattttctggctcccttatactacattgtagcctcacagcattcaagcaggcacagggcacttggacaatttagcaataatctataatacagatttttgaaagaagcgatttgttcaaatgctgctaaaacagaaagtggctcttgaataccaaagtgggtgccagaaactgagaaaaaattccttaaactaggatctttagtataaggagaagtgattagaataatatcaatttggggcactgtgacatctgaaacataatggaacaattcctaattgttattgaggaagaaagcaagacctattaaggcaaaccaaccaactttcattgcacagggacataatttcggagatgctatatttgattccatgtttgatagggtctggcatatctcttcccaagtgtgctctggaaatcctatttcagtccttcttttaggggaagaagtcattacatcagccttgtaaagtacactggcatgcaaagtaaaatctgttactagggtgaaaagttggtacattctgtttttttgaggggaggtgagctctcacgtgcccccaacatgcacagttcactaaaaatctgtagctcaccaatctcctattgtatgcatttgttatttagtcttcagctctcctacattttctttgtttctttatctattaaacttttaaaaattgttccctgcctcttttccattctgattttaaaaattctgattaatatacaattgcatctgtattggcagaccatgtagatacagcatttgtaaattgcaagctatggagtacactgaataccatattaaggagttagtgaaaatgaaaagaactttaaaccctagccttttagatagatttctgcttttaaagattatctctggattgcaaaaacagacatgaatattgatagtgtaaacctgactaaaatatgactctaaaatatgaatgtctgccattataaaagaatctaatgataaaacctgaggaaataaacactaaaaaaaaaaaaaaaaaaaaaaggttgttttctcttccttaaaagtcctgaaatttaattttaccattctgtcacaggataaaacatctgtcctaatggaaaagtaacaaaaacccattttctgaaaagccccacagataatttttcacatgagtacatggaaatatctattccatttttggataactattctttcttgatgtaaaacactggtggtcaaaatatacaaatatcacatttgccttcaatcataaaactctgataagcacacaaattgcaataccatcatgctaaattaactaattcatttattaatcattttctttgaaagcagagtgacattcaggcactgggaatgctgaaataaaagattgaatccctgccttctggggtcttacacttcagcaaagaggtcacacatcaataattaatatatgatgtcacagatataaatacagaaatgaagtaaaaagagacaatgaatccagaccaaaagtttcaagaaaggctcctaagaagaggtgacatctgaatggagtctttgaagaccctgtaacaatagccaggcaaaggtgctctaggcaggaagaatgttttgtgcaaaagcagaggtgggtaaaacatgacttcagttctctcaaatagaattaatcaatctctttatacagtaactcagcacgttgtctgtacttctgttagcatgaatagaatgaatttttattgcttatctttcctggtggactgtagcctactagaagcaggctgatacatctttgtacctcccatttgtcttgcacttataacttgcctgcttagttttgatggaatgagccaatgaatgacagtaagatttcacaagagtcacctgtgaaacatacttcaccaaagcacccatggtagcacttattaacaaacggagtttaccagggatggggcagaagaaagtcttagcttttcaaagaatttcattcctgagacatttttgtggtcatgtatttaaaaaaaaagggttgggggggtgctctgagaaatgtgctctcagatggcacagctggaatgagagaaatgggaactgttttccattttacatagtttctggaaagggcaataagaacaaaaaaagcaacactgttggtcagcattctcagtgcctgagttgaaaggtgctataaacagagaaaagtctcataggccaactctatgcaggctatgtgccaagaatagctacaaagtggcaagttaaatcagccagggcttgtgagctgtctcaggacttgagtcccaacttgcactcgtgaaagttatgctgcaaagggagctacctttccccagcactgcctggggccttggcaagtctaatggagaatgagtttgatttcaagccctgctcccttcaggcaacttacaaagaaaagctgttaagtctgtggagctgggaatgtctggaaagagtgaagacccatcatttaaaactgatttctttttaaggaagtagagcagagagcagtgattacttcaacacccattctcaggggaatttctgtaagccggaatcagctaatgatggttaataaaggtaaatgttccctgattctcaggaagtgattcttcatcctggggctttttgaagactctgtcttcacttgaattttgggtggaataaagccctcctggatttatcctaatctaatactcaaagttggtagttcacaggagtctgtttattcttctagaaaagtataacagtggattagctactggcttctatcccttcagcacagctcccccacacaagagcgtacctttaatgactgatgctggtgtatcaaattgtgtcctctccttctaataacaaaataatgaaatacagtaaaatgccactttttctgactttttttttcttctaggacatgtatgtttcttacctcattcagaggcatgctgggaaatttaactaaatctgaaagaaaaacattctgtaaatccttaagactggattagtaataaggagtaatttctgatctggaataaaatccagaattcagcttgctcaccccagacacaaaacacaataaaaagaatggttgttacagttactaaacgaaggatcttttcacactcagcaagggtaaagactgtctcttctgtatctctgtattacccaagacattgagcatccatcttactgatacaaaggatgtctagtttgaaagtttgcctatgtacatttgtttacgcactcaggcatatacagactgccaactttattattacccaagattaaaaataaaaaatagaccttgctctcaagagatttcctttccgttaactgcaatgctaagtgagatgcatcagtttcatttttgcacgctcctttgctccgtttagtaccgaaataaaaacatgacgtagcttttggggccggggaggaatctcattcttgcaggaaataattgccaggaattttaaagagtgtcatcattttctctgtgtccagtcctgcccagtaacagagaacagctattaaaagtatccaaatgctggctgcaaggagaagttgaactctgaaccactataaacccaatcagatgcagacattcttcccatcccataccccggactcccagtgaatcttgaagaccctggggttagccttatcatttattcgtctgtatagtgatggcctgtgctaatgcccaaatgatcctgacttattaaaggttcttcctgaaaagacatgatttttattagttcaccacaacttattctcaaaaaagcatttattctttatcaagccacaaattttacttaattaactattctactagattccaagacgatttagaagctattgaggttgtaacaggataagagaacaactagtccactctgttaaaataaaataaaatccaaaaacattaaatgttttcctttttgttctctaatgagaggtagaggatgtgaaagtgaagatacagtaaggctagtgtttccaatgatttcatgacttctcttccagctatgctggtgtcatagtaagagcctgatgctattattatctctgattatttgataaacctgaaaaacaagttcaacaaatggtaaaacatctggatctttgacagacaatggcttataaaagagaataacgaacagttatttggagagtattaagacccagatggttcatcagggatcactttaaaggtgtttgttagatcctccctctcaaagacacctacacaagagtcatcagctgccaatagcactgagaagattttcacatacccagcactgtttttgtgacaaccctttccaaaattacgaaagaaaacaaaaacaaaggcaaagcacaaagaggaaaaatgaacattgcttaattttttcttgcacccagtgcttgaaacgcatcaaagtcagagctccatgctctttatctcagctcactgcagctgtcctttctgccaaaagcaaaacaactcattctctagaagaatctgaatgcccactatatccttgacagcgttcctaacaatagacgccgaagatagaacacggttagactttcattgacaagaaaggctggagaatagagaattgtgatcaggcagaagaaaaataaaaactggaacagtcagtggtctggcatatctactaccccccaccttttatttttctgaaaagcaaagctgtattttggcagagtccagaaaaactaggcttgtaattgttaatgtagttctagtggtttaggagaagcagtgggcttggccgtattatggaatgactctgcaaatatagctcagaccctaaggaggttaatttaaaaaacctatttcttatctgtataaagtcttgcacacgaattacattgtttccattttctccaaaagtgtgctttctctctctctagatatctgtatctatagatatagctatctataccaatatatctctataagttgtttatatctatatgccaatatctataacatatttctctctatatataaatatatagagacatctctgatctcgctatatatttagagaaatgttatagatattgacatatatatagatctctctatataaatatatatagatatatacatatatttatgtatgatatatgatatatacatacacatatatttatatagagagatctatatatctatatatctatatataaatgtatatctatagatatatatctatagatatgtatgtatacatacatatctagccaacaatatatatagacaacaatatctataacatctctatttatatatatgttgttatatatattgttatatatctatatatagatattttgttattacattatatatataaattaaattgaaagcttttggggaaaaacatatataaatataaatataaatatatatatacacacacacaatttctcattttttgttgcttggtcttattctaaattcctaagtgtagtctgccactctaatctcttttcccatgaagtttgtcttagaaatgtcatccgtgcaaacaacggctcaccaaggacaagtgctggtttatgcaattgagcagtagaggatgctgtatccacttcttcaagaggtaaaaggagctgatttctgcactcccagggatgagcaagcttcatattcatctgatggttatctgagcaggcactctcatgcattttgatactctagttttataaccagagaatgtcagagtcaataacatgattataagccttataagtcatagaatacagcctctcacacaatcatctttgaaaaatggtcagctggactccaggaacagagagatggcagcattgcttccttcaagagacatttattaagcttctggtagcaactctgtgaattgggtattattgtcctcattttacagatgaggaaatagaaacctgagaagatcgcagttagagacagacaaagtgggatttttaacctagggctgattccaaagcctttattttttgatcactacaatatacatctgacagacgttctctttaaccctttcaagactataagataagggttctttgtaaggacagacccatgctttcagtagtaaacactgtgtaaaagacaagagcatcataaactatggggctgatttaggcagccaatttctagtgttttctttttttgttgtttgtctggttctttcacattctctctctctttctcccatagtatagcaacaattggtctaaatattaagctttatctatgtcaccccacaaatgctgagtgtgattcatccaagtctataacaatggtagagtggcccattaccacagacagacaagaagaagatagcagtgtttacacatgagataatttggcttttctgctaagccttgtgtgccaagttaattactctcttggtgaaacaaggtattttgctcatataaggtagggaaacttgcagtgcttttggttttgttcatttctcttcactagtcattcataatgtggtttttaacaacaaaataattagttaactgagatagaaatgaaaatcacactggtccctgtgcataaaaaatatatattatagatagaactttgtgcttgccatttctttctttcatgttgtttaataacagagtattttgcctgaagttccttatatgatcttctgattagagaataactgccaaaatgatgtttgaaatgcaagtagtatggcagaaaactcttaagaggaaaatgttaggaccagggcaagtgctccctaggagccagagttcagaactctgggctggttctctgtgctagttactgctcagtacccagtgcctagaatagtgtctagtacacgacagacagtagtagctaatagatgtctgtccagtcaatgaatataattccctactctggtgcctgctgcagcttccagaggtggactctttcattcaaactatttttactccattttatcttcaagagaagaggcttcactatagggataaccccaggttcacaggaaggcatcttctgttcagctgttccttattcaagcttccatactgtcatctatacaacaaatcagaccaggatatgaaagacagagggcacctcctctaggttgccattgccttaagaccatttattttgagaggtaaccatgcttgagacatgcttatgttaagactactacatgaattttatttaaaatgcaatccctgattgtagaagacagttttgtgaccagtgaactccgtggatcagcctttgatggacaaagagaaaagacttggcttcaccttaacgactggtctgtaagataggaagtttaagttctaaggcaactggactaaaggccagcttaagaaacaaagcaaaccccttacactggtgtttctgttccactgatgactttctccatggtccggagctgatggacagctatattcacacacactcttcacaaccattctgaaagtaattttcagctgcaaccaaacaaccagggacctactgtgtgacacatggagcaattgataataccagtgctctatggatcatgttgtcttatacatcacatgtgcttgattggtctgatcaaagttatgattgaaccagctctgcacctgtattcgtccttgcacgttcaagtgaaagatgatgcaaccacgacaggctggaatcaggcctttgggccatctgagtgcaatttgagacatggagttaggctttaagaatgactttgagggttctcaagtaatatccaccctctttcacaggagtaacaggtcacctacctcccatgaaaggaatttaaaacaatttggaactcagtaagcaatgttacactcagcttgtctgtctggcagagaacactaaaaaaatatgtaagactcatcatgttaccagtctgtcagtaaatatttaccaccttgagacaaaagtataatattcagcatttgatgtctaaattagtagaaaagacaaacacaaatataataattagagaacaatacaagcaagtttaggtgtagaattcagtggctggttgagatgtcagtgaatcaacagcttagaaaacagctgtgtttccaaaatatgttggcagcagtctatacgtgttctcagtgatgtaataggagtcaggcactcacagaagctgacattatccataatgaccctgaatcatagacttcagcatgcaaactcatgatgttctattgttccaataagaataatatctgggatgccagacatacacctgcccaaagctccctgcagaaggcaatccaattcctcattctttcagcggacttggcagaggaatgatgtgtgtgtgtgtgtgtgtgtgtgtgtgtgtgtgtgtgcatgcagggacaagggggcatcttagctcaagcttaccatactgggaggacagggccatgaaggctggagtgaggaacaggggaggatgagggatagggactcagggatgggaaactggcatggggctctgcaagcagtgataatgaagagacatcctggtcctagagggcagagaggaagcgtgggaactgaaggcatttttccctttgctctgctgcttgtcactcacaacaccctgcctcaccaaaccccagctctgatcagggctcctgcagggattctggaaagaggaagaacacgcacgttatgagactttgatgggtattgtcctgaagcaaccaggaaaataaaaagaagtaaattttagtgtgaaagcagctcctggtcctttggcttggaaaccacttctgctttccccttctgctgtcctgatcctcactgcttccctgcagactctgcaaaccttgcatactgcttcaggcaagagggtctgttctggtaatacaagtgccttggggtttgcattcatgatagtgttttcatgaattttcatctaaaaacaaataatagaccccctcaagaattgttcctaggatttcacacatatgacctgaaactttaaaatcaacttttcacctgctgtttttatttagcagaatcacattttaggaaagctaatcatttgctatttaaaaatctgaaatagagataaggttttacaataggcttcagagggaatacttgctcaactaaaggaaaagagaaatggcaggagttccaccagggatgatctggcttcagtgcaacctcatcagtgtgagatattcttgctggtcatggcttggctaatattctccccagcccctactcctctcccctccacttctacctcagctgaaacacccaagttgaggaaaacttcacagggagaataacccctgtgttgtgctgcagccagttcatcctgggagtcagttatgtatacctctccccagttctgtgtttagtgacttcatgttggtggctagaaatcatccgcatagtatttacatcatgggtataggcaagtgctacaaatcaggacttttccttggggatggatgtttggagctagtttaccagcacaccagtgggtaaaagtgaacaaatacttttttgatcccacagaatcttaaaaaatactttacttcgaaaatgtctctactaagtaatcatatatatatatatatatgtatatatatgatttttttttttttttggtagagatgggatctcataatgttgcctgggctggtctcaatctcctagcctcaagtgatcctcccaacttggcctcccaaaatgtcagtatgttgggattaggcgtgagccactgggccaaaatgaccatatcttttgactggacaatattatcctatgttctataaaccatattagtttcagaactaaatgtaatgctaaaatacgatgactgattcttttttttttcagtcaaatgtattataaaacttttacgcaatatcattttccccctttggggaaagtagagggatataagctacaaaagaataaaaaagtaggtagattaaccaaatcctgttttttttaaaaaataagttactttgacagagtctgctgaaaaatattgttaaactatttgtaataatatttctggtctggttagaaaatttattagtttatagtacaatgcaaagggaaaaaatccaacttctctattcaggttacaaatgtgatttcacatttgggagttgtgagagaaacgaaaagaaaccttaacaactttcttgccagattgctttgaatccctaaatgccttattttgtagccagccattggaattgagctactgtctccagacaatcccattaaatatatattggttccctagaaaggtaacaaaaaaaagttattaaaaaaagaggaaacagcccagtgcagtggctcatggctgtaatcccaacactttgggaggctgaggcgggcagatcacttgaggtcaggagttggagaccagcctggccaacatggtgaaaccctgtctctactaaaattataaaaattagaggggcttggtggtgcttggtggtgcatgcctgtaatcccagctactcaggaggggaggaagggagaattgcttgaacttaggaggtggaggttgcagtgagccgagatcgtgccactgcattccagcttaggcgacagagcgagactcagtctcaaaaattaaattaaattaaattaaattaaattaaaaaataaggaggaaaaaatgatgagattagcagacaggaatgggagatgaggaagtagattagaagacaaacatattttttaggtagttggtgctaggagaagtcttgagcaagtgtttcattggataattaaaaggcctgtaatagtgaacttaaaatgacataagtcaatttggcagggaaaggaaggaggaggagtttttgcttattatttagtctcaggttggactgccacctaaactgttggttccattaagtcaaggagaccccatatcctcttcattactgtgccttgcaaggtgcctggatgaaatgaaagtgaaagaatgggaaacgcagtacgaaaggcaaataactgcagctgaaaaaaaaaaaaggtttctttgtttctttgtttttatcttggtttagtagtttcaggcaaattctgtatcttctagttgacccatatatagcactgattctcacaaagttcggagatagcattagattttaaacttcattttctttgcacaacaatttattcatccccttctatagaatatatgcttctagagaagcaggtgcattgtctcaaagaaaaagacggcagcagagtctgggccagatttaccataatgtgcgtcctgggagatcttgctgctgtcacatttgcctggttaactatccataagtccatgttaaatactcaaaaagagaattacagtgaagaaaaatggatattttaaaaacagtggtatctttttttggatccagaaaacaaaaagtattttatttgccagaggtaattttatgtgttagtcaacaggatttgaaggatcctaaaatacccattactacagctataataatgagtaataacaactttcttctctttatttcttagatgtttggaagtcctatatgcatatcccatatggatatttcagtctatataggtatatccctgtcttcccttttgatacataccagttaaaaaactgaacagaaagtttcaagcaaattggttaaactctaatggattcctctggcaactttgatgaaaaggtttatgcctatgacagaaaagtcccatcagtgggcaaactttctagacataaaaattcaatgtaatctacagcaggtaaattttatgtcaattgaacatcaggattggaatttctggtaggtgtctagtgatcatagtacaaactatagttttatttataagggaactggatgtaggcgacttctttcagtcttcttatcacaatctttctaagaagacccttcttttcagtcatgaagaagctttgtgctgttgattattaggagtattttctcaaacaaactttccagtctaaaatgtcaagccacagatgaatattgagaaggcttgtccaaagtgttcaatcagtgattttgagtttatggaagtcactggtatgatgacacagctttatagctgagtttctcactgtgttcataaaataaacaatttaaaaagtaaatcaatgctttgcatcaacaatagaaagataagttcccctgctcatattccgaaagtttcctaggtttcaagctgggagttccttgaaaaagcccagggcgccaacagcatgatgtgatccgctcccatttttagatgagtcactaggacagttttactcaaagaggcaggggtttgtggaaagaggagtggacctctataaatggcataatttgaatgtgcattttgaaaatgccacatgagcaaacttgcccacctgccagtccagagaagtactgctaaaatcacctctgaaagaaccacatgatctcaaatatttaaagaataacttccaatgtctctcaatgcaccttttgttattttatgttagtgcatttatccattggatttttcagttaatataaacatttttatcatattttcattagatgagctaaaatggatgtactcttaaatttcactgcgaggttgaagtcatattcagtcacaacaccctgagtgctggacaagacatctttactttttttttttttttttaacaccacgagctctaaatccttccaagatacaaaccattaaaagcacctttataatcaacgtatgtcagagatctaacatcatattaacttctagcacatgcaggtagctaattattattttatttctagtctttacaagtacatggtcagttaaatagaaaccacataaagagtattacaagtggtacagtggaaagaaattttaaaaagagggaggaaaaactaaaccatgagaccaatatacagggttcttctctttctatgacatatgtgctctcattagggcattgacaaaagaaaatatatttttcagaacttttgtacccctgatgctaatgtacacaagagaagccatcaaaagcctactgctgacaagtcagactattgatccatcctgtctctcatgatttcccctgcctcataatttgatggccttttggaggcgtggacaatgaaactgccaaacaaacagggactctcacatagagctttgggctttgtctccagtgtctaagctagatttttgggttatgctgctgtggaacagctgcttccagagtcacccctctagagacatacttggtcacctgccaggatttacatgattatccatcatggggacaaatctatcccaggaaggctcatttcagaatataatacagtgtggattgaagacctaatggagagaagtgcacccacaggagtgactgtgatctattaaatcagtaagaccttggaagccttctgtcaactgacttcagaaaataatggttcccctctcaacacaccactgtacttttttatttgtcttttgttaagtcatcctgaggaaaaggctgctggactgggagatttaagactttgaatagtgctaacagaatagaaaaggaaagttaaattacgctgcctattctcttaccaaactctgtaataacaacatctattccttcatctagtgaactgtcaggtagggcatagagaatacgcatttggaaattgatctcaactgcctttgagaaaccatagatcatgggaaaagaggacctgtgtgcctttccatcttaactctggatcactctgctcctcatttcagaggccttctttcccttcttagagtagatcttattttgttgttgttgttttctgccagaaaatctttacacatgctgtttcttcttccttggaatgcttttcctccactgttcatttgcctgaacacctaagttaactcaggatcctcctattcaatgtctattgacctcgttaatttttatagcattttctcacaatctgcatttgtacttttggttcatctaaaagtctcacaaaggcatgaaagcctcacaaaggcagggaacatggatgctaacatgaagtaggagttacataaatatttgtcatattaaagaattttaaaaaataaaagtaaataaatgaagactgcaaaaaattgacagccataactctggattgtaaataaagttgtatattgatgctgctgtgtccagttaaataaaccttaatctaaacttggagctttagagtttgtatactagtcactggaagtttcaatcattcatgttttaaatcacatttttctcaataggagcatatcctttaggtaaaatttaaacattgctctcttcccttaatatgagggacttaatatctagctttacagggctttttaagagcaaggaaaatcactctattgatgctaagtgaagggcagagaaagcaactctattaagcttttgacctagtttctctctggttacttcaaggcaattgaaaagtcctcgattaggtgcaatttgctagtgactattctactgctatcagtgcagaggcatatagatggaatagggtatgtagacttatctatggtatattcatttacataattttatgtcataaaaaacaaaaaaaatcaaacttgtaacattactgagtcagtcgtaaaacagagtatccagatgttattttagaaacagcattgattgggcgcaaagatcaaggtgtatatggcagctttagtgagtttggagtatagaaagtgttgggatcaacagaatccatagcaatcagtttaaagttttcaataaagctatgaatggtaagagggaaaccaactagaatttgctgctcattcacctcaaactgcactgagatatctttatgctcaaaatggacaaggagactattatgtgtattctttgatgcagcaatgctacttctaagagtttatcttacagataaagtttcacaagtgcataaagatttttaatgcagcatcatttttttaagttggaaacaacttaatgtccatcatttgaggttccttttttcctatcatattgattatttgctatctgccaggaactgttctaaagcacttttcacataataactcaatttgtcttcaaaacaacaacaatcttcagttactttccctactttaaagataaggtaaagtaagttgtaggggaccacagaggtatttagtggctaagctagggtttgaattcagacagccattaaaaaatgaagtagacccaaacttactgataaaacacctagggcatatttttaggttgaataaaaaagcaagttgcatatatatatatggggagagagagggagagagagagggatacattccttacaaaggtctagaagaatctgttcaaccaagcgtagtcacctcttgcttataagcagatgcttgaagagaactttccccttttactctttaaaaaacatctcaatcattttaattttatatccttaaatgttaaaaagttatgtatgcctggttttataaaataaagttaaatgcaatttcacccccactttaaaaacaataactaaaaaggtatagcgcttactgttcataattttgtttcctaacaattaaaacatgttattaaggaattcaatttaatatggtctatagtcacatgtacgtataatctgtatgtagcacatataaagttctgaatagatggcttccaccggggtgacaaaaggaacagaaaaaagttatactatgttaagttcagaactttacccaaatatctttagacacacagcataatacatgagaaaaatgataactacagataatccataaagttgtttaataaagaatggattgaaaagttatttaagaaacaattattattttttttttttgatgcaaggtctcactctgtcactcaggctagagtgcagtggtgcaatcatggctcactgcagtctcaaactcttgggctcaagtgatcctccagcctcagcctctggagtagctgggactacaggcataagccaccatgcccagctaattttaaaaaattattttgtagagcctgggtcttgctatgtttcccaggctagtttcaaactcctgggctcaacagatccttccgcctcagcctcccacagtgttgagattataggagtgagccaccatgccctgccaaaaaagtaacatattgaatgtaaaaatcataataaaagttataatgatttggtgtatactatgtcattctaaaataatttgtgcatttccttctaaatatctatctataaacattagtaaagaagtgggaaatttttttgtcctgaaattcattttacttaattagcatcatacagaaagtcatttatgtgccagatgctaaaagggaggattacgatccagcagatattgatcataagaatgaaatgaggcacaagaaacacctgtgaatcatgaagtattgacgctggattttattaactcctatatagtgataatgtgattgaaagattatgaatcctataaaggaaatatatttaacaagtccctactaacaccaactcttgactctcagaccatccacaaataatctacaattagaattcattatgtctaaagacagctatcattaaaactgaaggccaaaatcgccctttctgcgtacttctgaaagagcttgcctttgtgagcaggaggagaagggaagagagacagtgtacccaaggaaaggagggtgttggtggtatagagagaaaggcatttctagcgcccaggcaccacaatgagaatttgagaattgtgtttattgtctatagagcttgttattgctcttgggtttttggctacaaaacctaataatttactcagttttgcaaggaaataagaaatgggcctcaattcactctccttaattcatttagttggatctgatttgcaatgtatgttagtactccttctgtagcaactgaaacatattaaaaatgactctagaaaaaatacatgctagaaagtgcttcggttactttttccttaactaggagaccccaagagggaaatgactaggtctcaaaatttctaggaatgacatttccttcttctgagcaacttgaaggtgctacagaccaatggaatataagggattcattatttaatgtacaaaattcaggctgctgctttagggcaaacagaaaaaagtcaaaatttgcctctatatagaaggctaaaaacacttttaagaaataaagtaagtcatagggaactgggcataattgaagttcccaaagccaaaattttcccttttttatttgtaatccaatttgtggtacaattttcctaaatcctacttctgattatttttaaatttttctttataccaaataaaacaaagttaaagacagaactctgctaaaattttcaatgtaaataaaaattaaatcatttaataaattatattagttgtcatgctatattttatgtttactcttgttatgttttatttattttatgtttgactaatcccccatcctgtgggaaacgtttgttgatgctgaaattgccatgagctatctttgctctatttcctttacttatgtcatcatcaagttcaccaattaacctatattttcacccaggtagttgacaaagcattggatgcacctagccaaggactgttctatggctctccactagaaactccctctagaccaggctgatgtcaagccatacacattaatgataatggtaatgagctacataatccagccctccttgacctcatatttctacatctgggtcatgtgactataattaattttttttttcttacatgtcttggtgaactgaaggcacatgatactcatggtattctcctgatcttaccactaggcactgtgtcaaaagacatagaaattgaaactgggttccttgagagcagacattatatcctattcatcccttaattctgtttcaaaaccagtgactgcaagacacagaaatacatgttcaataataaatatgtaatacataaatacatgttcataaactattgggagagtctcaggattttgaaaaagttgttttgtagtcctagctatgccactttcttgctctgtgactctggacacatttcatagtctccaagaacctgagttctaaatctgaaacaaaaatgtactgacacattttaagattctctttcaggcataaaatcctacctagatttatcatttccactgtgtaacaaagtgggacgatgacccattttttgtaactcagtagttttctggaaaaaatttaaaatgcattttttcagtacatcaatacatcttgagataaaacattgtatagtctctactttgtgtaaagcaaacattttcattacttatctaaagacttaaccttctttataccaatcatctgtaagtttggaaaaacaatgcaattgaatttttcatccagctgtttaccatacataacttagaaatcctaaaatgccttattgaaagtgcagtgattttagcattggtagagtaacagtctcaagaaatgaatgaagctttaatgactcatcttcaattcaagaggaggggctactattataaaatgttaagctgaaaaattccaaacacaactgagatgaagttacatgatttaacaatctgttttttgtttttttgaaataaagtctcactgtgtcgcccaggctggagtgcagtggtgcgatctcggctcactgcaacctccatctcctgcgttcaaaccgttcttctgcctcagactcctgagtagctaggattacaggtgtgcaccaccactcctggcaattttttttgtgattttagtagagacagaatttcaccatcttggccaggctggtctcgaactcctgaactcagatgattcacccacctcagcctcccaaagtgttgggattacaggtgtgagccaccatgcctggtctgtacatcctaaaaaaccccagtgttctttctgctgactgaggctaattagtgtgggtgataaaaattgggcacacatatcaaacacaaattggctactttgtccagcaaactgcttccaccaaaactccggctagcaatcacattacaatgactacttggctcttttctttccctaaatggatttggttatagaattggaaaaccgggtatactttgttttcaacagattaaatgtaatgggttttatgaagacagtctttatattttcctataaaaaaggtaattagttaagggattttgggggtaggagaatgaggcacacaggggagtactcatttcaggaaaaataatacgtaacaaaatattcacaaatattctgctgtccctcaagctgatgaattaatcttctcgattagttccagataaatcctaccatttaatctattttgaaagaaattagaaggctatggttttaacactatgttcaagttttcgctaacttgtaaaatggtaacatacgtgctgtaaggatgacataagagatggtaaaggaaagcatgcagaaaactgtaaaagcttataggattttaaatataattgtacagtaactaatgatggtgaaataaaatagatgttccttgatttagaacttatggatgtttctgaagactacatagaataaacaatttagatgttcacactctggccttggccttatcaattcgccttcccctccttgctgaccccacccctttaatctaactccccccaaaagtggccacatactgggagtaaagagagtggcaatgaacctggatctacttggggaggaggcctcggctattcaaagagtaagaaaaacacaatgttccaggctcctgattctcaagcaacacagttacttggggtatttctcaccaagtgacctggatttgaggttggcaagtgtcgcacaccccacctttctgggtggcagagccatgtgaggctgttgggctgcacctaccagctaatggctctgtgactctgtgtcacaaaccatttgtttctacatctcctggcatcaggatccaggaaagatgtccacactcattatccataaagggagttgattgcctaagtgatctgcctgcattctacagagtggagaaaaacttattaaagataggtttagtcacaagattgcactgtcagcagtcagactctcctcctttcttgacttttctttccctcatgctctaatagaattgtggctgaactcatctcctacttggattatttgtcttgagttgaaggagccctggaagatctgttctgaaactggatgtgacgttaggaaggcaaaggagatttaaagtgacaaattgctggctcaattctcaggaagaggtgctgcagaggtgatgtgcaaacatttggacttgtaagggtgatgatccaggaatctggggactgggttctttgcctaaatcctcccccaccttcaatgccattgctctatgctacacctgcaacagcttcccatctgcctctgcccaaatagcctccaaagtggaaatgcagttcggtgaaagagagtttcagcataataatccctgggcctttttctatacttaggacagaaacaaagtgaattgccaaggagcagacctctctccctactaatcggtttagagttgtgttgacaaaatagtggcaaaatctccagaagaatctccctatgagcctccctgagcctcccaaactcctgcatcccatgcatgcatagatatctctatcacattcctggcttttgggaaaggaattgcgcatacagcaccaatacttccaaagtatttagaccttcaggctatcactgtcctcaaagtttcaggttccttatccataaaattctgaaactgggccacaggatcttctaagtctgccaacccagccctgagggcccatgaagatctatgctgcttgctttggtgacaaaaataaaaataaaaaacaacagttggggcttgattccccatattaaatatatgccaagtatatactaagtatatgttaagtacaatgctaagtattatcttgttccattcttactgcaatcctataaagtcattcttgttatcacacccatctgacagatgagaaagcagatctagacaggtcacatacctaatacaaggtcatgtgactagcaaactgtggagccaggatgtgcttcactgctttagaagttcgagtgtttaaaatccagaatgttccattccataaaaaaaaagacattctacatttcttatttgtttcgtaggctggcccacaaaaacaaagtattgtttcgtgcctcagcgtaagtctgaaacaagacatgcatggtaaactagtttcttgagccccactgtgcccttctgaccccaggaattctccacagttcaaacctcagactcatgctctgaggcttcaatttcaccacagactagaacttgagctcagattttggagaccagaaacctagcccttctggccctaagaatgacaagcctctccaggagcaaagtcaggaaaaggctgaagacaccagcagccgttgagaaattaatcgagctgcagcagtcattttgctttatagggtatcttttttggcagaatgatcttaaaaatccaggacaaagtatttaaccaaatatgtagagcaaagaactgtgatgagttaccaacacatttctcacactagtaggttaagatgatttacttgatatttagtaataatctatacgtaattgtcctttttatgaggatagggatatttcaaggtgaaaagaggtaagaaaatgtggttgatccctacaattttttggatatagaggaagaaaaacgttcaaggaagttcagagggctgaagataggtggtcttcagctttgcatcttgatttttgcactaactagctccatgacctgggataaaaacaatgataaaaatagtgataataaccttcattcactgaattctatgtgctgagaatttgctaagtgctctatatgtattatttcctttaagatttaaaacaacactataaactggatgttataagtcccatcttagacataaagaaactgaagttgaagttgtgataacttgtccaaggccacaaagctgttagtggctaagttagtattagaacataaatatgaatccaaaacttatcccaactgaatctgaactgattaccttcaggctataactgtcttcaaagtttcaggtttggaaaagcctggagggaactggagactattattctaagggaagtaactcaggaatagaaaaccaaagatcatatgttctcactcataaatgggagctaagctatgaggatgcaaaggcataaaaatgatacaatggattttggggacttggagggaagggtgggagggaagtgagggataaaagactacaaattggggctgggtgcggtggcttacgcctataatcccagcacattgggaggctaaggcaggtggatcacttgaggtccagatatggaaagttccttatccataaaattcttttttaaatttttcatttccataggttttggggaaaacaggtggtacttggtttcatgagtaagttctttagtggtgatttgtgagattttggtgtgcccatcacccaagcagtatatatactgaaccccaatttttttttgagatggagtcttgctctattgcccacgctggagtgcagtggcacaatcgcagctcactgcaacctctgactcctgggttcaagcaattctcctgcctcagcctgcaaagtagctggtattacaggcacctgccaccacaccgggctaatctgtgtgtgtgtgtgtgtgtgtgtgtgtgtgtgtgtgtgtgtgtttagtagagaaggggtttcgccgtgatggccaggctagtcttgaactcctgatctcaagtgatccacctgccttagcctcccagtgtgctgggattacaggtgtgagccactgcacccagccccaatttgtagtcttttatccctcacttccctcctacccttccctccaagtccctaaaatccattgtatcatttttatgcctttgcatcctcatagcttagctcccatttatgagtgagaacatatgatctttggttttctattcctgagttacttcccttagaataatagtctccagttccctccaggttgctgcaaatgccattaattcattcctttttatggctgggtagtattccattgtgtgtgtgtgtgtgtgtgtgtgtgtgtatacacacatatatatgatacatatatatcatatatgtgtgtgtatacatatataacatatatatttacacacatatcatatatatgtatatatatctgtataacatatatatcatatatatacatatgtatgatatatatatatataaaacaatttctttatgcacttgttgactgagggcatttgggctgattctatgtttttgcagttgcaaattgtgctgctataaacatgcatgtgcaagtatcttttttctgtaatgacttcttttcctctgggaaaatacccaggagtggaattactggatcaaatggtagttccacttttagttatttaaggaatctccacactgttttccacagtggttgtactcatacattccccccagcagtgaagaagtgttcccttccaaaccacaatgtgataccaccttactcctgcaagaatggccttatccataacattctaaaactaggccacaggatcttgtaagtctgtcaagcaagccctgggagcccatggagatctaaacatttagaagagggaaaaccaatgagacattttcaattcttcctttcttgtagactgtaagcactagcaaaatgaattgaatctgtatacagttactacacactgccaaaatctgattcattttggataagtgatgatttccagaagtacaattctcagctgaccatacgctgctatgttcattcaatttaaaaaccttgagccattctaggttttgaagtccctcaccctgccttgccacacccctgtagcaggaaagaagctttcccaaagaggaggagattttacttcaagagttattacccgcttagttgcacacacattcatcacattctgagcctgattggtggctagagttctcagggggccagcactggctggggaaagtggaaggaagagatatattttaggcacccattgatagctttgctacaaaatgcactacccgggcacaacacactgagttctggcaagtacagcccatgttaaagacaaaatactccactaacttgactttgtctttcttggaccatctcaaatttggggaacctctaggtatctgattgcatatgttcctgtgtgctcctaaaggtgccaggggaagagaaaaacacatggcaatcagttgacttgcaaggcctagttataagccgaaataaagttttaggtacaatccagatgtataatttgctataaaaatggactcggaggaatccttggtgatttcccacaagactgagccactgtcctcctttcaatacgagggggattctgggttttccagacctcactttcttcaggtctgagataagcctgagacatacacaattgctgaaggtaacgtgaagcaggaaaaggaaggccagttgctctattaaaggagcttgtgttttcctctaaccaccacagtctgggcagcagacaattctcctttttctttcagagcaagtaaaatgttctaggtcatgtttaggttgtgacaggcacccggatcaacaagacgtcatttaccaagataagctggaggtcaacatctccttatgaaagggctccaggagctgttgcataaatgcaaaataacagatgcacaatatttgagtcctttagtatatctcataaactttaataatgtgataatattcaaacacatggtagtgttttaatggtaactacagaagagcccctggaaaatctgacaaatgctgtcataactggcccttcagagatgtccttccagctagtccatatttgcccttttaattagagttttagtccacttgttccttcttgaaggaaataaggaggctgttggaatagcaattttcaatatccagattccagacacatcaccctgttatagacagaactcaaatccaaggcatttctggaatccctatgttaattaccacattatcaagtcctggaaggactgtcgcataaggattctgagtaacttgattctcctaatgaacctgagccacccagacgatggaatgaacagcctgtagccagtctgggctgctgcctctcacccccgcagtctcagagctttggcctctcctgggtttggcacatggcctgtcctttcccattgtcagcctccttttcagcgcggtttggcatcctcttcaacatgaactgcctagagtctcgtcgtgccccttttcttgacccagccactgcctcatgtgctgccgtgtctgctcactgatcacctccactgtcttctaatctgttggtactgcattgttttacctgggtttgcaactggggctctgagatccccaacgctagctgttttctgggctcagcgatgctcacctagacctcatgcgcccgccagagatgaacccaggtggaatccctttgcctatttttgtcaggtgaacatggacttccgcttttgagaatcttccacctacccaccccatccatttgacactaacatgtttaggtcagtgcttctaaactttagagtgcatctgcatcacttaagaattttgttaaaatgaggattctgactcagtaggtctggtgtggggcttcaaattctgcatttctaacaacttcccaggtgatagccattctgctggtccatggattgcatttgagtagcaaggctctaggaaacagccttgtcctattcatctttgctggcctgcaatttccacagcagtttcactgccaccacttgggaagccccttctagtggtgtgaagcagtgaagacagaaggatgaccatgacacagtccctgctccccagggttcatagcctggagcagttttcgagttcagcactggatgttgagggctgataatatttagttgtgagggaagtcaggtgaaatgtaggttatttagcagcatccctaacctctacccactaggtatcaatagcatcttcccagttttgacaatcaaaagtgtctctagacattgccagatagttaagaatcaccggtatagggagggagacaaatatataaattaataactgagaggatggatcaagttatagaagctatgtatacactattcaggaaaagggattattaatatttcagaggctgtgataagcatttgacacagtgtgtgctcaataagtttgttagatacacaaatgcactgtgatgtccccacacttcctataacagtttacctttctgactgtctaatagaaaagacagttttacattccaaagattagcatctacttcactgacataattcactttcatggacatgtttgccaagtgtattacaagagaaagaagcctccttattttttaggataatgaagatagagtatagacatttgtaagaaaataagacacttaaaataaatatattttgtgaaacagaccgtttgtactgcttttttgacattatatgcacattcctatcagacaacaactaagaggagcattgtacatattacttggtaaatgaattcaagcaggatggtgcattttgttgcttggcacatcttaaatgcatgctcctaagcagctgtttcttttcccttacaggttttgggaggatgaatgtatttccaaggaactgtctattctgggatgctcatgctcttatacagatgcatttgacatctcaccatgcatacatagaaaggcaaaccagtaagcagataagcttggggaacccaaataagaggaaaaccagtgagcatccacatttatgaaatggaaaggagatgaggaatgctcatgtcgagcagcagctctaaatctcagccccaaatggcagagctgagaaaagaaataatgtcagcattggacttacataacaagatggcaagttgaagattttttggttatttatcttaatatagaggcaggaattgagaagggtctgactttgaggcagaacaaaagggctgtgagaatactgaaggtgtaagggcatttaaggataaataaaaaaaggaatggttgtgggggggggcatagcgtggaatatttcagtgcaaactttcagacatgtacttggtaaatgttattatcccttaacattttataaatggaatccaaaataggccaatgggaaacattcttggaaatatataccaactggacaagaatattcacagttgccaaaggaaagtgtgacacttggttctcgtgccaaagtcaacaagcctttgcccaaataatggcaaatcttttcgtttggaacacagtttcttaattaagccccaatgtcaattactgcacgtaagtagaaatcagcagatctgaagtcaaggccaggctccacggctggttggccaggtgaagtaacatttgtgctccaattttcctatccagggaatggggaaggtaatactttccaccaatctatgctgaaggaatattgtgatgagtcagagaataaatctctgattttttttgtttgcttaatgaagagtatcactgcatttactatagtaaaggcttgttctgttttagtccataagttgaaaaaaatcaatatatagcattcatatatccaaaatattcacaagaaaggtcttcaagaaatatttgctcatccatgttcatagcagcactgtccacaatagccaagaggtgaaagcaaacaagtgtcagtaaacagataaacagatgactggctaaagaaaatgtgatatacacacacacacacacacacacacaaacacatacacacacacacaccaatataacagaatgttattcagccttaaaaaaggaagaaatccctgtcacatggtacacggttgaactttggagacattgtgctaagtgaaacatagtagtcacataaaggcaagtatgattgcatgatatgaagtatctgaagtagtaaaattaatagaaagcaaaatggtagttatcaggggctgggagaaggggaaaaggggagttgtttaatgggtacagtgttttaattttgtaagacaaaaaagttctggagatctgttccgcaatgatgtgaatatacttaacactattgaactgtacacttaagatggtcaggatagtaaattttatattttttactacaatgaagtttttaaaaagatataaataattcagcgaaaggaaacaaaagcctcaaaataacatcccattttggttttagcattagaatttggctaaaggggtacagtctctgatgagacttctttacataagtagccaagctcctggttaccagaggtgtgtctggtcagtaacacactttgttcacagacaggaaccaagagtgcaagtgtcccccattctatctagtttgtgcctttcaatggcataggatagcagcaaaggcatcataaccttccagggggaaatggatagttagtacttaattctatgtaggctgccctatacaggaagcactgatttttgatcatgtaacattctaaatagccacaaatgaaaataattgccagttctgcatcatgaagagcaggagaagaagacctgctaaaagagtcagaaaaataaataaataaatgaaatactgagataatatgaaatggaatgaaataaaataatataaataaaagtaaacaaacacttttcaagcaagttttgtttctcaagcctaagaaaccccattttggcccaatatacagactactagagaatttcttgtccttaaagcaccaagtgcttagtgtggcatctgctttttgctaatttctgaggagaaggtgcctcatgattcgtggcagtgacattatctttcctattatgaataaaaaaccttgaatcaaattggagtgatataaacttaataggatagagccttcagatctgcattctcagccaatcactactttactgggttatcctgggcaaaactgtacttcatttgttttttctgcaaaggtagacacttttcagatctgattcgagggacagcaaaggtggagtagaaaggtcactggatatgctgatacaacatgctacagaaagtaaccaaagacttcgtggtttgagggaacctgggccatttctgctaggcagtaaatgacaggaagaagcttggaaggttttctcttaagtgatgtttaaggctctgagctaccaagacttctgggaatcaccaccaatatcatagtgctatactttactcagtaagcagaaggaatttctctgttggaaaaaaaaatcaaacaaaataaaaacaaacctctaaaggtgtattgggctcgcagttatttccaataggggctcagtcctatgggggaaagggagtcaggtagacgccatggagatcagacacctggctgattagctccactgagaacgctgcaaagggcaaaactttgtcatcccatctctttgtagaagcatcttctctggaggcttttaaaaataggacttgctctcagcatttagagaagacagagcataaatcttcctggggaggagtggaagaaataaccttgcaaaatatttgggggactgggtcctgtggacagttggtctccatagttaactggagatgttgaaattgcattcatgcaacctaaaatgcttagacatggtgaaataactagttgaaccaattattttgcagtgaaaaaaaaagcttcaccagtgaaatccaacctgttttgttattgttgatgtttcattatttttactgcatttagcttttgaggggacacataccaaggtgacagtgctttaggtaaattttgtttattccttatttatcttcttattcaagaggtatttctaatattttaggcaggagctgcattttcaacacaggaataaagtttgtagatatttattgcagcttcctgttgctgctatctctacagtaatcatcatagcttcttccctagggaaagagtgcttcaggctttggaaggcgcacagataaaaaggatacgtgtttttggctggagctacctgattctatgatctccctaaaattggttactgaaatattctcaaatgtctaagcaggtcatattgtgtaaatgaatgatctcctgaatattttacttttttttttttttttttttgtgagacggagtctcgctctgttgcccaggctggagtgcaatggtgcaatcttggctgaccataatttctgctcccaggttcaagagattctcctgcctcaccctcccaagtagctgggactacaggtgtgtgccaccatgcccagctaatttttgtattttcagtagagacagggtttcactatgttggccaggctggtctcaaactcctgacctcatgatccgcccgccttggcctcccaaagtgctgggattacaggcgtgagctatcgttcccatcctaaccattttttattgatatataatttacatataataaaatccaacatgtttaaagtgtataattcagtggtttttagtatattcataaggttgtgcaaccatcaccattctctaattccagaacattgtattcagccccaaaagaaaccctgtaccaataaccattcactcctgctttcccttcccctcagcccctggcaatcactagcctactttttatttctgattatttcatataaatggaatcatacaatatgtcaccttttgtgtttggcttctttcacccagcagaatgttttcaagtttattcatgtcatacatgtatctgtactaacatcttccaagtaattactgtgtccaaggtaatgaggtgttgaagcttttcttttcttccagatgtatggagttggtgcagacccagtccagtcttatgacgagccttggatgccatggtcacaggcagcacatttacggtgtagccctaagggttatgggaaacccaagtagttgggttaacccagtgagacatgaaaaactgcccagaacacaagcaagaaacaggtcataattgagaattgaggaaagaaagtgcaagacaaaggtgttcagatacacagttaagatctgagtcctgggtcaggacagaatcaattaagagagaaagaacagtgggtgagaagaggtcagtggccagggatgtacaccaagcagccaaggatctgtagtactcgggtctgtagcagctgccctgactcaggccatgtgacttcagagttctctgtcacagaagcatagaatatttgcactggagaaaaatttagagctatattctttagcaccatggttttgaagatgaacaatctgagctctagaggggctaagagacctcccctcaagctcaccaaccttagtgatcacttccttcatctccctccactcagtagaatacattttccacaatagctcactgccatgggaccacggcatgggatcccaacagatggatctggtcatatgttagtgccaaaatgcagtttagcaaccatttactcacatacccttatactatgtgacaatcagcagaaggtcttagatatttttatattagcttaaaagaaaagtttgatgttctttgacctaatttttattggtttaattgtctaaatacctggagttcctttacattttaaataaatttaatagtatcaatctataggtttagaaactgagagaaataatttttattggttaattgtctaaacacctggggttcctttacattttaagtacattaatagattagtatcaatctataggtttaagaactgaaagaaatgaatgaggtccccaacacgtcagtcaatgggaattagaacagtgatgcccaaaatatgcacataaatatcacgtgatgaccactaaaaaacacttggtgttcaacagaattgtaaaattagtaggtcaaaaggaatgactccaaaacccttcatcatttaacattcaaagctgtaacttttaaatcagtttcttctagcatcattgtatagaaaaaaatcattttttcttcagaaaaaaaattaaaaataaataaattttaaaaatagccttcagattagtcaaaaaattttgatgcattcatatgagaaaatcgaaggcattaatatggcggtatgatgtatgtctactgaactcaaaagtttagtaacatgttgagtgaaataaaaactatagaagaacatttaaaatttgatgtctttatatatcttacaagtgtgtttatttatatttgtgtgtatatacaaagaatatatctggaaggacatccataaagtattgacaattgtatccccaagtagtggaattatataaggatttagtttctataattttttgttgttttgttctctttatcttctatttttttttctggaatgaacatggattacttgcataattaaaatattaaaaatagactttgttttgaatattgtgtttgcaagactggttcattatcagtttctacaacaaatatcattttagaatcgataacaaaaataaaagcaagttgtccttatcatctccacaaactcagaaaatagttctacatcaaatataaaccagtacaaagaggcacttgtgaaaggaaacaaatgtttggggacttgacctactccccttccctcctcccttgcgtctcaaagaggtacagctcattctcactccttttgatttattaaatcaccatcttctccctaggctagacaaaaaattcatggttaggatttaccctcaagcttcaggctgactacattgtatttgaaacaagcaagtcatctctgtcttgttgcaaagtttacaggaacatcacctcaataagcacacttgctgagcttattgttatccacctttacctcataggaaagccctactagtaatggactttgaatcaccttctttgtttattcatgaagttgaaagctacaatagatcatgattattttccaataaaacaaactaccagggtcatcgtgatgcgcaactgtgaggggtactattttcatcataggttatattaatggtgccactttgctcatcacacatctgctaacagtggtccaggaaacttcatcctgtaacattttaatcaaattctgcttttctattcagtatttgactctgaagggcattttctccacaaattataaaagtataaagggttttagataagtacaagtataaatataaataaaatatacaggtataaatatgtatatggaagcaaatttttctatatatcctgtatatttcataagtttctataaggatggacttctgattctaaaccaatgggtcacatacattggaaaatacaagataagattgcataccaagttaatcacataaatagaagcagaagttcctacttttagatttggaaccatggtgtgccagatataatgccaaactttatcaactgtagaaaactatagattagttttaaattgtatattcttttcacagttactcccatgttctagagatcgattgttccagttttttaacagctttatttgatgtatcactgacatataataaactgaacataaagtgttcaatgcgataaatctaatgggttttgaaatacatacacacatatgtatatgtgtgtataaaatatatgtatacatatgctgcatatactacgtatatacacacacacacatatatatgtacctttgccataatcaaggtaataaacgtatccattaccccccaaagttctcttctctagctattccctctccaagtaatcaataattttattgtcactgtggattagtatgaatctccaataattttacacaaatagaataatccattatgtactttggggaggggaaggaggagagtcaggctttcactcagcctaattattttaagagtcatccatgttgtgtgatatataaatagttcattcctttttattgctgagtagtattgctgtgtatggaaatggtataatttgattacttattcacttgctaatagatatctaggttgttttgagttgtacaagtctttgtatagctatatgctttcttttctgttgggtagataccaaggtgtagaatggctggattatatgataagtgtatgtttaacttttaaaaaaacggtctcctaaggtagtcgtaccattttacattccaaccagcagtgtagttgagtttgggttcctccatgtatttataaatatttggtgtggtcaatttttttttaatgagacaggttcttcctatattgcccagactggtcttgaactgctgggttcaagcgaacctcccacctcggcctcccaaaatgttgggattacaggcgtgagtcacagtacctggatatggtcaatttttaattgtagctactctattcagtgtgcattactatttcattggggttaatttacatttccctagtgagtaaatgatgttgagcatatttccatgtgcttatttgttaacatatattttctttagtgaaatatctgctcaaatatttgaccaattttttgctgtgttttcttaattgttaaattttgagcattaattaaatattctgatataaatattttgttagatatactatttgccagtattttctttcagtctagcctgtcttttccttcactgaacaacatatttcagagtaaaaggtttaaatgttatcaatttttaaaaatagataatgttttggataaagaatctaggaaatctttgcctaacctaagttctcaaagactttcttcaccgttttttgaaaaaaatataattgaggttttttattaggtttcagatacatttggaatttgtgcatatagtgtgaagtaatagatcaaaattcattttttatttgctgcatatacaatatttcgggaagcatttgttctgcacagaattgccttgtatttttgttagaataacaacaacaacaaaatccaaaaccagtttattcatatatgtgtggatctatttccatagtttattccattctaatcacttatttctatttttatgccactaccacactagcttggtacctgaaacaataaaataaatcttgaaatcaagtagtgttatccttttgttctttttttccagtggtattttagctattttaggtcctctgtatttatacatgaactttagaaaaagcttgaaaaatttacaccaaaaaaaaaatgcttattgggattttcactggaattacattgaatctctagatcaatttgggaagaacgattatcttaaaaatatgatgttttctgacctgtgaaaggcatatctgtctatttatttaggttttctttaattactctcaggaatgtttttaattttcagtgtacaagtcttgcccatcttttggtcagatttatccccaagtattttatatttttgatgacattgtaaatggtactgtttttctaatatcagtttgcatttgtttctcgtatttagaaatacaattaatttctgcatattaatcttgtaccctgcaaacttgttaaactcccttactagttttagtggttttacagatttttatcagatttttatataaataatcatgttgtctacgaatacagaggttcatttctgtctttccaatctggatgtaattttttttcttgctttattgcactggctagcacctccagtacaacgttgaataaaagtggtgagagccaagacatccttgctttattcccaatattaggagagaagcattcagtctttcattgttaagtatgatgttaattttagttttttcatgtatgtcctttattaggttgaagaagttcccactattcctaatatttctgagggttcttaacatcagggacagatgttgggtttagttgattgccttttcaatatctattgagatgatcatatgttttcccttttctagttcgtcagtatggtggttatcaatacagtaatatggttaacattttattattattaatgctgaattgcaaaacgtaatttctagaaaaatggaaggttagtcacagttgtgcctcaatgatactagattagagtgagtaaggtaaataaccattttctttcctaagaatttttttttttttttttggaatttcagttggctatccctgttacaactgcttttgtatctatatttgctacatccaactgggttagtattgaactagcgtttaaaaagggaaaaagaacagtgaattttaaagttggtatgtaacttaaaatgtgaccccaaatcatgatccctgcttgaagaattggtcaaaataaataaaaatggatcacatgctctttaatgtcactgtcttgtctgaaatcaaaccttcaggaatatttatctgaagtcttttcatgtagctaaagtgcaatcatcttggagacttattttccagtaacatgtcccagagatagaaatttatctaaatgttatctaagttctttatagcctttggcacatggtgataatgtattaagaaacaaaagggggaaaatactcaaaagcttcttgcaatgagaacatttgtcactggtatgtgtcatgaaacggacctgggcatgcaaccaagttaagtaattacactggtctcaggccaatttaaattgtgtgctatagaccttctatgtagaaaatagtccataggttctgcatacaagcatcacatgcaaaaaaacgtgatatgaaagtcttttgttccccaagaaggacctgaatgtctgtctgtcgacaagacaacctctgtgggtacctcactgacatagtatacatggtgaaaaagaaagtgtcaattggttgtgatcatgatcagtaaaaacctatttggtttataagcctggatccaatcacactgatatcattctggactcaactgtcctttgtggttcaaggacataagaaaactgaagagaaggcttgcaacttggatgttgaaaagaaatttattgaaaggaacaccacttgaataacttttactacctccaaaaagcagtatgttctctctactggaaaagacctaaatacactcaaaaagcttactggaggattttttcctattaatttgaacgtcgtataggaacacaaaatttggttaaatatttgatagataagtttggtattaaaaagtccacttggttcattataaatattaaaattaggaacatgtgttctttgtttaagcctgataaagctttagctgagatcatgagttttcataaaacaacttttcacaacacaataatgtattaggtcagggtctactgccctcctgcagattttgcctgatagtattttcatacaaacctcatcactcctgctttttctcagatcttctctgagcttatttcctaatgcaaatcttgatttatatcagggccctaacgtggctgtccaaaatacctccctcccccaatttgtgttttatctcaatacattacccagtggtggcccagcatctcagagtgcccaacatgtaatcttagtctcatagggataaaggaaagcaaccatacctcagggcattcatcatccctgaaagtccctctccctgtcttaccatgctttatgtcatcatctggctcatttatttatttataaatagccctccactcaaataacactcctgaagggtggggaatttttctactttgttcactcatacggagtaagtgctcaaaaattgtgttaaactaatagcattcagttttagtaggattagttgcattaaaaatacatctcctagaattaagattgcataatatgttactgaatagttcggcttctttgaaggtatccttggcagagacaaggttagttctccctgactcaagcagagatactgttttctcaattctcttgttcgactaactcctctctgttatttattactggagacagacagtatccatcacttctcagattgatgcaaggcagtggtaataaaataagctacatacatcatgtaatcatattggttttatgaatcatatttttctgaattagggaaaatagttgttttggtttaagctggagaaaaattctgactcatgtcaacaaatcactgacaaggcaagcactgataaaaataaaaagcttaaagcaagttttattagagaaaacttgcaacaactctacacaaacattgattaattataggctcacttggtcttctttaaaatgaaaatacttttaaagacatgactgtatgtcaacaactaaagaacaggatatataactagaaaaataggaatatttatttaaaatgttatactgcattgtgcttttttttaaagataaaagctatttaaaaatgaagcaagctcaatttgtaattaggacacacaattcctcaaactctgtaagtctattaccttaagttgcccttacttaaaaaatttattcttatctgaaaattatggcaatgtttaaaatgtttaaagaaaacagtaaatttgtgttatgtccccaatttttgaaatttacattttattttcatcatactgaaaacctgatgctgaccttggcttcactcctcgaggtggtatgtagagttctgtgaggtcattgctgtggatattcagcatgcactaacagtgcagatttcctggtgggtcagggctgagaggattggagagcaacactgaagtgtataacaagagaccagtgcaagctttgatttgaaagaaggcactaaatatggattcacggcaacaagtactatcacatggaacacttaattatttttctttctctctttacatcttaagcaggcaaagtcaacttgctggaactgggctaagtttgggagtggtaaaaacaaaaagtcataatcatccagtgatttttaaaattctggtgtgcgtcagaatttcctagaggaatggttcaaaatatgattatctgagcctcatctcaaaactacctaattagagcctctcctgaaagaggctgggcatctgtcttttaaaaacctcattccaggatattgttctacttaacactattcaagagctgttagttttgactcacacttactatgtaccaaggatcatactaaatcacttcaatgtactacattaactaatgatcctacaattctaggattttggtattatttttatatctattttacagaaaagaaaaaaaaactttataacatttccaaagccatgtgaccagtaagtgatgaaaccagaatcacctgacttcaaatcacacacttaactcttatacaaactgcctccaaccatatggagtatagtgccccctataaatgtagaccgttgctgtctaagtagaacctagagatattttacaaaattcagtcccaaaatagtgctactatttttatttactaactgcaattgatgaggaaagtatatgcattgaaattcagtctttaggactccggaagttacacaaggctctatcagacgaaagcctaccagctatatcaagtgcctactgtgtgcaacgcttaggaaagttattctctggaagttgttcttttttttccctcaacttttcaatacaatgtttgagggtaaaattgctatctggggcaaagaatttctgcagatgttactgttactagaatgtgaacaatgattctatggatttgccactgctataaatacaccaactggaaagctttcaactcccaggaaacaggatttggaaagtgagacaggaatacccagctgagaaggtaatttaggtagacacaatgagaaagccttaattcctggcatatttctgttaacaggcagtgtgggaatggctttatttcacctctgagagaaatccaagcgatggattgttttatgagatgcgtgtgatcacaatgagaatttccagtttcctaaatagaacacttaacaagtgttcgtgaagcttccagcaggtcacaccattttaaatgcagcacacatagctcaacactgactctctttaattttgctttctttcactattcttggaggtacaggactaaggaacccactatgcctcacttaatatcatcagggtttttagtcttctcactggttttctgaagcatggatttttgcagttcctagtcaattaattcttggagcttcctttgtcacctggttgatccagctttggtagcactgaatttctctctagaccatgtgttctttatcagagacgttcaaaacacgttttctgaacaaatgattaagtgaatgaaagagtagatgcctcactaagcagcacatctcatactcccatatattatatatgagcagttccgcctgtcacaaagctcctccttatgttaggcatgacagtaacacgaagtcttcatttgactttcctccattagccatcattctgcctttggagagctctgcaaacaattcttccccaggacaaccattttagtagctgaaagaagttattatgaactcccaagtcctaattattcttccactttcttatcaatttcttaaataatatgacctctagatatatcacaattttgctcctccttctgtggagagagcttaccaatgtcgttattaaaaagtggcactaaaaactgaacacaatattgctgatgtgaacaagtggatggttctgcatcttaaatggggattatggcacctcccttttaaagctgttacatggaaatagaatgatggtcaaatgccaagggcacaacaatttaagagatgggactcaataaatattggtatttgtctcatgtcatcattatcatcattaccatcaccatcatcttcatattacctaagtctctcacagcctgtatagttgcaggtgttttttatttaatgtaagtgccacatactacatttgtaaatacacatacattgtttttccctttcagaaaaatttcaatacttattcttttttttcaatgcaaaaataaacatccgatgttttcattaaaatatagattaaatattagccagggaacaggggtcaaccttgtcctccaacatgacattattctccaaaccattatgtccactgcccttagttgctggtacagtttacctggcattagctgatggacttctgaaaatataatttacttttaatgagttgtgtgtgtttcatgttgtggataaccctaaacaaataaatgtaaaactacaatttgatgtccaaaaataaggaagaatgggatttgcctaaaatcagacgtttattaaataacaaggaaatagctttcagctatattaggtatcttaaaactcttaacattgttttgaattcactttgatgcgtgtctcactgttaagaaaagtgttaagacaagtgaagaatggtttgatgttaaatggatcatggaacacaggagatcatatttaaaagggaggttttcctccattttcaatatttcctaaacttaatctcttaagagtcttctcaaaagaacaatttatgaactctttaatggaaatgcattaaaataaaatgtggccgacctcttctttccttgtagcctcagaacactctatcagtcactactcagaacaaattagccaatttggctgtgagttacccacagtttttatcccttcactccaatagcctggatccctggactgcccactctaaccatgcaggcgggggattgtgtgtgagaaggagccatgcaagccacagggaagaggctgtaaactccctgaattgggagctaaaaaccctttgttcgatttggctctgtatatttttcaagatcatacatctacttatgatgccaatgaatcaatttcctcatctacaaattaaaggggatatgagacatctttatttgcaaagtctttctgtcgtacaaatccaacagctgtatattttccttttcacataatgactttagcatctcatggacaaacatctgttaaggaatgtaattgttttttctgaaatctcggtgtatggtttgcacaagtaaattaagacatttataaccagtataaccatgtatatcatttctaactgggattatatttttcagaaaagaaactaaacctcaagatttgcatgctaaggcagacagtgatctataaacagacccgaaggctctcagtaacgcatggggtctgtgggtccttactatctgtattagtctgttctcatgctactaataaagacatacccgagactgggtaatttacaaagaaaagaggtttaattgactcacagttctgcagggctgtggaggccttaggaaacttataatcatggcagaaagggacgcaaatacatccttcttcacatggtggcataaaggagaagtgccgagtaaaagcgggaaaagccccttataaaaccatcagatcttgtgagaactcactatcacaagaacagcatggaggtagccacccccatgattcaattacctcccactgagtccctcccatgacacgtggggactatgggaactacaattcaagataagatttgggtgggaacacaaccaagccgtatcaccatccatgtaacaaatcacctgagatactagtatgtaaagtattttccactcatttaatcaattcacaagcatttattaaacctctactgtctgattcaactaagaaattctgctgtcactcattagtcaacttagggtatgctggtgaatctctaagcaaatggaaaggcctatgatgactctcactagaattgacatagcaattattcacaaagttcacatatttttagcagtaagtcagtttctttgaccttttttacccatattatactgcactggatgagcttaagaaaagattatatcagtaataattttaggaaggctgctgtgtggttttgcatagtaagaaacgagttttccaggtatccctgggttcatcagctaaacttcttgaatcagaaaactaatttattaacctttctttttttcattccatggaaccaccccaatatcttcaactcagtaggtaatccatatataatttttgaaggaaaaggacaccataattttctcacatttaatgccttcacaagctgggcagtgtggttcacacctgtaatcccagtgctttgggaggccatggtaggaggattgcttgaggccaggagttcaaggccagctgggctacatagagagacctcatctctacaaaaggttaaaaaaaaaaaaaaaaaaaaaaaaattagatgggcatggtggtgcacacctttagtaccagcaagtcaggagtccgaggcaggagggtcacttgagctcaggagtctgatgctgcagggagctgtgatgacatcactgcatttcagcctgggtgacagaccaagaccctatctctaaaaataatgataatgataataacaaaaataataatgccttcacaagtatctataaaaccaagtttgaacactaccaatttaataagaaataagatgattataataaatgccacttatatagtgcctaccaccatttattgggtaacacacacacacacacacacacacacacaccacacacaccccacacacagaatctcatttaatccttagagcaactctctctggtaggttttataattcatatttaaagataaatagagacatatttagcgttgttcagaaaagaagaggcatattccatttcatttttgctaaaattttagttcaataatttttataatttaaaattgaaggattatataacacttaaactaatgatggacagagattactgacagaaggtaggagcatttacagaaatattcttatttgtaaagcaacatcacataggcaactataatgcttttgttctcgagcttccagtgtctttatcatagaaaaattacaagattgataataatttttcttaaatggctgtgaagactgacatccattgcagtgtttccttgataaataatcatcctggattctgtcaatatttccctttcataatttgatatacaaatggatgtaacttaagactttaagacactattactgtccataaaaagctcacaggtcttgcaaatagaattgtcatgtctgaatctcaaattatttcttcacctggtttttaaaaaaggtcaatttccttagctaaaaataactgagtgattaatctattcaacataaaacaaatctggattctgacttacttgcccatcctaacttcttttttcaatccccaatttaaatttctattaacactcattccgtaaatatttgtctggcaaaattcaagtaccaggaaacagcataatgcaaaattaacagagtagcactataaagaagcatatgacccaaacagctgcaactcaatgattatctgtcccaatgcccagttcctaaggggggaaatacaacaaaaacaaaccctcctacccaaacggcttccgagagtgtttaactagatcctaaatccattgctgagatttagaaatatttttaaatgtttaagggatatgaagtgatgccagaaaactcagtctcttatcaaggtatctatttcacttatgaatagataggaaactagtatgagaaaggtgtttcaggagtttaattgtaaaaaaattataagaattttttaaagtctgtacaaaattttgcttatttccgtgcatacttaacttataaatagagttactatgccatttatattccaaattgcaatgcttagcaagttaaaggtggggggggggctgttaacaattacagtatgtgtaaaccaagattgtctcatgaaaaatgcggcatatagtcaccctacttataaataaatttatgtaaaaaggtgatggagatattctaaacagaaatccacgagattgaaatatgatgaggtaaaaggaattagtgaagagcttttaacttttagatcgatactgggttaaaagtagaggtagcatgaattgatactctaagtgagaaggtaagaagggcttacatttttaaagaggggaaacgctcacaaaagtcaaggagtgggaattatacctggttttgaacagacaactataaaatggggttcaaataaagatggggctatttcagaggcacttcctaaaccaacatggcaagattatttaaatttcctgttgtacacttaaacaggatcaaacattccatttctttcctaactcagaagtattcttccccttgttatcactacgaagggaaatgtcatagattcctgctctaaatatgattcaaagtgaagtagctcatttgtttattaaaaatgtagggttttagtctccacaaagtggcaattttgttcatccactggggagaattaagttattagtttctctccctctctcccttcctttcccttcccttccttcttccctccctgtctttctctctctcttttattcagaggcatcaatgtctcaaatcttaagtttatcaggaacatactacttttgattccccacaaaggttgcatcttgacaagttcttggttgaactagaaatgtcgcagtagcatgttttgctattaaagcacacctggaggaaaagaacatcctctgatggtgcagctgtttccagatgacctccttgcagtgcaacaaccaaatgactgcaaagatgatgtggctgagatatggccctggatctctcctctccatgtgcccttctgtatcctaacagcacttccacactctcttctccaaggaatccccaccacatcccttctcactctttccttaataatgatccaatttatttatgtgaaggcccacttcctccccacagacagagtctgtagagaaaaaaaaaaactacaattaattccttatagggaaaacaacttgtattttctcttttatgaccagaaaaatagcagacagttttccttgtgaggcttcagattgatgctcaatgatgtagaaagagcataactctgccagccctagtaagtgccatgaaaatacttgaccttttgaggtagggcaggaagagaatgtttcttgagagggctgccaggcccctgaaaccaggaaaaagtcccagcctggcccagggagctgcttttcccttgcaaaccagtggagcagataaataactgggctaatgatatccctgagaaaggctaggcataatgactacattttctagaaactcattattcaatttatgagcaacctaagcatataagaaggctgcaccttttcatattttgtatctcattgttatattacatgttatattataataccattaaaaaattgggtcagtttctttcagatccagtcttaaaacctgaatcaatataataggtgtttgatttcagtcataaaaaataagcatctcttgggccgggcgcacgcctgtaatctcagcactttgggaggccaagacgggtggatcacaaggtcaggagatggagaccatgccggctaacatggtgaaaccctgtctctactaaaaatacaaaaaaaaaaaaaaaaaaaaaaaaaaagtagctgagcgtggtggcaggtgcctgtagtcccagctacttgggactgatattcgatatttctttaagtttcactatcctttataggttacctagaatgggtaaaaaggtaaaatgcacattaatgtacacatgagagttcactgctgggcctccataatgtcaagaagcatgagctgccttcttcacacgcccacagggaaagtcagcaactcacctgtcctgagctgactgacaagcagatctactgcaccttctatcagcagctgtgcaatctgtacagtggtgaaactgaggatatcttgtctggatttttcagacaggcctaggtagcaaaactataggactcactcatttgcaccagcctcttcgaactcagagctagggaccgcagcgtggaaaaggctactggggtgcctgcccatactctctgttttctgtttaccccttattttgtacttgtctttgcctgtgctgctaaacctcctacttttggtacagtgcactatgtaaatcaagagaacagatctcctggccaagaccacctcataatatagattagaggaaagatcaaaaatagtcatagcttttgaaaccacagtgcttctatttgaaaggctccaataagcagcagggaagagataaaaaaaaaaatggtgaagaaagggaacatcagagagttatcttactgttaaaaacctttcttctctgccttggtcttttcttgtcacagcccactcattttgcttccccaccttccttcttaactatcctcttcctctctttctctttctaactttcgaactgccaagagttaaaggaaaaggtggtccccttgtccaaaatgaagagatgaaacaaatttctggtactgatcaatggttatggtcatcactactatgggctactaatggttcttgacagcctagtaatgacttgcatatttaaagaggactcctttcagtcacttccaggagggcctgtgttttaagtattctcttaatctaatctgtttgatccatttaaattgacgatgtaaatttaaagatgattgtgtggaaacaagagaaggatcctaaccagactgcagaggtattgatcccaaggtcagggctcattagtagaaattgctaatggtccaagtaatcttccaagctcactgtacaatattaggtcctccataggaaacaaaacattacttttgtgtaaaacaacttgtaacaacaatagtaatacaatatacctattttaaaaagaaaagaaactacttacaattctactactgtcttaaattatataattttaatttattccctttcaatctttctcatatgcatgttatacatttgaaacctataatgcacaaataattgtatgccctgctccttcttaaatgataattacatttctaatttgatagtcttcatagtttttaaaagttgcatgattccattgaatgacatacaattcacatgaacattccactgttacaatactggacctttgaattgttttgaaagaactctgtgaagtatgtttgtgcatatgacattttaacatttcacattattcccctagaataaagtcccaaaagaggcattatgtgtcaaaggaaataactgtttcatgacacttaatacatgttgccaaatttcgcagcatagctttttaaaaaacgttgtgagcatgttctttctgcaaatcactttgctagactgtgaggcacaaatgaatgagtttaaaatacagtgcttcaccgtggaatactatgcaaccataaaaaaaaacatgttctttgcagcaacatggatgcagctggaggtcattatcttcagtgaattaatgcaggaacagaaaatcaaatactgcatgttatcacatataactaggagctaaacattgggtacacatggacataaagatgagaataatacgacactggggactccaaaaggagggagggagaaaagggctgaacaactacctattggatactatggtccctacctgggtgatgggatcagtcataccccaaaccttagcatcatgcaatatacccatgtaacaaacctgcacatgtaccccatgaatctaaaataaaagctgaaattatttaataaataagtaaataaatacatgcagaaataaaactgaaaaaaaaatacagtatttgccctgaaaatcatataatacagttggggaaataagacatacacatgtgaaaagagaactaacaataccaaccacaggaattcagagaagaaagaaaaagagcatatttagcagaagagggtaaagagttagacttttgggatattctgaggtttggatgagttgaggtagaaactattcaggtcgataaatagagtaaaaagaaaagaaattaaccattccaaggaattttctgtgacttaaaagcactatgtgattaaatttaatgtattatcctggtccacatagactccccaaggatctttccattattagtaatagttattctttcacctttgtccttgaaacatcgacttcccccgttccatttgatgtgatactgtggaggtttatctcctctgcctctaatcagtccttaacttctttcttttaaattcatcttcctccaaccaccaccatgagaacatttctcaaagttctcctgcagttttctccttctttatatatttctgtaggtaatgtcacctgatgacttagctcttgtcattacttcttgctgcgaatcccccaatctctattttcagctctcaattctcatttttgttcgcatacatacattttccactgcctcttacagcagtttaaactagatatcccaaactgaactctttctgtggtctctagataatctgaaagcaccacagttcgcaagcgtgtcatctttcaggtctctttcatcttcatagctcacactgaatcagtttccaaatttggtcccagcttcccagtgacttccaatttcctcctattgtaggtgatcaaaatctcccacctggactattgcaagggctcccccatctgatctgcttgcctccagcttcagccccttcaatctgtggtctacaccattaccagttgccttttaagagcacagagtagattatgtcacttgtctgcccaaggacttccagcaactctagaaaaccagcaaagcccaatccagacacattaatgtatccctcctggtcccttatggtttcaactcacactacttctctattttcatctcctcacactacaacctcacacacacacacacacacacacacacacacacacacacacgcactggactatttaaaattcactgaaaacagacaaactttcactcggccaaacctttattcctgcagtttcccttgaatgaatactctcatattctctggcccattgaaaccttacgcaaccgttaggtccaaccaaatgttatcagttccaacaatccttcccagacctctgtctccacaatctgaagtactattaacttcctgtattttacagcactgaatggttaattttcttgctgcctgtgcaactacaatgttccctttctggaggccaagttaataaattcaatacatccaagtgtgtttaaattttttaatctctttggccaagggctgaacttcctcttgctgtttgttaaatggctattggaagatctcttgctaaacctgaaagtatttaagatgttcaacagaatcctcattcacagatgtgaggaagaataagagatggaaagagaaaaggatttaagttactaatgatttttctttccaatcagccctatgacgtatcttcaaaaccaggccaagaattctcatcacttgtcatgacgagtcccttagcaaggatagggtgctgcacattcaagttcttgttttaggctcttgctcccatcccaggcccttgcttaggtttaaagtgagagctttaagcagggaagactcccaggttgcaagtattcctcaatcccatcccactgcatgtgatgctgactggagtcctggcacgctgtcacagatcctagcataaaaataacctgaggtaggatagaggggaaagagaggaagggaatttatgaccaaccctccagctttatttatcacttaccctgggaaagtactatgtaataaaaagggggggaaaaacaagacagccaagctatttaaagagcaggagctgaaacttcagaagcataaactaatgtttctaactaaaaacgggtgtggagcttaaaacttttcaaaaagtagatgctagatgcatatcttaataaaaatgaattttaaataatatttttgaatggactatcctacgctatttattaggactaatggttattcccaagacccgttctaacttctgatcattagaaggtaccatatttttccatttgcatagtagaggcaggatgatagtatatgtttttgtctgaagtgagactattaaaggaaacacattaaaatgatgaggataaatggtcatgtgtcatcaaggccagtccttcctgccattctttaagctgaattcccataaaatttagttttacctctttgaaaactatgtgtgttgttggactaaacgtaagaaaagaacaaaaccaaccagtgaataataaaggcaatgtctaaggctgactacatttggtatattaaaataaagtagaaaactggaaatacaagagtagtattcctttatgttttctaattagtcatttctgatgttttccctgaatttacacatcagtccattattccaagcagggacacacacacacccatcaataaattactattataaagagaggtaattgtctatatacaaaataaatatactactagttgcttatagttgcaaaggtaaatgtggaaattctcttcattttaccaattaccagctcataaaggaaaaataaagttaaaatatattctctttttgcacagactgctaaataattgactgatcatgattaatcaagtaaattgaggcattctggaaaaatgacaaatggcaagatttactgcctctggaatctacggcatttgctaaatataacttgcttgtaactacagataaatatctaatctaatacaatcgagttacctgcaaaccagagccacatacaaaattgaatgaataaaaacgtctcaaaagacaataaatactttctttcttccaaatgaaataaaatcttatgataggttttgaggagtacacgtagatgctaggagcatcagctttgcaggcctgcagacaagggttcaaatcttggctctaagcctctgattcctacctaggaaaatgagggtgatattatctatggtatgagattgttataagaatttattgagataattcagtaattgccatatagtgtgctaagcttagtgtctggcacataatacattatcaataaatgtgtcttatcattactattgtcattatttattaccactagtgagaggctagaaagtgaaaagtctaaccaatgcttttaacttcattttctacagaatattcatagaatattcatagaatcataaaacacacacacataatgcctactatatttggtacttgtctgtattcacttctatgacccactttaatgtatatgcaaccctacagtaaagaacactcccgggagaataaaaaagtgccctttatattagcaaaattttatgtgagttaactgcataaaataggatgagttttgtactaaaactcatcaattatttttcattagggtggctttttatttatttattttattttatgtttattttttttttgagacggagtctcgctctgtcgcccaggctagggtgcaatggtgcgatctcggctcactgcaacctctgcctcccgggttcaagcgattctcctgccttagcctaccgagtagctgggattacaggcggccaccactgtgcccatctaatttttgtatttttagtagagacagggttttgccagttggccaggctggttttgaactcctgacctcaggtgatccatcagccttggcctcccaaagtgctgggattacaggcgtgagccaccgtgaccggcctaggatggcttttctaaatattttcgtctatgataatttttctctccatgtatttatttattttcagacagtttgaggttacagtgagctatgatcgcactgtctggagtgcagtggtgtgatcacagttcactgtaacctcaaactccttggctcaagtgatcctcccacctcagcctccctaagtgttgggactataggcatcagccatagtgcctggcagtgagttttctaaacagagatttactaaaaggcttgtgtagtgacttggcaacaccgtaagtattttatttctaaactttgaatgcctttctaaatgtcacaggctaggtctacgtaattccctttacagcaccacatgcaattggctgtttagaaaatgctttttgaggatggtgaagagctctgtttttcattaagtggctttgaactttgagactgcaagtcctgactctggatttaccctttacttcactacataattcaattcaaacagtcaaatgatatcctctttctgcaacatgtgtgtggggggaggacgggggcggggggcggtgtttccccttacttatgtatctttatcccgtgagttcattttaatgaaagaactccagtcttccctcaacttccttattctgaccttgtgctctagtactaagtagtgacgccagggagaaaaaaggctggtgagccaaaaatggcttaggaacataattctctaccaagctgcagaaaataaatgacagggttggctgaaatccaaaggtcaaatatatacaggctttcttatgggaaaggaatgtcaaacctgtttaaaaatcctgtgaagtgagtttataatccctgactaccaaaattaaccatccagctgaatcattttaatatttccgtgaataaagtagattgattagcttttccagagttatgtgttatcagataaacaaaccaatatattttaaataaatccttttgacccaaatggcatggtggagcacaaaatgcttaaaagatgccctctggacctcctaaggtttttcataggaaaagtaaattagctagactattttcctttctgcacaatgcaatacaagctgaaataaaaatgtagctttctcttccttagtcttcttttttaatgcttctgaattatgttagaattttagagcttccaactggattaaaaattgattcagcagaatggtaaattacgaaaaaaaatctcttaacgaaaatacttgttgcactcagttaaaactgtcttttaggccgggtgcggtggctcacgcctataatcccagcactttgggaggccaaggcgggcggatcacgacgtcaggagatcgagaccatcctggctaacacggtgaaacttcgtctctactaaaaatacgaaaaatttgccaggtgtggtggcatgtgcctgtagtcccagttactcgggaggttgaggcaggagaatcccttgaacccgggaggtggaggttgcagtgggccgagatcgcaccactgcactccagcctgggcaagagagcgagactccgtctcaaaaaaaaaaaaaaaagaaaagaaaaaaaaaaagaaaaaagtgtcttttattcccaagctagcataagaatgttgaggtaaccaatgttattggggaaaaatctgaattctattcattttattcaagacctaggtatcccattgagcttattctactttgtggtagaaaatatatatatttttctaactctcatatcttcttaatagtataaacaagaataaataaaacaatttcaattttaagagtctccttatcattattgtagcataccatcacttgtcccctattagtttggagtcagtaatcatcacacaaaaaatatcaatatgggctgggcgcagtagctcacgccagtaatcccagcactttgggagctaaggcgggtggatctcttgaggtcaggggtttgagaccagccggaccaacatggtgaaaccctgtttgtactaaaaatacaaaattagccggacatggtggtgcacacctgtaatctcagctacttgggaggctgaggcaggcgaatcacttgaacctgggtgacagaggttgcagtgagccgagatggcaccattgcattcagcctgggcaacaagagagaaactccatctcaaaaacaacaacaacaaaaaaacaatcaatatgcattatcatgtatatccattttgttgcaacatcatcaacatatctatagaaacataagtgttagaattagctaaaaggagccttagagactatccacctgccttgtttctgaagtaaataaaatgaggtttagagaagttagtgattttctctgcattccagtccaatgtgatgttatcaatggaggaaagaaaaagtaccatgtactgaatattgtattaggcttttgatgacttttagcccagtcaaatactcaacgatttaataccaaaggcataaccatttcagttttatatagacatgacttaagtgtagtttaaggccatatatctggacaatgacaatattttttacagccaatgcatatttttgaaatcacactagaaaatgaaatgtattaatacaatttggataatatatatgtgcattaaaattcttaaaagcttattttattggtaccagtaataaaatcattatctgtgattctaccctggagaaggaagaagggtatgtcctgcaatgcactaaaagggcaggaatcatgcccttaaaatgtcctgaaaacatttttttcagccataaatatgaataaccaaagttgagggttacgcactaatggcaaaattatcagatcattgatcaaatgacgtgctattttcaggcaggcaataccataatagcaaagcaaagagaaatctaatttgcatctgggacatttaaaataaatatattaaagaagaactgttgagccagtccctcggccatactgctctcattctcagcctaaaactagtccctcagcctttagggggtgagggggcagcagtaggcttcatgtcacctaccactgtccttgtcttccccctaacctgtaccaaggccttcagtaaattcggtcatccctgctttagccaaaaagccaaaaactctactgatatcaactcatggatctcattctccaaagaggtcattagtgctcccattttgtaaacagtcatattgtgaatcccaaatgaatttcctgctaagataaatagatatagggaaatagttttggatatggatatgatatagatatacaatatccgtatattattttcctacaattatcatactacaactggctttcttttctatcattttagaaatttaaataatgtaaagacaaagcaaatagatgtatgcccataaagtttagcaatgtgctcatatatttttctaatttcctagaatatcaaaatatgaagaagcactgaaagaagaaacatctaccatatattgatgtatttcaaattcagatatggcttcatctggaaagcacactccctgtaattaagcaaaagtggttagtctataaccataattaaatttatattgtgttgtcaagttaaaactgtgaatactgtgtacaaccaggaaaactggatgggaatgactgacttaataaactaacttcttttaagaaatacaatgaacatagcttcctttcccttaattgtatttttaaaaatcatgtgaataatacaaaaatatctatgctacaatatgacagccctaaaagaacagaaatgggtgttttccatggcccacagggccagtctaggaacagccctttgctacaaactacatagatcatgaaactgacaagtgattgaaataaggtaatccttttattaacaggaaatgaatgtgttttgaggctctgcctttgtcatgattatctggctctatgtgaatacaggctctttgggaacctgatccaatttatatcagtggaatgagcctatcagagaaattcaagaaagagataagtgaattaagtttagaaagcactacactgctagttggtatatgaaccaagtactagaaagtcagtggggagaaaggaaaagtccatgaagtgggtaatgctagagctacacctcaaacaagttggtatttacaaggcagacaagatagggtggcatagttccttatgatgtcatgccatgacttaaaaacgaaatccctgccagtggtgaagagcaaatggctgttctctacaatgctccattcccctctaatctcaaggatgaatttggccatcctaattccactttatgtggtaccttaaagacatctgagcatcactggtacagcaactatcatattgcattgtaattgcctgtccttcacttgaaggtgggaaacatatttatatcacactgtaccaatgtccagtatatcttatacactcaaatgagtaaacaaattaatgaatgaataaggatttaaccaagacaacaaaggccttgcaggggcctctcttgtctgcaattcatcataatgtccactaaaaatctcagaatatccattttatacatggtcaggcctcggtactcctgagaggcctaaactagtacagagggctcctcaagagttccagataaatcttatttaaccataaggctcttttctgaaaaaatagtgtcacatcccttagggaagttatctaaactgaccttttcccctgggaatcctccagtcattggtctaggcttcatttctgaagatgctatgataggctatcatagatatagactgttaagttcactttcgttcacaaaaatacaggcatgaacctctgtgtactgccagcatgttccgctttaggatgccttaatatttttattcatgttttcttttttcatgaaaaaaataataaagtccatggtaatattatagactgtggtgtcagagatgtcacatggaatcttgactctgccactttctgtttaactctgggtgaattaactccctgagccacagtttcctaacctggaaaatggggataataatgcttactttatagaggtggtgaatataaaataagatgcacctggcataatgtaccaaattgatattcagtaactagcatccttaaagatgcctaagaagatatgaacctctttgtaatgcacttctagaagccaaccaatttttctcaacatggttggaaacaaggcaaatgttgcttctttttacatataagcatgataattgtgtaagcgttttaactaatgtgctgaccatagtttacagtgctgtgtaagttcaaaaatgtcaaacacattttttaagaatgggggaagtaaatacattcactgttttgaaatggtattttgatatttatacatcaaatgtagtattttcttaggtataaaattttagtatgtttatgcatcatcataaacagtgatattgttttgtaaatatcatactactactcaagacagctcagtcgtacagagtagttttattttctcacccgaggaccctaaattctataaactttaagaaagtacctgattctacagggaacccatgaaggaagtcaggtaaaaaaaggaaaagcaagaaaaacaacaaaccactcacctccatagcgcactcagcaatgcaatggtagttagcagatccaattaccagctactcagtggcactcaatggtattacttggtatggattcatctccttattttctgttttgcttttctctgtatactttaaccacaatctcctaaacctttccccctaggtttccattccatttattttcttgtgagttacactcctatattcctacttatgtccctaggaaaatgcaaaataattccttctattcatggagaaatatactatcctgatgattctatgaagttttcttatttcagttattgtacatcttccgaagtacaggataaacattacattccttgattcttctttttcactgtcagttctacctactatttaataatactaaatcatgtaagttagatgtcttactagtatttagttcaaaaagtcattttgaggtgtgaatatagaggaaagggtgttgaggcagagagagagacagcaatatggacaacatcacccagctcaggaagcaaaggcagcatctgaacttaggaaataatgagggtctgaaagtgctctgtcttaagtttctctctatctctctctctctccctcccatctccctcttctccctctccctctctctctccctttatccaataaggctacaattcagccagtagataatcgtagtggggtagcatcatgcatctttttcagaagacagagatcttcaaggattcatagcaagagaagcctggacatcctgcctgtaagacaagtcttgacatatatcaaaataaatttggcacctggttttactaatctgtaaacaaaaacaaacaacagtgtgtgtgtgtatatatgtctgcatgtatacatacatgtgtatgactgtgtgtgtatgccttaaagcttcttttctataactgggtaatagggaatgaataccagctattctgagaactctgagcctgctgattgaagattactctgagataaaatgcagcacaagtcaaccctcctggcccacaaaccatggtctttgattttatttctgctctgtaaacatcctcatatggcatctgaccctactgaaatcattcaacaaatacaagtcaatgattactgagactaagcaaaatcaacaagactataggtatgtttttcatccataagtgacaacaaaacaagttgtgtcataaagaagtcactagggatgattcttcctttgaaattagatggcaattatcttccataattggattttcttcttttagaaatttcctaatagatcctgaaaggtatcatatgtattacaggaattcagtaaaatgctacgttaattacacatagctgtgacttgaaatatttgaaaacagcgtgctgtatcttatatgagaacaactaaactaaaaatcagaaattaaaatttaagttacaaattagcatataatctaccagagtctctccaagccacagacagtgaacttccctggaaagcgaagtgttggcctcagatgatgggctgctctgtgctattgtgtcaataaaaataagacaacccacaactcagatcacataaacctaggatctgtctgattttcaagaaccaagatgattgatattactaaacaaatacccactacgcgcctctggcttcttctctcatgtttcttttagttcttagtaagcattgaaatgataggttattcattcctaagatgtcattatctgtagcaaccactgtcttgcagcctgcatatgcttcatgtcagatcagagtattctgtttaaagatgaccagtgattagataaaggtaatgtgcattctctcattacctctcatctagatagcggcaggaggaaaggatatcagaaggcagcagcactgtgagcctctctgatgagcagtggcaatccagttacagagaagttgagggctctctaaagtgaggcagtgccagaattcactttaccatttttatgtacacttggttttagaacttgttctagaaacatatattctaccattttcactgtaccagattgtgaaaagatagtaactgaagtacaaagtaaataagtatatacatgtatgaaaaactgctcagtaaatattaactaatataggttatgaaatagaatgcaatttatgattccattgtcaatatcaccaatgaatgtctcacacatgcataggaaaatttgattaagttcccagctcttactgatgaattgaggtaagggagtatgagttgggcattgtgaaatactttcaatttctaagacgtatctaaatagatggatggatagaaagacagacagaagttactttgtaactataaaaatcatgaacatatatcattatgcagaaaacaaatattcaaaatgcaatgtatcctattgcatacctattgtgtatactttcacaaattcaggtgacaaagctaggtcaatcaaacacaatatatttcatcactgcatgacttttcagagcttttaatgtgtactgtggatgtccactgactataagtagtcatatgaggcagaatacaaatgttcatatgcaaaaaaaccaaaaacttccaacggtcattgtagctcatatcctcattaaaatttgactctttcttttaagtcaagatatattgcatgctctttggagatcaaaaatggtggtttgtgattctgatcaccatggaacctctgaaaactataagaaacatgtctatttcaaacttctggtcctatttctgtgagttgatttggtaagctcgtcaagaagggagtcaaggccaggtgcggtggctcatgcctgtaattccagcactttgggaggccgaggcaggtggatcacttgaggtcaggagtttgagaccagcctggccgacatggtgaactctcatccctactaaaaatacaaaaattagctgggcatggtggcaggcacctgtaatcccagctactcaggaggctgaggcaggagaatcacttgaacctgggaggtggagcttgcagtgagctgagatcgtgcgactgcactccagcctggccaacagagtgagactccttcttaaaaagaagaagaagggagaaagggagttgggggactaggcacatcaaacacagttacccatgcccttcccaggtttagggttaggatttttgatacagaactctcttatcagaaggagagctccacaaggctcaggattttcagagtttaattcttgagactggcctgggcgaatctgtttcttgctaaattgaaagctgggtgtgagagtaaggaaaacggaaattcatcatgcaggtaagccttagaggcctgagggtaagaaaaagtttgaaggagttatttcagagacaatgagatagcacgcacccctctctctacccaaatacactggagacttgtactaaaggctttgattcctacacaaatatacattcccatgagagagttaaactttgagcttttattgatcatttcatatcctactatgaactgctttatgagatccatagtggagaaagcatttgaaggaacggatgcttaagagtagaaaggaatggagtagtagagagaagaggggttttgtttcccaaccagaaagtaactcaccctattgccttgtttggtgtgtactagctttgctttgtgtactccctggctctctttgccttatttttttacatacgggagtgtgagactgaaaattagttggcttcgtgaaacaagtcaattcatcttcagaaaaaaatctcaaagagcactaatgagtattttcaaatatatgtctcaaatttggataagtaagtaaataagtaaataaataaagcaaatggtagtggctaaaaacagctgtcttctaacttggccctgactaacttctagttagaatcataacaccatgactcattgaaactattgtggagtctaaatcaagtaaatgagatagtagttctgggcatctttgcaggttactctataaaatgaaagagttccttctgtggctttgttgattttgcaaggtctttccttggcctatcttctatgcattaaggatctttttgttagcaaaaaagttttattgttttcaaaatatgaaacaaatgatgctttttggaaagtttcttaattaccctaagcctcacttcttccaacgtaaaaattgcagttaatgtacctgcttctcaaggctgttttcaagattatataaatgtgtatgaatgcatgcttttaaactctggggttctacaaaagctattattagttacactggttttttgctggacttctaacattcacaggatgatagtgataatgggtcaaattccattgcatggaccatcaaggaaggacattaattcttgtacttgaagtagatttacctttaagcaaatccttccaaaattatgtattctatctgcctggagtgtggatcctgcttaggatattaagagaaagtatttaaaatcttattaaaaagtaggtagcatgacctttcagcatcatatgggagctatagacctaatcaaaggttatttagttacttagagaaggtgtattttgtttgattcactttattactgatacaggtccaagagttagtaaagtttcttgttaacctagtgaaatttgcctggtagagatacaaataatttttgtctagttgaaaagataaccccaagggttttagtttatggccctatagatattaactactcgtatctaacactgcaatcttattctaagatttattaaatggcctatatatacttagctctgcaaatgctctttaaactggccttaccatcttactggatctctaattaataaatgaataagctatttgacatgtgctcatttgatgtaggcaaatcatatttttaatgttttaaaaactatattaacagtgatacagaaattttgttgttgtagagataattagagtgggatttgttagatggtagaatatattctgatattgaaaagaatagtagtaaaaagtaaatgggaagaaagatggacgagtaagtagttagaaacaaagagtttctggaaattttaaattaacagtgttaaaatttgctttctttctatttcccccagggggccaacatgctgttagatagtttatgatgacaaggaatttagggaacttatttaaaaagtggatccttctaataattggaatatacactattgcaattgtattcaacgatactaaagtctcacacaataaacttcaaggtgcagtgccatttacttacactttatatctcagatgacggagacccagagaatcttggttgttactaaacagatcactcactgcaaatatgaacaaacgtgaactaaaatagagtattcggggttcttgatactgtgttaaacgtactgatcactttaagatttataactgggtaaaatgtgtctgcacagaggtccctcacagtgtacaataagagatggtaaccacgattccagtcataatctgaaattgttgcataagcttaaacttaaactttcagaatctcattttaattatgagtaaaatgaggatattggaataaattatttttttctttctcgggtgatattctattaaaaaaaggaagacaaaagatatatgattcaatgtaaaacttgggcaaaaattacttaaaaagggaagcagagtaacatatagtacagcctctaagagtttttgctgtgaatacctcttttaaactctgtttaattatgcattttctcaatcttatttggccataggataactcacttccacctcgtcttttcttgcccatcacctataaacatgtctatgaacatcaccatgaacttaaaactcaagttgtcagtaactctttgggaacttctggattaatcatctctgaagtcacttggaattctaagaagtcacttggaattctaacatcctattatcacttggctaacatcacaaattaccctaaatttacttagcacttactatttgtaaggcactgttctattcacttaaaagtgccaacctattgagatcaggtgacagtgctggagctcataaatgtcagccttgtatgtattaggatctgtaagattaaatatctgtgccatacaaaattgttcctggtaattatgcaaatgtggctacaatttttttaaagcacagattattataaattaaatatagacatatcataagttctgtagtgtaaaggaaaaagatgttcatgacagactgagaaaaatatgaatgggaaatatagtttgaaaattacattgggaaatgtatttattttcaaactactgtacttgtaattttgaatcaaaggctaactcccaacttctgctaatgattggatgagtcttacaaatacccttttccattttttataatagaatttttaagtgactataatgtacaaatccattcaataatcaattgaaggtcaaactacatgccagtacccgcatcaggtacagggatagaggtctcagaaagttcacagctttatgagcaagagagtgtgtacgatggcaatataatgaatcagcagtatggcagccagatgacaggagagatggtcaaggaaagcttccagggaaaataagtgaggccatagagaagtcattttttagagtaataaggaggtcagctgagggcatggcatgaaaaacatattccactagaactatttaaaatatcaagatgtcaacagcaaagtatctaagttaactcctttctcctgagacaatgcaaaggaggaggctctgctgatttcatgcactatttgcctgggatttttttgcatgattcttttaaggtgtcaagcactgggtctatgacaatgtagatgaaggaacatgctttggagggagagatttagcctaaacttttaaaggacttctatccaacccactcactgtccgtatagacacaaaaagaaagggacaagaaaccagattaccccaggtgtgtactacaaacatacaatagtggctttggttctgggaaagttcatctttgagtaagacacccagactcactgtttattttaatgtaaactattagagagaaaaatgtctgggagaaatgtactcaaaaagcatctgttgagaataaccagtcctatgaagtaatatttaaatgctgtgaaaaaaaattcacagagcttcaggtctcccattgcccttagtcttcatcagtctattcctatgtacacaagtttaaaatgttgaggacagccctcctaggaaagtctcactcagaattgacattaggtcctgtacctagcagcatctgaattcccagactaatcttaagaattcatggacctgatactcaaaactgaacattcagcatggtaatcacatgagatctcagggtacatatacttccccacccaatctctcttcctctcacacccacattaggaacatattgcacaggtcaggatggacaaattctagaggactctgggaatcatcttccgtattttgtttgtctgtttgttttcaaaaagtgacaagaggctataagccatggattttctaattttataactggttaagtccaagcttggaatgccaagagtcttcattctcatttttccagtcctgtttactactccagagtcaagaaactctgcacacggtggttgcttatgataggagtgaagggtagatgttttgacactccgtctcctgtggccacaatcaaagcatagcaagaaatttcactaggggccctgctgctcctctcactacactcctacctcatcaataacaacatctgtatttagtaataaacatgctaggaaaatgttaacgtgcttcataaattatatttccatttatttgcaaagaaaattgaagtgtgatagggtagaaaacatgttttataccacatgtagggaagcagtcagaagattcatgtgagcaacaaagctcaagaagattgtcagaacaaaaaaaatcataccattaagaacatgaaagactctacctttcagctctgagatggacagggccactgatttattcccagagttgttaataaatgaataaaaaaaagaaacagcaaatttgtggtaaagtatccctgactatgagccaatatactttgtaatgaccagaaaatctgcattttgaaaaccctctatgcagccatagaaaagaataagttcatgccatttgcagggacatggatgaagctggaaaccatcattctcagccaactaacacaggaacagaaaaccaaacactgcatgttctcagtcataagtgggagttgaacaatgagaacacatggacacagggaggggaacatcacacactgggccctgtcgggcggtggagggcaaggggagggagagcattaggacaaatacctaatgcacgcggagcttaaaacctaaattacaggttgacaggtgcagcaaaccaccatggcacatgtatacctatgaaacaaacctgcacatactgcacgtgtatccccagaacttaaagtaaaattaaaataaataaacacactcatcaacattaacagtaaaaaaaaaaaaaaaaaaaaaaaaaagaaagaaagaaaaagaaaaccctcaagtttcctgtggtcccctcaccacactgctcagaaccagaaagagtttaagactttgaatggattcatttcttagaaagcctggctgtacatctctatatttagggttgatttcttttattgcacacagtgagaagttgatgggaggagtgacgagatggctgagactcccctttcctaagcttttcttgcctttgtagagttgtaatgggcaatttcttaccacataatgagaaaacggacttgaatccatgctactcaaagcggactggcatccctgggacttgttagaaatatatatgctagggcgtttacctcatacttagtgaaattagcatctctgggcagaggactcaacattcagtgttgtgaccagcactgctttatggctacagcagtattcctcctaggaccatgccgccgtcagagttattttgaccctctctgggaagacagcaagcctaagtcaaggttttactctattccacaagagcttgttctctaatggaatttacaagtctggcctttcaagtacagtcccaaaaatggaatgcaagacacaggaaggcagagaggggaaaaagtctgagtgccaaacagagaagaatgacctctatggctaaattgttttgtctgcatcctgtctaaaggcaccaaaatttacagagaataaactaaaggaaagggaaaaaagtcttgtagctcaatgatctttctagtttggaataattttaaattgagcaataatctgagcatattttcagccagcatctgtctgtgttccacttagtttcagtctgacttttactcccctgggtaatcagcccacacacaagcaggttaggaatgaaaaaaataaaataaaataaaccctgcttatttcattttctgtttcccacatctccttttgtacatacatcaaagcacagcatgtgacagaaatgcttccatagcaccaaggcaatagatagcactttgtatagaaggttggtgtgtcttctgtgcctaggttcaaattttggctttgctacatactggctatttgaaatgtggtaacttactctctgtagcctatcgcccaggctagactgcagtggtgcaatcatagctcactgcagccccaaaccactggcctcaaacgatcgttccaaccttggcctcccaaagtgctaggattacaagggtgaaacaccaacctgggccccttgcttcttctaaactatcaacctaaccatgtaaaaggcagaatccctttgagaacctcatatgccatgcttcttcccatcacagggcctttgaatgtactatcgtagaagtcagcagagaaagaagagaatccaggcttcagagccagacagcttgagctcaatgcctggcttcagccttgctgtgtatatgacatacaagttactgagttatcctctctgactctcagttcccatatatgcaaaataagcataatacccattttacagaggtgttgggaatattccatgagaaaatccatgatttacctttagtggtactaagacttctaattgtctataacatctattggctttaatcgaatgttatactaacaattttaaaataaaactaatgaaatactttcgaaatattgtgtattaatttagtttatgactcttgaaacaaactccaagttttaatgaccaacaaaagagatctttagtgattaatcctgaatttaaagcaagatttctctaatttcaaagtccatacattttcatcttgaaatcaaccatataattaataacaaagataaggagataaaataaaacaatggcttacggtctacacattcttttctgtctaagatggcccacttgaaattataagcaatttaaattagaattttaaaagcatattctcaggttttaaaaaatcagctgtatttgctccagtgcttctttatttactgaaggaaggaggtcagtaatttgggagtcatagagaagctgaagtgtgtttccttcttaatttttacatgggctgaaatgttttcaagggctggaagacggcgtggtgacaggaagacaacgtggtgtgcagagagaagattgaactgtacatgaagaaatctgagttcaaactgcagttcccaccagctggaatccacagggcaagtcatttaattgctctgaagacataaccgcctcctctcaaaatgaggggttggcttagctaactgcataggctccttccagctttatattttgctggtcttgagaattgttagggaagatcacagtgactccaaaaagagaagatcagatctcctatcccatcaaagaacctatctaccgtttcagacattttaaatgccaaacccatacatctaataaaaaagctttttttctgaactctggtttttaaaatgtataacttcaagaaaaagataaatctgcgcaagaaacatatgacacaaatataatgcattttatcagcatatgttccatccctagtggtcacgtttattagagatttaggctgagccagggttggctgtgttctcagaagtacggggatgggtcttgcagaacctctgcactccggggtctcagggcagctagtgctgaaacgtgaccagaaagagtgaggacatgaagagtgccatgtcttgcccttaatgactcttggtggtttcaccagaaagacagagggaagcggtattcagtctggaggaaagaagtgggtcagtctccccacagtcgtaacacatgcatcacagtcctcttatgctttcatctgtcaggaatgggccttcatgttgttgttacactttgacctaatgaagagaaaaatgactcagaataaatgaatcttcccactaataaatgatttcttaatttcgtggtgccatgggcttttttgagaatctgaggaatgtggctcttcttctcccacaaaatacacataagcacaaaattgtgcacacagcttcaagggcttcctagactccttcatgcccattctcattcttcaggggctaacagggaaagaatccttcatctaaatgaaggaaaattaagagtttatgaaaacagacacaatttgagcacatcacaaatgtggtataagcctgtttttccatcaaatatgtcaagtctgaaaaaaaccgaagacatgtcttaatcaaatttgtagtctcatcagcatggtgccctgctcattggttacagtcgacactttgaatcatggtcattgagaaaagacagagtgggcaggaagagaaagaggcaaggaaaaggaatgatttaaggatttctgtggaaaatgttatttcaaaaaaatacttctgaggttaaagggaagcagaataaaagactttctagttaccagtgaagtcagagagacacaaatatgaatcctgctccttcctcatagcagctaaatgaccttgggtaagttcctctctgcacctcagctgttttctctgtgaaatggggttaataagagtatctacctcacagggttattgtgaggctggaaggagctaatagctgaaaagcatttagcacagtgcctggcatgtaagaagtgttcagtaagtgaggtatttatcaagaatcaaagctgtggcctacttaagatggtactatctgcaaaagtgccagccttaaaaaggatgtgaaaactaaaccaatttagaaaaaatatcatccttttaatattagaattatacataattctgaaaaacttaagattaattcacaaatcaaaaaagcttgaagaaagacaaaaaaagaaatatggtatttatccataaatataacattgtttctatttccctaagaggggaatataagcagtaatattaatattaaaatggagctccaaattaatggaaagtattcatttccagagatgactaaaaatcagagattagaatttctgagctttgctgtagactatgcattttcctaaactcacagcttagccacccttttattaattttttgttgttttccttacttggatgtttgtgtttatgtgttgcatgtcatatttatatgatgttttaaaatccatttgatctaaacaactcagaattctcttaaaactatcaacgacgccatttatcagctgggtatggtggctcatgcctacaatcccagcactttgggaggttgagtgggaaggatagcttgagcccaggagttcaagaccaacctgggcagcaaatggagactctgtctctacaaaaatttaaatattagctgactgtgttggtgtaggcctgtagtcccagctactcaggaggctgaggtgggaggatcacttgagcacagaaggttgacgctgcaatgaactgtgatcgtgccactgcggtccagcctgggtgacagagttaaactctgtccccctaaaaaaatgtcatttatcaaatggcatttatcaaattacaaataattttttgtgcatttaaaatagccccaagcaagcattacttctcacgcacccagacaagcaaaaaaaaaaaaaaaaaaaaaaaaaaaaaaaaaggcatttccatgtatggctgaattattactctatgtgtaaatttgtcttaacattagccttatataagtatatcttttattgtaaaagctaaaagatgttataaattataaaagcacaaaaactgcctggcacgtcactaatctatggagtataagctgccattttttgagtgcctagaatgagccagaatgtgtagtaggcactctatataaattatctataattctcaaaataatcatgtaaagaaaatattattaatattgccatttcataggtaagaaaattggggctttaagaggttatgtgacttgtcaaagggcatgaggctagtatatggcagagctgagaaatgacggcagctctgtctaaacttcacattctcatccttatcccattgcctataatgcaatattaaattattattctaagtaatatctaataaactttagacaatctcaggtaaagcattataagtggattttatctgggaatgggatcacccatcatactttgtatcatattttataacatttgtatgtcagttatttatattaagaaccatatcttacctaaggcagcgactgagtgtgaattttatttctgtgcagagtagacatctaaactctcactgaataaatgaacaaatactacagatttgaaacatgccatggatgatacatgattcctgacacctcacctcttccactcctcacctactttcccatctccctggttaagagtgagttcaagggatggagaatgtggagacagtgtttgcagtgagaaatcctgaaaaagggagaccataccaatcactagggcttcatcatactactactttttccacagagacttccttgtctgcccctcctgtgatgccgccagtattctaatctccaaatctaacatctgtccttatcaatgtactagagtcaagtagattggcatactgaatgttgcatccaaaaaaaaaaaaaagttggaaaactcatattctagttcagtttccaaccaagacagaccaagaactcacaaacaacttttggcatgcactaaaatctgcccctttctaaataaattgaagaaaggcagtgataggggaaagagctttgacaaagacagtaaagagctctatgtattacagacaatagcttgcctaagtatttgaggttgtagagatggtaggaatgaaagattcaaaccaacaaattgaagggactccccatgacctagactaataagcagtactgatcctaaggtgatgtacgacaatttcaaattaaatggttttctgagcagaccactcctatgttatttaaaacagggtatatgtgcattcataaagaatccaaatcttatccaaaagaagcaaaaagctaaaataaggaaacatgaaaaggtttttaaaaccaatggacgttgcttaagtcaatctagagaataattatgcctagaaattgtaacaagctatttcctatggaaataaatagattaatgcttcgtatttatccagttttcttcttttaaaattcattcataggcgttcatagagaaggaacttgcagttgtattgcaattttgagccagtgtgtcatgtgaacaattcaatttaggaatatactcatttagggaattaaaaaagcagaagttaaatttaacccagaaaattaagaacattatctctgaaataacattttccaaagctaaaaatatgccattatgtttattgagaagtgtttgatttcaaccaatgtctcaaatggttaccttatgcttcccgtgttattcattttattgggaaatggatgttctattcattgtccaaaggcttgttgagttctctttctataatcctcaggaattcaaagaagcctgtgagtcatcaaaactcatttccaaaactgagtgtgaaatttaatttcctagagattaggaaaaatatagcacatatctttggtctgtaaaactctggatgtaattttggctataggcaaagagtggcttaagtgacctttgaagaggatttctatgtgtacttaggatttagcctccaagagtcggcctactcagcctcttttgaaaagtattactgaggcagtcacattttagtcagtaaaatgatttttttccgaacaagttgactgctttcagaagtaggacgtggctttaagttaacaccaggattccacgttactaaggagaggcctcgatatgtctgttgcatccaggtgggctactccctgttctccagtcacgtctgtatccagtaagagctttccaactctttgtggcttatctaatacatctacgagaaaccagggagggttttaaaagctggcagggcataactctcacttacggaaggtccacaccccagccttatttttaaggccttatctttgatttcctgaaggggtggagctctcacagccttgcttttgtgttcaacttctgacttactccttgtgcacctataactttctattgtcaactgaaattacttgggaatcaaaggggtaaattgttttcagcactggataaagaaatttttgagaatgagaactttttctggaagcattctcctgcctgctcaaattttgttcctcaaatatgtgcttgctgtcataaccatgtctctgagcctccttaggagccaactcttgacagctaaagaaaaaaatggagcaaagagagcaatcttcctacagccctcgctgctgggggccccacccttctccatcgttcaacctcaaaaacttggcctcatctgtgaccctctcctgttctccgcaggctctccaaggcctgtagatttttcattatggaaaatggctctgacccattattaagcaatttccaccttaacctccctcctctcatgcctcattacaacatcgctaacatcaagtccaacattctaatattacaagtggaaaaaaaaaatgatctgagactgtgaactgtgagaactgtcgactgtggtaaattttaagcatgttataattctaggcctgaaaactaagagataacaaaagaaatgtaatccacagatgcccccttctttatgctgcctacctgcctttgtactctttctcccaaagtcatcttctgcatatccttttagaaacttgtgtcccattttcattttcccaatccatccacaatggcagcgaagcgctctaccatccttctacctgcacacccttcagtagaggtaaacctcttaaggagagggaggcaccagattagaatctacttcctcactgcccggtctgtcttccttggaaaaggaaaagggaagtagatattgaataagcgtaccattttacctacaaggcacacagtaagtggttgatccaatcaacacaatgccaggttgaacattatacacaagtcattttattcttgtgcagatgtttttataggaaagagccccagaaatggggttgcaagtcaaataataaatccacatgtaattaggttaaatattttcagatctccctccatatgcgctataccactttgcattctccctagaaatatatgagtgcctttgttttctcccaactttgcaatgaagtatgattttaagctgctggattgttttaatctcatgaaagagaaattgtttcttagtgtgatttgaatttgcattattataactgaggtgatcatatgtttaagggccatctgtattctcccttaaatttctgcatttggcagaaggcattttgtaatccaaagagctatttctttaccttcaagtcacactccgtgcacagcccacccatctgctgacctatgtaagaggtcaatgctgcttacacgtgttttgggactaaatgggggtggttgtggcatttgtgtcaatggagcaaaggacctagaaggcatcataattcacacagtcagtctttagttgatggcttggcagaagctgaatgaagtgtgtgaaggtgactctacagagcacagtagtaaggaggggttgcttcttctgtaagtttacatctcatgctattttgggatattgcctggatgacttgtcttctcctctaacatataatattcagagtgttttaagttgtataaatcttaagaaaagaaaaagggagaaaagaaagggaaatgctaggaaaaagttctcacatttgacaatgtgatttatagaactatttctaggcacatcttattacatcaaagtggcagtgtttatttttttacaaatgtgtaataataaggatcttgacaatgcacccctccctttcagattacctctagaaatatccctggaaaactttaagatgaggcaattgtggcataaagaacaggcatagagaaatgctttttgaagagtgtttgacataaaatttctattaactgttaataagcactttaaaaattgttctgttctcaaatacgtatgggaaatgccggatgaaataaagataagcaagctcttgtattgcaagaactgaaaaagcctttactatggggaggagttaaagtaatcagtgtcccccactataatttggctgcagaaaccccttctcccccaaaagcaatcaagagtctgatactgtgataatgctggaaaatgctgatgcagagggaaaaacatctaacaaggtgattccgatgattttttgattctgacaacaacatgcatgatattctcagtcacaaagcctctcagtgctcaggtcactcatctgtaaagtggggtactctaaaaggtcactttccatttttactttgacctataaggagggatgccctgcagaagacaggtcttcctgttagctcagccagtggctttcttggtccatttcaagggcactgttggaggggtgggagagacagcacttctatcatgccaagctaaatatcctgagaaagatcaggggttttctattataaaatataatagagaccttgacatgaatcctcattctgtgtacagatgttgagcccacactcttactgattaccacacactgacccatctagggagtggtttaccctgaggccaggtcactaagccagtcaaaatccagctcgctttaatttgtagtccatgcacgtaacaaacactggtccactgctccaggtcatcattcgaatgtcagtataaactcaccagtggtcccaagagttctgtttctttggcatttgctttctctggtattatgtgccattttacaacaacagaaatcctgatctgtcaatgtcactcaattattaacatttcctggggtgttctacaaaccccattaagtgggatttgctggaaaggttgatgctctgctttgccccttggccccttcaggcacaaacatggattgaacctacgacatgccaagcacctaccgagagctagaggtagagtcactgatggttacgcacatgctgttctttctgaatgctctgccacactctccacaaaatggagctgagatgcctcttcctccaggaagccttactgagcttcacctcctctcagtctggattatgtgtcctacccacccccagttaaacagttccttccacagatatcaaacattacccttatattcctacatgcctgcctccctccttgagggtatctctgctccttaagtgtgaagactaattccttaatcttcatttcctcagcatcaattgtagtgactgccacataggaagtactcagatttatgactgactgactgactgaatcaaggtatgaaaaaccaattcctgctctcaaagaccacagagaatctagttcaacttttctacatgactttaaaacaatttataatgcatttatgatgctttaaataaaaatcgcgtgaatacttccaaatatttttgaattataaacacattttcaaatttgcctttcattagaagataccaagaaaaaaaaaactgcctttcaaagatattggataatgttaaaatgttggtttcaaaatcacgtatggtccaagataccaagaaaaaaaaaaactgcctgtcaaatgtattggataatgttaagatgttggtttcaaaatcacgtatggccccatgcagagaagggtccagatgtaagaaagactaaaacacagctaagggagacaagcacttatgtctacttaaatcggcctgctttttcaggctgtcaactctcccaactctgcagcttccacatgccttgttaatgtgaggagaaaccaatgtgagacaatagcagtcatatttccagtttaattacagaaatgcaaaccttacatctccttaagcctcaattataaaaaaaaatgacaaggcacatgccatgttttctctgcttcttgtcaccaaccatcttgccctattataaacaagaacactccatgagtattcagagtataattctaataaactgctctcagtctgccagttacatctgcagaacacagcaagaagaacttttacgaatgtagatatagtagggtaggaggcacatgaaagagagttccagcttcatcagagcaaataacctgcagagtgtattttgataatagtcacataccatggaaaaaacattcaaaaatatatttatttttccttaaagaatgtaaacaggtcagctggctcgtacctctaatctcagcactttgggaggccgaagcaggaggatcccttgagcccaggagtttgagaccagactgggcaacatagtgagaccctgtctctacaaaacatttttttttttaattagccaaatgtggtggtgggtgcctgcagtcccgactacttaggaggcagaggtgggaggattgcttgagcccaggaggtcaaggctgcagtgtgctatgatcatgccactgcatgccggcctgggcaacagagccagaccctgtctttaaaaaaaaaaaaaaaaaaaacacaagatgtaaacagtaatatttctgtgctcagtgtagaagtaatcttctcacagaaatacctaatgtagacgacaggttgaagggagcagtaaaccactatggcgtgtgtaacaaacctatgtaacaaacctgcacgttctgcacatgtatccgagaacttaaagtataattttaaaaaaaggaacctcctctcattaataaccagcatatagaatgctgagctacatcactggatgctaatcaaatggattaaaagccctagcttatacgacattcctttagtgcacatcatcctctttaaggagagtacagttgatggcttctctctcccccttttcatctttcctgtttcctaactttagggagacgtaagctgctaggaagacagatcattgtttttgagttgcatggttcctctgtgctgccagatattttatcctgatgtgtttgtataaaaagggataaagggaaatccatcacaaaattattgttgctcagtgaatgccaaacaatacatgcaactgaaggaaaaaaaaaaaaaaaaaaaaaaaggtggcggtgctggtggtgacctagccctcattcctgttatgaatgggaaactgaagaaaggttaagaaaagcatttatccatccactcatccacccattcattcattattcattcaagaaaaaaattcagtagctatttaaggtttttagataatttctcaaatgcagataatttttaaaattaaaatctgggcagattaagacaaaaaaaaaaaagacccaccacattgtgccctatgtttaaatatgttctaaaaaatgtccttgtagaaacatctgcagcccacatagacattttcatagacatcttgacagcaaaagaacagtactatcgtttcaggtacttaggaacataaaaggcagtgaatatatcagaaatctctcaaattttgttttttagttcattgaagcatcaaggaaagaataagggatttggagtaagaacatcttaattttaaaacctaatccagtctaatcctatttattctctttattttgtggagctgaactgaggatcaattaaattaatgcatgcataaccatttggttcttgcatgtagtcattcacccattcaattgattgattcattaattcactcattcaacaatctgtacaatggcctaggtacagtccaaggtgctgctaggattctaagtttgagaagaaacaggcaagactcctactctcataaggttttttgtctattaaacagccaggggctgataaacaacaacactaatgaatttacaatgacacactgaagcgtgcactctgaaggagggatatgcttctacaagactgaaggcaaagaaccacacaaaaacagggatgtaggaaggactttactgagcaggagacgctttgtacctgagaggaaaacgagagcttactgggagaaggtgcgggggtggatgggggtggaacggcttgtgcaaaaacctcagaacaggagacaacacggtgattggaggaatggaaagaaggtcaacatacaaagctgggcagaaaagaagtgaaagtgaagctgaaggtggggaaggggtatctagcacgtacgcagctattgagcacttgaaatggggctagttcaaaatatatgggctgtaaatgtaaaatacacactttattttgaagactgtgaaaaaatgaaactctctcaatttcatacatcgattacatactgaaatgacattttggacattttgggtttgataaaatacattattaaaattaatttcacctatttatttttacttttttaagacgactcctagaaaatgtaaaggtacatacatgactcatatttttcttggacagtgctggtagtaagtacatgcatagccttttaagtgtgaaaaagggtttttgtcctgagcgcaatgagaagcattgggaggctttacgaagagagacaatgggatcttcgcagcttctgggtagaaaagagatcaaaaggcacctggaggcaatggagaaaaatgatctgtgtactgcattataacagtttggtttagggtcaagaagtagagataagaggagtggaaggatttgagagatatttaggaagaaacacatcaacaggctctagtaatgaattgagtatgttactgagaaaccccaaagggcagaaatcatgttgggaaaacaaagatacagagtatatggaaatatacaatttaagtcctataatagaggcatggattcattgcagtaggggtacaaagtaagaagcaagtgtgtgctttacataggataaaatattgctgctgcagcttttcaggtaggcttcattaaaaatcaacatctcatcaaaaatatgcattctggttttaaatatcttttacccagagtttaacttaaaaaaaaaaaaaaaacagatacataatgagtaacggctgtgcaagagtctgtggtagggctgctcttgaaatggaaaagaaagagaatgtttctttagtgcccactggcatgtgccagaagttttaagtgtttaatttatttaatcatcccaaaaaccttacaaggtcatgttactatccccattttagaggtaagtaaaatgaggctcaaaattgattgaagttccacgaagacagaaaccatttttattttgcccctccactctattcctaatgcccagcacactgtccagcatatgctaggcactccgtaaataaaggttaaaacagctcccaagaggtagagccaagtgccaaccttgcttatctaaatttgggatcatcatgctaccatttgtttttttaatatattggatagcaagtacatttaagttaaagctttttaaaaatagaattaggcatagtttatatatttatatgtggttaggctaacaggtatttatataagagccctttatctgtgacaggtggttatcctctaccttattgaataacaagaacagttaacacttcctgagaatgtactgtgtgccagcctgttctaagcactttgcttgtattatttatgcctcattctcagcaaccctacaggatagatactatgatttctctcactttagacactgggaaactgaggtacacagagctgaggcatacagaggttgagtcacttgcccaaggtcacatagctgtaaaggcaacaaacccaaggaacctaattttagaatctgcatcacactctcaacccctatgagacagagcccactactccatgagactctagttcttacaaagatctctctagcattagggcaaggtctgccctcttgccattggtccagcaccctctgctggggccacacagtgttgtggtttatcagggcacctccttgtaaatctagaaaatcattcaaggataaattgtgagtcagacatttggagagtcagaataaaatgagcacaaaaagagcctgtagatctcgtgtggatctcattccatgaaaagagcaaacttaccctgagtctttaaatgtccactagcaggaagctatcatttgtctatggtgacatcagatagagtagagaaaagaggtgaagaaagggacttagtaagttgaagatttcccaacagcagaaaccatggcattcgggtgttaacagtgaattcaagagacccttgttcatgaatggagtttaatggctaagatactctctaagcacactaggcaatcagtgcttgctaggagttcacataatgaacaggatggttacaaccagacatccaggcatttgatgtgtgccggttacttcaagtgtcaaattacttacaagttttcaattgtgatatgtaagagggcttattgctatgatttggaagatcagttgggcacatgtgggtctatatatgaacacttcacttcttccaatactttaaaattgttatgcacattagtagagctcctgaaggagcctttttttttttttgttttggaatagtcttaatattactgtaaacacttgagaacatgttcagtatctggccatttcatacaaagggacctcatctggtgccccatcaagacaatctgaagtgcaatcaagaactcattatgaggtggtctaatctgtagggtacctcactgcctataaactaagagcagcacgatgcttctctactgaatgatgtcatctgcagtcactgggaacacacggaggtagaccaaatgccctatatggtaagtggccacacgtatcgggtaggaaggattgcctctgcccaaattctaatataaatgagaaataaattcatttacaagagaatattatgcactgaaatgcataatttttcaataataattatgctagatagtcagatgtttatatcttttctttccttttttttttttttttttttttttttttttggagacagagtcttgctctgtttcccaggcaggagtgcagtggcacaatctgcctgcaacctctgcctccgggttcaagtgattctcctgactcaacctcctgagtagctgggattacaggcatgcaccaccatgccctgctaatctctgtatttttagtagagatggggtttcaccatgttggccaggctggtctcgaactcctggactcaagtaatccacttgcctcagcctcccatagtgctgggattacagtaatgagccactgcgcctggcctacatcttcttataatgactaagtttggaagtaagagaaaaaattgaaagccattctgtctaataggtactggaaaatggaaaaagaaaaaaagaaaaaaaaacttagatagatagattccagggacacaaaaccagtgttagcataaataatgacagcccagatttatttgtacttaaaaaggtatacaggtaaataatctcaatttaaagtaggaataacacttgcaagacaaattaccaactaccaaaataaagaaaggaagaaagaatgcatcattgtgctactattttttaatatatagggtagcaaattcaaaatattttaaaatgctacaccacttaccatttaatcattaataatacactatgttaataaaaatgatatatcttcatgtgacaattacagttgcaaatcaatacagaggtgttgtcttggtgactcaaatatcacaaaatgttgttgccttgggtgggtataatattccaaaattgggaataaattttggtaagtttataaaccaaataaagtataatctttcctcaatttacatcatagttgcatccctcaaacatttagtacaaattaaaacattgtaaaaactacatctttttgtacaagttaaattctgtgttctcataattataaactgaacttgtacttctgtggatttcttgggaatgctcagagtgacctagaactcaaagaaattttttgttatttgagactaccccatgcaatacagtttatctagccccttagttctgactaaatgtcctttctgttcctcctcagtccctagtatgaccataacatgtccccataaatatccataatcatttccccaccacccctagaaggtactgctttcattcaggactacagcttacaactcttttgtatcaaatttgtacatctgatctagaggaatgaaaaaggttttactactgaaggttggtattagatgagtcttataatcatttttcaccatataagttaagctcagagataagattcattcaacatgctttatttttttaatttaaagttaaagctcattgacaaaagactaagaaacaactgataataaaaagtgcctcctctccctttttctgaagtggtttctaaaagaaccactgcagggatgatgatgatgatgatgatgatagcactaacatttacttaaacagttattttgtgtcactactaaactatgtgctgtaaatgcaagaaagctacaaaacagacctccaaactcacttgtggagcacttgtgaagattagagatgatcaatgagaaataaactggcacatggtaaatgattaaaaacaaaagctatcattattattaaatcccaagctaccctgaagcagtaactcaaaaaaccgtgccttaccattatgtcagttgttcagtagttatttatttataccacagacaatatgtttcttaaaatatgcatgcaaataagcccatcagagcaaaagacttcctttaaatttgcccctttgtggcaggtaataatgacatcgcctcgcttggatgattaataaccagttgttatgaggactgtgcctactgacgcaaatacagcattgtatttgggccctgagttataacattcatttctttaaggctgattgactctgaacagtcacattatttgcttgttgagtttacgcaagacgtttttccaagggaggtttatttatttatttatttagtggcatttacatgtgtgcctctgacttcggggagaaaaaaatgaaagcacaatgtaagtagtctaaaaaaagggctaatcagaataaccctggatgttttttcaccatgttacctctgtactcatatcactatagccaatttttaattaaaaagcttttattttctttcaataggatagtaaaaatgtgcaactgcctgataagtatttgctcttagtatagcacacttttcagatatttttaaagaagtatcagataattaaaacaaaacatataaaaacatatcagctgatattattttctcaatgctcagtatatgaattaactgatgggaatatagagaaacaaaacaatttagaagaaaaatagctcttaagccatcaagtttcaaacatttcaaactcactggaattgtgcaatcactacgagtttgtgtgtgtgtttgtgtgtgtgtgtatgtttagggtaatacactttattgattcattaaaaatgtaagtacagtaagctggaaagtatggcaagtaaaacaaaaaaaaaacaattagaagatttctatgaaaactttacaatctaataaaattgaatcctttttttttgttgttgttctctccccaggcaattattttgctctgttcacatgtcttcacaaaatactttcaattttatttttccaccctcagataaacagattccttttgttcggcagatgagaaacgtaccagctgttagtactactatatccatccatttactaatatttaatgagaaaaaatttaactccattttcagcctttctttccctctgctcattaaagagaagcctgccctcctggaaagcccttacttgtcagcccagttcttgaattatttttaaacagaaagttaggagaaaataatacagtgatgaggataagaaagtgaaagtgctgcaatttttttttcttttaattttttttcttgagaaatgacagggaacagctttggagtgtgtgcaggtaacagatggaagacaaaaagagggattttaagatttgttgctggggcacatgtctctctaatcaagaaatcaagtaaagaactgagttattttatggtattattgtattgcatggcatgtattctttcaaccctgatgcctctctgggactggcccacactggccatgttctccatgagttatttatggtactttaccatttttagagtgtatataaatgctttaccttatttgaacctctgaaaaccacagggtaggcaggaaagatattatacccacattttacatatgactaaaccaaaaaaaaaaatgaaagcgggacaagaattcagactttctaccatagaatttggtggtccttctatcagctatacattgacatatcatatttttatacttaatttattgtgcatttgcttcagggctatatctttacacatccaaacatctaaataacctgtagaaaataaaatcagtgatttatgtgtttacaattatccgaatatttggtattcatatataacagagaaataattaactgcccatttcacttttcacctaacaatctataccttctgtactcttagaagtaacagcactgctcaagaatcactacggttgggggcaaggtgaggggctctgaatcccatttggaagctttcttcagaaatattgcttcttgtgcagaagtcatgggtcaggttttctgtttggttgatgacctgtctatacctacatttacacacacaaacatgtcattcatttgcatttaacttgtcagtctaaaacttgcttatttggccaggtgcagtagcgagcacctataatctaagcactttgggaaactgaagtaggaggattgcttgaggccaggagttcaagaccaaactgggcaatacggtaagatctcacctctacaaaaaattaaatatatatatgcatgatggtgcatgcctgtagtcccagccactagggaggctgaggcaggactgattaagcccaggagttcaaagcttcaatgagctataatggcaccactgcactctaacctgtgtgacaaaataagaccctgtctgaaaaaaaaaaatcatttttaagattaagaataaaaaaatttggatccagagaactaggacttcattcttcttctgtacattatgagctacctgaaaactggtgatgaatatgcttcctttatctctacattctctatttgtaaaatggggataataagagcacccacctcataagggcactgtcaaatgggctaatacacatgagtacttagaacaacatatagtatgcactcaacaatgttaactttttaacattattaagttttattatgttacagttgctagtgcttgctaaaatagtgctgacacatggtagtcacaaaataagtgttattgtggtatatgttaaatgaatctcagttttgccaatgtgtgatcttggaagaagttacttcaccagaaaaataagaatataaaacccacaataatgacagctgcctgacaaggctatcgtgaggaacaaatggaataatatgtcagaaatgctttataaattataaggtgtgaaataaatgctaattaccatgtttgttctctaactttatcctcacaaataggctgttctgtagatgcaattatcctcattttatagaggaggcaacaggcttaaagaggattatataactcgctcaaggtcatttagatggtttggaggaaaacacagatcaaaaatttggtctttttctggccctttaactccagtaccttctttactatctctgttccatacagagatatgatctccctacaatgttatttctgagtattcttatgcttttttttttcacaaatgccatttgaaaatgttgatgaaaatatactttacattttatggatattttgccatcgccaagaaatttaaaaaagagaatgtggcagcaatcccatggcagcaactaacaagttgaatcaatccaacatcctctgaacaggatttcatctttagttttaggttcggtatattaaaagcaagcatcttaaaattccacctgagattaaccttcagcatctgatttttaaagttttgagggtgtggttgtcaaaaaaatgaattactgaggttctgggtgatttcatagggatttttcataaaaaccaaagagtcataagatcttcctagagaggccagcccccaacctgccagtgtgctgatccccaaagacaagctgtcactttgcaaaggattcatactaactcttgcttaatcaggcagatggcatccttgttctgcctcctagtctctgcttccatttgtctcctagacatcaaatactgagtctatagttcagaatcttcttctgcctgtgttccctagtcaacctggaattccctgacactgactgactgacacctttacatccattgtgctataatattctaacacttcgctgatctttgctgcaccctctgcatccatggtatcgctacacacatcccttttttccccgactgagttacctatatttgttcctcctctgctcttttataataagtattggtaaactgtttcttccaatagaaacacaatgtaccaaactatacagtaagtattttccttgccctattgaaaaccgacaacccactctcaagtgagacaaacgtacatgtgtcatcagtgtgtgctgctccgccataattgttcgccatctcatctagatgcctccagactgtcaatgaaatctgaacatgtgggtccaaaatggaatctaatactcaagctgtggcctatccagtacaacatgtagcgagacaataatatctcaggatctgaatacaccccttctgttaaaatgcagcctaggattacactagctttgttcacagccacgtaacaccactgactcacatgaagactgaagacaacacaaccccccacatcttgttcacaaaaactggtagcatgccaggtcttccatatctttacaggacacttggtatttttcaaaaacttaaattcagtccttcatatttctccccactgaatcttaaacctttggtttaggtcaagtgtttcagcctgttaacaacatgttgaatttttaatctatcatgcacatttacatattcctcccaactttttgtgatctgtagctctgattaagcagttatcttgttgcttcttttaatcattgataaaaacgttaaagatactaaggataaatccctaacactttttctaaggaccactcatggtttgatggtgaaccagttatcaaaactttttgtggatgtctaactacagaaaattcatttcaacatctaggccataggctccctttttatttacaataatatcataaaagattttcccaacgcttttgcaaaaattaaatttttaaacaaagttatttctttagtaaccctaccaaaaataaaaataaattcatttcaacatggagttttaatgaacctattttagtttcttctgaacccctaagtctttcagttatctgtttaatgttttgtatgtaaattttattgggaggaactgggatttaccactttttatttacaagaattgggatttactgattttatttaaaaaaacagaattatcttcctcttattaaaattgataaatattttcaattactgtgttttttaaaaacttttaagttcaagtggtacaagtgtaggtttgttacacaggtaaacttgtgtcatgggggtttgttgtacagattatttgaaaacccaggttaagcctagtacccgttagtcatttttttctgatcctctctttcctcccgcccaatatgtgttgttcccctctatgtgcctgacttcaaaccatactacagggtgacagtaaccaaaacaacatggtactggtacaaaaatagacataaagaccaataaaacagaatagagaacccagaaataagaccacacacccacaaccatctgccctttgacaaacctgacaaaaacagcagtgagaaaataattccttactcaatcaattgtgctgggataactggctagctgtatgcaggagattgaaactggacccctttctttcaccatacaaagaaactaactcaagatggattaaagacttaaatgtaaaaccccaaactataaaaactttaggagacgacctaggcaataacattaaggacacaggctggggcaaagatataatgacaaagatgccaaaagaattgcaacaaaagcaaaaattgacaaatgggatctaattaaactaaagagcttctgcaaggcaaaagaaactgtcaacagagtaaagagacaacctacagaataggagaaaatttttgcaaactattattgcatttcttaccactttcacctcgtcatcatctgagctggttgtttctagtgtgtctgcaacctcagtgttcagggatatgaaaaccattagcggaatacataaagcattaagttggaaacaagtatcagcacagaatctctcttgttaacatgcatgaacttcaagaattccactctaagagaaaatgaatagatttagcattgctaatgttaagagttctgtctgtttttcatccaccagttgtctgtggatgttttactgtactccagtcaaatcttagttgtttaaataatgcttattgggttgtggattagccagctctaatgtcctgtccatctatgtctatcagccatttcaatacttgttagtaccaataccatggagtacgcagggagcaacattctggcaagtaaactggattttctttagcagatcttgtaaatgtctttccagttaaattgttgagccattggccagagccaattgaggaatcatctgtggttgggcctgacagccaattctgagagcagaacaccatgaaaaagaatttcctatgaccactgctggtgtagaaaagaaaaaaaaccaaaaaaataaaaaaactgcttaaatacactgaagacataattcaaaatttattctttgtttttaatatctttgtaatatttctgtaaagataaagatctataaaataaagaccacagaagatggagagaagttgagataactgtaaaatcttatctgttgctgttagtcttagcaaacacaatacagggagacatggcattttaatagcttcacatgtgtaaattctagatgatctaggcaacagattcaacacacaataccagttaaaattaaggaaaaaggtctcatttctgtacgcttgttggtgagtcattcattgcgtgggcaggagtgatcacccttacagaatttcttctagaaccataacctcagttggtgagttctgagagctcagacatttttctagaaactaaacagggtacaggacaccagaaccctagggaatcaatttacatttccaacttttcttccagcacccacaccaccttctccccaacttcttatatagcaaaggctctctggtgcctcttttctcttttccccttcatcttgcctcagacttgtgtgttggcctcactttcctagtgttgttttaaagtgactttgctttttctcatgtaattgacaggctaaactatccttgcgtctaacaaaacatcctggaaaaaactgcatttcttagatatcttattcttatcagaatgacttgagctttctgccaaaactacatttaacttgaataatgaattataaaatatgttaaattgacaaatgacactaattcaataaatatattacaaaaaagcaaagaaagcctctactgtattcttgagtcagtatctcatgaaactaataccaactccagtattttacaatttacaaagcactttcatacctgtattcttacttatcagcattactaatactgtattactattatcatttccattttacaaataaggaaattgaaggtttattgaagtaactggagacactgagaaagtaaaccccaaagctcatgaagccaaggtcagtgcattttatttagcatgacttagtacactagttgctatttgaaggtacccctagacattcatttctataaagaccacctacatttcattttctgactcggggtacctaagaggctgtctctcttactttcagaaaggttttgctacatggggacaaaaactagaagggatcttttctagcaaaataatgcctaaggttcaaggatttcttagtatgatattggtggtccctggcccagcccctggaatgatccctgtgtgcattcatttcaggtgttcacaggaaagtctagatttagtacaggctcacattttcctttcagtgtaggggttaagattttgataaagtagaagcaaattgctcaagttaaatcccttcattgttgcctttcaaatatacattacagcttcagaaatagggtggactttaggtaagaagggggagaaaatggtgttaggcagaggccaggggcagtcctgttgactctcatggatctgacagggaaaatcagtagtttctcattgtgaacataggctttgatgtctagcaaagcttgactacaatgttaccaaggctcagggacctcactcttaaaacacagaagatgttagtgtcttctacctcttagggtttttgtgaggaccgaataggctaatgaaggtaaagcacaatacatagtcaacttgcacatagtgaatgctcaataaatcctagctcttgctattatgagattttatctgattttggagatagaacagagacacatatgtttaaagaggaaacaagagagaacaaaggtttaaactgtctttgagatgggatgtgcaaaattgtctcccagcagaaagagttgatcatatcctctggaaacccgatctctggcaggcagattctgaggctgtgacatcactgattcttgttgctgtggcagcagccctgcagccagacaatacggttttacaacagaaccaggtccccagttggtctcctgggccaggcactgagacaaaaaaccaggactatattcgtacatggaactgggatgtaacatcctacccatgacttaatttataagcattgtttattctctttggagcaaatgaaatgcttttccaagggacagctgcaaaggccaaggatttgaaaagaagaaaattatgataaacccctcttaatgcaggaaagattagatagcttgctaccagaaatcaagaaatatttataataatcacattcaaccctagactttcctctaagaatctaaacagaaaactttaatcctccagaatgtaaactgatgccatggctatatatggtcacagaaatcctaaggggaagaaaaagaaaagaagagggggagaaaaaataaacacccagttgctgtgtctcttaaattggtgtatgtgtgttctaccacagagatctgttaaccttggcaaaatttacaagtaagaagcattaatcaactttacacaagtacacgtgacactttcctttttaagtggaagccacaaactcctctccctttgggaaatctcactgtcatgctgaggatttttcttcatagataatactaccatggcaaacatcaaaaacaactggattccatattctgtgggcttgaccgccccatgaaggcaagcaatattaacttttcttgtggttgacttcttttctttttttctcctttctctacttcttttggcctttaggctagaaagactgtttcttgaaagtattcaactattcttggaaattgcaacattttcctgcattctttctatgttgaagacacttccagactaagtttgggttctagggaatcttgcagaagatacttcctcccctgtagttaataagccatcgcttataccacggtattttgttgtttgactcacgtctccagtgtaacagtggaaagtcattatctctggctttggtgttaacatagggagggatagcaaattgcctcactctactagtgaatgaatagaagagaaatccttgatggtttatcaagagaggtattatgggaacacaaaggaaaaaaataaattcttacaaaataccaacagcagccttgcaatccccgtcaaaatgtacccaaccaacttaagggggaaaaaaaaattcaaactatgtcctagccataaattgaagaaagaagtccagaaatgttaaaaatgtttataatcatcaaaattagtattttttgccttgaaggatgtctctttaaaaggctattcttaccaggttttgtgttgtaatattaaaagtggcttacaaaagagtgaatgtcaattgcaaaattaaatttatctctgggtatgtgattctatctctttactaatatacaaagctgtcttgaatgatttacacctactttccacccacaggtcctctgccagggtcaatctcagcagaaacatgactcttcaaaaatagatcatcacagttgtgattaaatctcccatgttcaaaatttacagcctataattcaatgccgatatgaataatgacttaaataaaaagttacagtcaccctctttccccttccccctaaaatgaccccaagactaatttacagttgtgggaggtggggactaagagctcttgagtatctattttaagctaggcatttttcaagtttttttacttacataaccctatttagcctgccgaacaatccagtggaatagtactaatttatctaatttacacataaggaaatgaaggctgagagaacttgagtaacttagccaaatagtacagttggatccgaggctcagaattcccactttttccttcctacaaacaaacagtagataaacaaaatattcatgtaaggcttaatggcaggtggcatgagagtactgaatttcattgtatgtatctgcaccctccattcccccatcttttgccatttgtgctccatattccctgacagtgcaccaaaaacaataggtttaggtattctctttcagatatcttccaaacaagtgtgcataaaatggactagaaggcaacttgatagagcaaataaattcacgtgctcttctcaagaaatctgagaagaggtatcagatacactccttgcctgacccagtgtgaaacacaggacgcagtgaggtaaagtttggacttttccatcctcagagcacacacaaatccactgaggattaaaaccacacaaccaggaaaaaatgttaagttacagaaagagctctttaaagccaaaagtcatacagctcatgagaagagagaagtcactttgtgctcaggtgaacaggaaaactttaaagaaaagatggaataaggccaggcacagcggctcatctctgtaatcacagcactttggaaggccaaggcaggtgggttccttgagcccaggagttccagaccagcccgggaaatatggggagaccctgtctctgtatttatatatatatttatattaaaaacaaaaacaaaaacaaaatttaaaaaagaaaagatgaaatgaataaaaataatttatatatggaaaggacttaaggctattcaggtgtgtgtgtatatatatatgtatgtatttggaattataaactgtacattttgcataggggtgacttgattacagcaagggaaattaacctgcccctgaataggcctgtaaaggaaagaactaggtaaagaaaccatttagtaagttattacccaaatccagctttgttggtgataaagtgaaccaaggtgatggtggcagacagaataagaacaataactttcccagcctggcctgacacacattcaggcctgatacacacacaggctgtatcagcctggcctgatacagcctctaaaagattattctagaggctgatcccacatggtgataataaaccatttcaactgctttgtgaatgaccaaagatgacatatgtttaaggactttttttaagaattgagacactgaaaatacagactagccatttttaaaagtactcgtcaatatccactaaaaaggagccccttatattttcatcttccttatttaccaaagctagcttcatcagtataaactagaaaggtaattccagagtaataaatcttccatggagagctctctacctctggctgcttgataatgaatttaatcagtcgggagaacagccctgtcattatggattaatcaccaaagactgttttggtaagttgatgctgtgtttgcagctgatggtggtcacaagacacacttgatatttttaagaaatttagagattgaaggaatgctcagttaattaacaaccacaaaacacaacaaacaaaaaatagaaaccctaagaacagcataaacacagatattagtacctttggctttgatgaattcaagacagaattgactcaaaatattggtaatatttatcttcctgttggtttgtttggtttattttccaatccaattagggaattttaagccagtggattctggagcagggtgaattttcctaacaaacttacttacaatatatccaattagtaaagtgcagctcattttaaaaaataagcattttaattggatagttttattagaagaattttatgtttccttttcaacatggtatcaaataccataaagtcctcattaaactttcatgtatatgactccaggatcattaccacagatagaattaagtaaagttggctaagagtggtctagtcaattattctcctaaaagatattaaggatttcagatgagttaagacccactcccaaagaaactgaaacaagttaatcacttgacaactatatcaagttatatgcttaggctgggagtggtggctcacacctgtaatcccagcactttggaaggtcaaggcaggcagattgcttgagctcgaaagttgaagaccagcccaggcaacacagggaaaccctgcctctataaaaatacaaaaattagctgggcgcagtggtgcacacctgtagtttcagctactcagaggctgacatgggagagtcgcttgagcttaggaggcagaggctacagtgagctgagacagcaccactacactccagcttgggtgacagagcaagaccctgtctcaaaataaataaataaataaataaaaagttgtaatttgtaggttgactttttcaacagtatatttagaatgctgaatgaagaggtagactctcaaacctaaaattttcttctagaatatatttttttccaacatctttgtcattcctcttaagtttcactgattgcaatataagtttgtgacttaactgttaacctatcagtctagtatttgtggccaaccttaagcatctaacaatgtacaatttacattgtacctcaacggtttctgtctcagataagctaacctaagccaattttgcttgtcaatattttggtaaataatcatggtcacctgggattagagatagacagtagctatggtttgttcgcctacaatttcactatcaaacgttctgttctataaaagcaagtctcagactaaattctgctgaaccttccacatttgtttacaaacaggcacaaaatagacattgtaaatctgaggaggtctcactctctgttgtcagtcactctgacatttacctcataagcaatgttcatgcatttcagtcaagttcaaaagtggcgaaaggaaaagaaaggaaaagggaaagggaaaaggaaaaggaaaggaaagttcacgctgtggcagatgcaaccaacaaacaacaggaccaggcaaccatggagtcacttagccagtggaggccccagtgaaatgggagacaaggaccgatgatgctttgactctgtgtactaactgcctcaaaagtattgagcagctgggctagcagattctatatgtccttaatgcaggaggagtagggcttataaaatctctcctgtcaactaaataatctgaatacttgtaatttccaaaatggaaacttattccatatgtctattataattaccatgccctctattatgcaataggtagaattctaagatgacccccatgaaccatgaccaggtatataattctcttctcttgagtgggaacaatacatacaacttgcttcttatgaatagaatatggcaaaggtgaggggatgtcactcctaagactgggctattttgtatggcaaaagtgaagaaagtgtgcatatgtaattaaggtccttaattatttgactttaagttactcaaggaagagtttatcccgagtgagcctagcctaatcaggtaacccattaagaagagggtccagggcttcactgaaagaagaaactcaaagacattctccagttggctttgaataagcaagccaccatgaagtctatggattcgagaaagtgaattttgccaaaaaccacatgagttttgaagaggaccccaagcatcacataagaccccagccttggccaataccttgagtgcaggcttgtgagaccctgagcagggagcccagttaaacactgcatggtcttctaatccatggaaactgagataacaaacgtatgttgttttaagccactatatttctggtaatttgccatgcaccaacaaaaagctaatataaaaatatttgaagtgcttgaagtctcacttctgaattgtgtgcttcagatgccaactcacagccctagagcagagctcaaagtgaatctacacacacatgcaccacctgtttttttctcaagtaatttaaaatagatttccaccatagataataaaaaactctggtccacatacctggtcttagtctctagatacgacatcaccgagtatgagtgggagctggaagcactgcagatattgtttagtcttctcctgcctctccaatcaggtctacttctactaccttctccctgttatagatgacaaagtagagccctacaaagtttctgtggcttcctcaaggccattcagttgcagaataagactgaaatcttgtgtcctatggtcatcaattcaaaatgtttttatttcaccctgttgtaatgaagtcttcttattgtcttataatttctaccacaaactccaacttcatttcacaggttttaaagaaaattatcctgtactctttgtcatccattcattcattcatcaaatatgtattaataacctgctgtatgcaatgcgttgttctaggagctggtgataaatcagtgaacagaacagataaaaatctatgcctttatagagtttaaattctggtgaaagggaaataagaaataagaaaaaccactgaaatgcctagtatatttcatattgataagtgctcagggggaaacagtatatggaaggacatgggagctgcaatttcctggatttcaggaagatctcttgcagaaaagtgccatctgagtaacagcctgaagacaagaagggagtgagttaagcaggtatgtggaagaaaattgttccaggcagaaggatgaagaaatgcaaaggttatgtgtgagtagaaaccttggagtacaagacctagaaaaactgaaggaagcccagatggctgaagtagagtatgtgatggggagaatgggtctgacaggtaacaggaggccaggctttgtggagtttttactctcagtgaagtgcgaagctagtggagagttttgagcagaggagtgtctgggaaaatcagcattatttcttgggagtttcaaactagaaccaagtcagagtgttcatatagctgataacagtttgtacctttcctgtggaagagaaagctgcccgtcatctgcagagaaagaggaatgagtcagacacatggagagaagtagaggtcagaagccagaaagaattcagccaggtatcacacacatgctcctgttcctgttaaattcctattttggcccagcgaactcacttctctctttaaaatggccttgcccctcattttgctgaggttgagctcaatgccacctcctagagaggtcttctttgaccatattctaaagtagcagtatcaaacactctatctccttctcctgcctaagttgtattcatgctaggcatttatcaccactttacaatgcactatttatttgttcactgttttgttcccagactggaatgttcaccccatgagggcaggctctttgtccatctttgtcactgttttaccgccagtttccagaatagcatctggctcataatagatgccattttaataattttttagtgaataaatgcaaatacctaaaatccccatggttatttactccacttggaaagcttgttaaaacatgaattactggaccctctcttgagaatttctgattccgttttgaggtggtgcttaatcatttgaatctctaagcttccaggtcatgtccttgctactgatccatggaccacactttgaaaactactgttctatacctcgctagtttctgttacaattaagaagttttagctaatgtagatgacttgaattcttttttcttcaatttttcatatgatttttgttttcttccttcaaccataataagatgatacttaaattttgtcttaaccaggagatctataaatacaggcttatccatcccacttataagcatggcaaatggtgcttctcaaaagtgtcccccatgaaccctctggtcacctaaccgaagtcgcccccttgcctgtccttagcttgactatgttgtgcagccatttcactgaatctcattccagactaatgtttccatagccttcatgattttgcctttttttttttccctgcagagaatgtgtctgtttaccgcatcaccatcacctttgggaccctgtgcctttatgtcagcactggtgctctaagaggcttcttctttgctcattttcccagagccacattttccttggggcagcatcttcaaaacttgccactgaagtctcctgaagtctttctaaatatctattaaagttctcaggctaaacttaatgtaaaacatatactcacagtaaaaacttaatggctcactcaaatattttgccaatatggagccattaggaaagagctctagtaggtctcatactgttagagatgtgaaaattaataaaatactttaagtcttatttatgtcacttgataccacatgtcagcacattttctgacattatatcataatgtctacaatgaaaatcatggaaaattttggcttactacatttagcttgatcagtgctttgtagtttacaaagcactgtttgttgttctatctcaatagcaatgccaagaggtaaaccgaacaagtatccttgtactcattttccatatgataaagctgatgcttgaagaggtcaagggcttgaccccaggccatgctgatagacagcaagagtcacactcatatatatgccaagcatgcaaggcccttgccttcacagtctatttacaaaacagcctggaagaataataaatcaatcctaagaattgctatgaaatgcctttagcataggcattaatgtgcaatggatgtacagcctattcaatttcttcatgaatctctatagtcttcacaaggaactttcactagaaaaaaagacaaacttatctgttttatctcatttttttttaacaccaaggactatgagacagatgcaaaatcatttttgatttgttggttgaggattgactgaaatcattactaattattcggcacaagtgggttccaccagctgcacttgaagaacacttcaacatcctaaagcaaaataaagtagcttacggcaagtgatgagtgccttaattatgttattgctacacttactgcgatttcaaagattaaacttaatagaatttcctgagcaatgatggtccacactggatctgagggggcttttcacaaaggaaaaggagaaaatacttactaacctggctacagctagatctggcctccctactaaaatgagggttaccaggtgtcctacttcttcagggaatgtgctacttttcaacaaatcaccctgcgtatgggatccaaagtagggcagtaaaaatgtctggctttctgtgacatgccagattcttctcctctctctgactcactgattttccacacctttcagtgtccgagtttgaagtttttcttagactgaagaaacttaggattggtcaattccccaaacctcttcatttcctatagcagaatgtgattaaagaaaaatttccaccaaccaggcaagccaaattttctagattgtatatccacaacaacaacctcagctggttgctccaaacatcaaaatcgggggttggctgcactcggcaataccaccagccctgcttgaaatggtttactgcatgatgaatgctgaactgtcacctcttccagggagcctttcccaatccactacatgctccacccacccacccacatgcttggctgaaattaacttttccatttccctgtccttccacaacactccttatatacttctcttaaagtaagtataacaagattcctagtatcttagagattcctgtgggacaaacttcacaactcctttctcttctcacatctctccatgagtttatgaaccttcaattcatatctccagaacaggtttctttctcttcacttcgtcaaaattttattcatctcacagaattcaggtcaaatgtcttttacctggccccattcttcccatctccataaagttagtcaaaacttccttcatgatctctgataactatgaaatggacccagctgtcctatagaacagatgtttatggtttcttttaaataaacatagaagttgactctcccagtcttaaaacttgagaaagttacatttgtcttatctgagttcctttttcaggaaaccaaccattgggcctcctagatagtatcaaggaactgaaactttccagatcaccatctggacaaagagaagccacacccctcacctatcatgactgcctaactgaccacctgcttcctgttcaccaactcctcttccatacctctccctaattcctgttctcctcatgtacttacatttcttccctgctctacaaacccgattttagtcagtcaggaggatggatttgagactgatctcctatctcctcggctgcagcacccaataaagccttcttccctgacaataatcattgtttcagtgattgattttctgtgcagcaagcagtaggacctaaccagaacccctggcatttcagtaacacacatttctctactgtagcactaatattgtaattagtttaattattactttacatatcttcttcactagactgtgaattcatccaaagaggccaagcttaatgacctgccacagagtctagcatattatagctcagaaaggcataacagtagaagttctcctaaccaatctctacttaatgatgacttattggtgaactgaacattctctgtagcacagtgagtacatacacctagtaggcggtcttcaggtacatccagatggtagaactgcacatttgccaagggttagtatttttattccgtaacctgtttacatcacttttgttaccgtaatttccataatttgattaaatattattcaaatcaataaaatatgagtgttttaaaacagttatccctataagaaacaagcagaatgccttgtaagtactaataaacactccgtaaagactagtattattttcttttgactgcctgatttgatgtaaagaagacaattataaaagactgggcaaaatatgtatgaactctgcaattagattgccttgcaaccatctaaactgaaaatcgtatattataggtatggtttgagcaaataagaaaacacaaatttacaactggtggacctttgcttaaagaaaagctttaattgttctactaaaatagaagtgagtaaatgtacatttatatgttttagttaaaatagaatgtctattttaaaattatttaaaattcctactttgacattttgattaactaccaggaatataagagggattctattataattatgtctttcttggttgattcattcattaattcatctgaataaacacttgatgaatactatatttgcttttatactatttaatacacaacctgtcttatggcatttattgttgacatataaatgtggcacatagtgcttggcaaattaggtacccaatgataaaacactaaatgaatctggacctattatccctgctttgattttgttttttaatgatacgttctgttttgacacatccttgtattcaaaattggcaaattaaagattacagacacgttgtagataataaacataaatcatggagcaaagtttcatgaatttttcacatttttttgaaatttggagaggctattgtttgtatatctcacttgtcacttagtaacttttacataccggaacaaatttgatatatgttttttgtccttagttggacaacaaaataacaaacattatattttagaattgctcttatccttcgccatgtttataagaaacatttgacacaggaaccatcccaaagacatttggtgactgtcattcgcttcatattttggtagagagcatcactcaagtttagtaataaaaataataacaatgagcatatttgccatgtgacagacctgtgttaaataattatataaattatctctttctagatttacaactatgatagtactcactagagaagtaggtactaacagagaaaaaaattaaatcttagataaaaaaatttgctcaaggtcacaccaactaattaagtaatacttaatacataaacaagtattaaatattaagtagttgtcacttaaatccatttgatggattttgtcaatttatttggcaagacactatttaacaaaggtacagatccacagaagtcacagactgtggtatatgagatgcatacgtgtgatagggaaattgtcataattaatagcatctgtaaacattatccttaacagaaattttagagatacaatgtagtcctatatccaagagtgaaccttcagtcattcacagatctggtaacagggcatctgcgaactttacaattcactataaagtaataaatggtaagcactggccaggtgcagtgactcacacctgcaatctcaacattttgggaggttgaaatgggaagattgcttgaggccaggagttttacaccagccaagacaacacagcaagagcccatctctacagtttttttttttaacagttagacatggtgggcctgtagtcccagctactcaggaggctgacacatgaagatcacatgaatcccaggagttggagactgcagtgagctaagaatgtgccactgcactttagtctgggagaccgagcaagaccctgtctctaaaataaataaataacattttaaaaaatgttaagaattattaaactgttatttattgtattaactagaaactttcttgattcactctgtatgttattgagcacagtcttttgtagattgttgaaatttgatgaaaacacaatgagacagtctcaagcagaacagaaccttgcatcatgaatcatgggtatagaaggcaacattctctaattatctttgaaagaaggtacactatacatcaacatcatcatcattcaaaaagaacatagaagacagaactaaattcttctataaataagaaatggactcacttggccatcattgcaccacctattggtttctactatgctcatttcttcaagatattatagttgtattttgtcatgatctttggtggaatattttatattttttatttatgtatcagggaggttttgttaaaaaatttcaaggactggatgaaagcctttcgaaaccaaaaaatatttaaaaacctaatttctcattactttcacatttgggcatttaaaaatgtattagcttttacaattttttcccggcattttatcttctattgcaattattgtcttttctgtggtcagatgagtcaaggctttacttgtgtagattaacaactgttacttataatagcacttgtaatttcacaaggattgcataatcaaggtcaaatctctttcctaatgcctgccaccacttctccttaagtatatagagttcttctaaatctaagtgatatagtactttcttataaaatacatttctaaaataatcataaatgacatgccactattcaattcctatagtactcaaaaattcaactcttatagtacttttgatcctgtagtgatgaaaagttaattgcaaatagtacggtcattaattgctatcacctttttaagagcgagtatgttcttaactgtttctgcaaatagaagatgcaataggaataatcctagtctcgaggaggaaactccttttttctaatcaagttttataaggaacagtttttgagacatactactgtaactctgggcttttctccttctccttcagtgatcagccacacttaaagaaagttgtcttgaatactggatttaaaacattcatttattttttcctacctttctcttttaatctctctcaaatcaccatttttcaaagtatctgttttttggaaactgtatcaattgctacgaaaagacagaagtataaatataggtgaggagatttataataaacacgggataatgataataataacatcaatataatgtaaaagttatcatatcaacaaggaaaaaaatgtaccatgaggagcaacataaaacaaagtttaaactttggcaggctgaagccaaggaaacttttgaacacttaatataccatctttcaaatgtctttctggagagcagtttgctaaagtgtactaaaaaaagttttaaacttcatgctttttgattcagtaaatccccttaaaggaatctattttaaaacagaagcttggcaaatataagtgtaaaatatgtaatgacaatggtttttaaaattaaaatagtcctggaaattataaaatgtccaaataaaaaaaagtacacaaaatgataatccacttgatgatagaatattattccaccactacaaagatttgagaggtagaaagaacattcacaaaaatgtaaaccttctgaattataataggtgattttcatttttatctttataaatttttaaattctccgagttttctttattgaactggtattgcttttgagctccaaataaatgctactatgtgttttaaaagaatatctgatagcatggagtatgcttacaatacaatcaagatataaagtataattttaattttgaaatataagtttacatatgcccacggacaaaaacaaaaaggactgttaggaaatacgtggaaatcttaaatgactacctgttattaatacagctggagataatttatattattttattttagtttagatattttccagaattttataatgagtctattttactttcaaatggtaaatgtgtgtgtgtatataacagagcaatagaagtcaatgtagcggaattcctttccttggctcaaacctgaggcttcctctcagaccttgggacaaaggtctgagaaataatatgaggcttttacattatttaatctcaccaaagaatgaatgcatgaaaaataaagcctaaagctattttagatcaggatttttatttaacatcaagtaaatgaaaaaagagataatgaataatgggactacccttttatgatatacaaagcaaggtattgggtctaattacttgatgaaatttaaaaatcaaaaaaaaaaataaagggaaaacaatgcagttaagtttccaagtatattattaataaataattgtaggaaaagtcagtaagtccatatattcatgtacggaaacagaacccatgatggatgagcattggttactcctcattgctggaggttttataagcaaacaggccagttttcttcttttgtggctttgtgagttttgccccttgacataaataatgtatccctaaaataccatgaatgacaacaaactaccattttgtcttccttgtctatcttcagtatgtggtggttctactatagcagatcacttcaacccaaatattatctttaaactctccaatggtgtacacttgaataaagagaaactagaatatcttaagtaacttggatcctaaaattcacagagatcaaattgtacatgagcataacaacctttatgaagatccaaagaatgaatgattcattggaaacaagtatgttccaaaggctgacctcacagagcattggacctcagaattcaacctccatctctgtctttctttccttgtattttatttaggtttattctgtagtaatggtatttccagggtctacatctttacttggatattttgttcctctttgtgtgccttctctctagagaaatgctgcaagtatagatcaccaccttattttagcttcccattactgtggcatgtagaagagaagcaaaggagataacaaagaaattgatatattctattcacacaggggtaggatgggaagatacaagcttttaatgaactggctaaagtttccaaaactcaaactttttttttccataatttttgcaaagctaattgaaaccagatacaaaacatcgcagacaaactacctaagagtaccttgattattccttctgcattgttctcactgttatttatctgaagaaaggggcatcctagacgttatagctatattttcataataaactatctatgctaattatgttgaactagacttatcaggaggatattaacttggggtacttaagaattagttgtggtggctcatgcctgtaatcccaaaacattgagaagcctagcggggtggatcacttgaggtcaggagtttgagaccagcctggccaacatggtgaaaccctgtctctactaaaaacacaaaaattagcgggtgtggtggcatgtgcctgtaatcccagctactttggagcctgagacatgagaattgtttgaacctgggaggtggaggctgcagtgagccgaaatcatgccactgcactccagtctgggctacagaaagagagactgcctcaaaaaaaaaaaaaaaaaaaaaaagaattagttgagactgatgggctactaaggaaatctctcataccagttaatcaatttagctactttgtatctcaaattggcatctctaaattgtgactgaaaagtatataatcccttttcaaagcaagtcatggtgaaaaatgttcccacttaagccaaataaacaaatgtttatgccactgatgagtagtgccccttagaaatcatcaaaacccgctttagggattagggcagaacatttgagagtataattaaatgcataaaagtgcttaaacttgaattgctacaaaatatagaaaccatttggaaatgttttatggatcacattaatgtgtgtgtgtccccgtgaaacataagatatatagttgttgttgcataatgagttctgacagcacgcttcctagaagatgacgttcatctgagcagtatcttacttttcattctacagcattgcaaaaagtgactaatgatagagaaaatactgaagagcatctcctttgatactaacttcaagcttctaaaccatgagaaggacccatttaaaacgttaggctcatttactgatgagagtggaccaaagaaaatcactctatgcatctaagcaacagtatgtagtgtcatcactaatttatgtcctttgggtaaacgttcttgttaaacacactggtttttgacaattttgttggaaattttctgtttataaatttcctcttttattcagaagcttggaccaaatcaaataacgcaaagtgaacaatgctcttttggtgatgtgcaaaacaaagagaactctaaaacattctgttaattttaataaacaacatgacttagaaaaaagtaaataaatcaaaaagcaagtagaatccaaatacccaaataacgggtgtgttagataaaactattaaataggaataaaatcagataagaaaattgcttaagaccttgagcctgctgtgaaatatttagtgaatctagggaacaaaggataacataatgaagctaaagtttaggaaacgtaagtgttcacctatcacactgtcttagaaatgtgtatataaatacatacgtatatatgtgtgtatacatatttacacaaatgtggctatatattttttgcaggtttttatacatatatttgagtgtgtgtgtgtaaataaagttcacagggatggcctgaagcttaacctaaaatatttctatttcaaagttgatcctatttataggcgtatttaacagagaggctatacggacaatttgtagagatcaatagttggctgtatagaaaggattttttttttaccctttataatgttgtgaatccctaatccccagtctcacggtaagtgtcctacatatttagtagagggtgatatgaacattcaattcttaaaccctttggtgccagccttaagctatcagtttgcaatatttcatatttacaatctaatctaagcttccaggattttcctcactctgaaagataaaacagacattttaaaatatgtatcattaattctaagttttagcaaataaaattgctacactgagacaaaatgtggttacaaaaatcattgtgtcagttaccaaaaatcccaagtctaccacttagactacttttatgtcccaccaataaaaactataaccccagaccatccaactgaatgagccacgaaaattacccccattcccatgttactgcctttccaattcccatgtcactccctttccaattcccatgtcagttgtgggtctcatacctaggtgtggggaagcaaaagaaagtttaaattatgagaaattgttttcagatacttttttttatgatggacacttaaaaatttggggaaatatatatatgatatatgatatatatgatatatatatcatatatatcaaagaaaatcaatgttataatcagccagtctccccaaatcaccaaagctaataaaatattttcttccaatttatagacacacacacacacacatacacacacagtgaatctggtattctaccaactaacatgttataaacattttccctcctcattgaaagttcctcaatcttcctttttctaatggctgtataatattccataatatagatatgttgtaatgtattattaggcaattgtaatggaagaaacattttactagaaaatctggattacacaacctagtcactgtagtaaagtaagagcattagtagaaactgtaattgttttagaagcttttagaagtgacagattcacctatcgtttcccgtactcttcaccgacattccttaaggagcagattctgttcagcttgcaattgtcacttggcttggaatcatataattatttaccactttttttttaactttcaattgtggataaaatgtttattaaatgaggctgattcacctcagctccaaagtctgtggcaatttctcacctgcttcctgctaattattctaaatagttacagaaacataattgtgattcaagtggttctccaagtagagtccctggaccaccaatttcagaaatacctgagaatttactagaatgtcaattcttgcataccatctaggtctactaagtcataaactctgaggatgaagttcagcaatctgtattttaacaaacctccaggttattctgatgccccctcaacttgaggaaccaccatcttatcctatagacagatcatgctgttgaaatgtgccattttcacatacacatagtccacagaggcttctgccatgttttttttaacaacccgatatgtaacttttgtcccagcaacattttaacatcaggggactgcatccatttcaatctgaacacttttgtccaatcactccaagtgagcttaagaaaatgtagagtaaatttttttaaaagatctgtgtacccaatttgatagacattttatcttattttggcatttctattctcaggtagcaaattgcctgaaagggcaaacaataaatatgggagctaccgcatggctctttgtggatatatttggaggcagtttaacatgctgtggagatgtttctagaaagattactgacaagatcaaccattttatgaaagttgcttttattacctttggattttttctaacttgaaaaatattgctcttaaagtatgcttctctactaatccttcctgttgagcattctattctccttaaaatatatatatatataaatatatatgtagatgcgtgtgtgtatatatattacacacacacatatgtctgtgtgtatgtgtgtgtgtacatatgcacactcacaaataattaagtaattccattctgggagaaagactttgaagaaaagcagtttatttgctactcagaaagggaaagtgatgttcgtgggacataaagggatttgaataaataggaataagtgtccttttaaaagaaagcagcatatggaactagaaatactttctggaagctctaatctcctatttgaagaaaatccaattgttctggctggtggcaaactaggagattacagctgaatttctctccctccattcaatgtgaagtaatcatagagccataaggaatttgacaggaaccataaatacttctcctgtaaatccctaaaaatttataagagcattatgactttcatgctctttctttcctagagtctttacttcaaagtcttctgagactagaagagcccctggagcaatcattctgcttccatatccacaacttggaactcttagtcccagaccctcaaattatagaacctgagggaaaatttagggggcactgaaaccaaataccttcacgtgtcagatgacaaaataaatcaggtagacaaaaagtgttaaccacatcacgcaaagaccaaaacccaaagttccacattttcaggcagagccctcagcctcatgtcactaggcttcatttctaccaatatcgccccactgactaaatgtcctttgtcactagaattgtttagttctgcataaatacaaagtatcgatgatcaaatttgacttatttcttctcattcagtccttaagtggaaacagcaaaatgctggttgccttctcttaaaaaaacaaacaaacaaacaaaataagaaggaaggagaaggaaggaaggagaaaaataaaaaagaaagcgagaatgaacaaagagtgaacaaatgaaccaacggaagaatgaaaaataaaagaaagaaaaaagaaaggaagagaggaagaaagaaaagaaaaaagaaagaaaagaaaaagaaaaagaaaagagaaagaaaaagaaagagaaaggaagcaagcaagcaagcaagcaagcaagcaagaaaacctaaagatctttatcatcacatttaaataagagtaaatctcaagaggccatcttatctacccgttcccactaggcattactcaacagagaaccaatagctaggaacttcctctattcctaaagattttcaagaaaggaagagaaatatcttgggaagtttaggaaacataaatatttaggctcatttattgatgaaagtgggcaaaatgaaatcatcctatgcatcttagtaatactatgtggtatcacaagcagcttgacataacaggctggtatcaattgtcatgggtaagtgctaattgctgaagatctaccaatttgctgtgtgcttttactaaaaatatctttgaaagttccacagccttccaagattttgtattccttgatataacctttaaattgccttcttcacattccctcttgtttgttagtaatgaaatgccaatgatcacagtaccggaaaaaagaaaacggagaagaggacaataaaaaatcatggttatgatttgtggagcaaaggagggctttcagcattaatatttacattaatgtttacgttaaagtgggacagattacactactttttactcacttcacttcttcttaccctgcatagagttaaatacttactgtttgtgccttgtaagaactctaaagattatagtgtactagtaaatctactttattttgctggcaggagtcagcagacaaaagaggagcaggagaaatgttgtcaaatcaatagtgatactgactgaattttatcagtgtttcatctttagctgaactatatgaactcattcagattttaaaaaatatgtaaactgtctaatctattttatagctccgttttacagagttataacatgtcaagaacaaagttacaaaatccaaaacatacaagttagcatcacctctatttttttctgaaaattccgaaagtacaatgattagaacacacttcaaacctcacagctctgtattacttaggaaaaaaatcccaacagctatccagttgtgctttgaggtcatttctcaaagcatgtgcattaagaaacttagcaatctatgtttatggttgctttatctggtagtataatacaatgaaaatctcacatataaaatttataatgtgatatttacaggttcaagggtggaattgctatgttccaaatgattttctgtcatcccttagttcactgtttctttaatcctttaaaacaatctgtacagcctttgctgtaaaagattattacattcttatttccactgtgtagtcataattttgaatgtactctctaatttaccaacattgtttccaattccatataaacccatatgagggtgctcccagcaaaactaattagggggataactgtgtaatgtgaaaaaataaagaattggaatattatccttgtgtcatttgatttgccaaaattcagcttgtaacaattagatactacagttggaaaattagtgattttatttatataacaggatctgtcataaaagagccaaactggcaaaatcactaatagtcataacctaaatcacccaatcaaccaaaatattataaagttcagcttttatttttatgcctattacccttttcatggcaatgggttatttcaaataccccaccacaagccctgagaacacagctgggttacttgaaaccagtagctctaaaccagtggtgacttgccccttaggtgacatgtgtcaatgactgaagacagttttgcttgtggcagtctgggggatgctactgacattttgtgtagggctcaggaatgctgctaaacatcctacagtagtgcacaggacagccccccacaaagaagaatgacctgggctaaaatgtcaacggagcttaaaaaaaggttactagtctaagtgagcttaagttgagaaaccctgcactaacattaagaactatgtgtccaacacggttgcaacatgttacgcaaacacctgcattttgtggggtggggggtgaatacagccattctagggagagtaatttgttctaacttgggtatttctgcccaataagctagtaagatatttgctttttctaacgtggattcatcagggcactgaaatttaactattttatttaaaatatggtatatactatttctttgtggtttttctgttagtgtgtgtgtgtgcgtgtgtgtgtggtgtgtgagtgaatttctgaaacagagcggtagcaagcaaatggcagatttggttttatcatcaagtttctgttagacatttcgataagattatacagagcatatagtggatgcctactacatatttattgatttttgaaaataaagtttgtgaacctatttctgctatcttcctctttagagaactgtgattgcatttttcttctttttttctaacatgtatagagtgcctgttgccatagtaatcactgatttagcacaacgtgttttttcctccttctttaaaaaaaaattagttcccattcctgccaaaaaggaacatattaatctacccatcatgctagcttggggaagttgaaggccacagaagttgtcatttgtgcaaagactcccagaaagtcagttgttagcatcttctgtgccaagaactctaccccaatcccagagaggaaatgagacactgaagtaaaagattctggagctgaggaggtaacatctctcttcttttctgcaaagtcccacaaaagatgtgcacaaatgctcatgtctgtgtaaacaaattcacctactgattatagatttaacagaccactgatgtccagaaaacagggactaactagacagtgctctttaagacaaaagtttaccttaatctacttacttctgagggtaggggaacaacaacaaaagcaacaactaaagaaacaaaaaccttttgagaagtctaaaagaagtagagaaatcctactgaagaaaccaacatcaacagtttcatttctttatcaaataaaaagtccggcctgagtctcctgactgactacattctttctagtattaggtaaatcagatctcaaatctgatctagccctgctattcagaccacgaattcctgtaaacatacctatctagaactgtgtgcaggcccctcttatgacaatggtctgtgctcacctggatttttatcactggcactcttagtcaggaccaccagattcttcctaatttctcaagtcaaatccgaaggctaccctgcttgtggtgttccataactctgtctggcccctcatgagaaatgccacctacttggatgagagcatttaagtcagagcaagacagcacagaggttgactttaggttcccatctgacatatttactgttctaagagaggaaaggtagtggaagagaaagaaaaactaaagtggaactgcaggatttctgattttcagaaatgtctgcttattatcagagtgataagaactcaaaattaagacatgggaaaggaaaagatagggatatagagtcagagctgttccttaaccaaaggctttacagaattagaacacagctgacacaggaaattcaatgcaagaaggtcctgctctaaataaaaacagatgaggagaaagtccattcatttttactaatagtatgcatggagaatgaacacacgctgccttttacatagacccttataactgttcatactgttctgtaaaatcagcatatttcttattattttcttctgggaaaaaacacttggctatgcatttccttttaatttcatggaaatgggaaaggggtaaaaggaaagaaagataatacttcctgaaaacttgaatgttttgctgaaaacacccttaaaggaatgtatctctgtcagggtaacaaaaacatttaataaaatatttttaaagcagttggtctctaagagaaaatgtgaggtatatgtaattagtagcaaatatgcattcaattgtactaagcatgaccattcttcccctttaaatcctcaatccatgaagtgtgtttgttaattaggcagtaacttgaagagcgctgcttttcccatagaagtcaggtgctcaactactcaaccatgaatctctacggttacatgaatctatgaatggtctgcaaaccacttatactccaggtttcaattctgctgccagtaataatagtaataataccatcattctattctagtagcacagtgcaaatttaagataattagaagatgatgatagaaatttgaaagcaatggattacaaaacaagactgcatcaaagcataacacgcaacacaacactttttcaattatgtacataacctggaaaaactagttggcaatgaaaaaaatgtgttgagaagtaccttattaattcattaaatatttctgtaatcctatgtttctttaaaaagaaaaaaagattactagtctaagtgagcttttatctttgttaagcagcatccttttaacctccatcatctctaataactaaaaaaaaaaaaaaaaaaaaaaaaaaaaacaagagaagttaaagaagcaaaccagcaagagaaactgtagttgctgtatcaatgacaattattccagtgataatgacctgactttttgggttggtcttctagctagtccacagggatccactgttcaggacggtgttaggggaggtgggctttgtcattttgcacaaggtttgacaggtttcagggtttaaatctgcaatttccatggccctggaaaagtaatgtctaaatattgcttaactgaaagttgctgatgagaatatttcagtgctctgtgcaaagagtggatccgtggatcagttaattttattgaacagaaaaaaggtgaagtattgttgtagggattgaatgagaacagatacacagtgtttaaagtaattcctggcacatagtagatatccaagaaggtgtctgactccaccccttccttttctctctttctgaattgtattccactgtcagctgctagtgtatacatgtcatgagctaatgtgcccattgatggtttagcttatgactttcaggtcagttttctaagttgataaaaacaagcattatagataataaaattcagaggcagttccaacatggaataattggcttgtctcattccatagtcaaagctcatctcaactaagttttccattgctcacagtgaggactagggaagaggaattgctgcaaatccattttcacaggtgggtaatcaacacaagaagcactgtcaactgattgtgggtgtgaaaccatctacgcacttgaaagttttcatgttatcattactatgtatccacatacatttgccgagcctgaccgttccagatcagtcttctgaatgctagctgcatatcagaaccacatatgtatagtttcataaatgtgacaatactcaggccctaccctgagacaagtggcacaaagcattcagaagtggaaaggattctcaccaggagaaccactctgagaatcaatagaaacagagatccaggtcaaagaaaaatattatctttcttccctgggaatcaccagcatttgcacagacttctacaactagctacatgacccagggcaatttcttaaagtgggacacagtgtgctctgaatgcagacctgacactaaatttatcatggttgggtagctgctgccttatggagaatggcctgtgggacactgaacttacacattaaacagctgagccaacggatgtttcaactgccaggaaaataacagaatggggagaccctctgttcatttgacaccagtgccagcttggagaaacagcatttcttctgcagttattgaaagaaagtaacccagaagtacccacagtcttttagctcttaaaatatggagccactttttcttttccagcttatttccaatgcaaacctgattccaggctcaagagaagtacaacgtgccttggtcccttctccctagtcttggtcagcttcttcaattcctcttgctgatctggcctccagtttggctggctttttagaggagtctctcagcactaccagcagagtcttttgacctatgttactaacgcgtgtatcatatctagatccactcctcaccatatgtcatggtactgtcttgttcctggttattggtggtatatttgtttttctactgtatgtagttaaattttaagtaacttaaagaattacaatagcaatacaatttcattataaaaagcagaatatgtggataaacagaaagaagaaaataatatccactatcataccattaaggtgacccactaacacaattttcaaataaatttcctacgtacatattttatttttataaaaatgcaatcatagaatagtcaatatgatttttaaaagtcccttttatgaaataaaatatgtgaacatctttttgtaaataattattcatttgaaacattcttttaaaatggctgtatagtatttccttgtgattttcataaccatccccatattgatatttagcttgttttgaatcttctgctgttataaactatgctaggatgacagttacagctcttcttcaactgctactacccagtttgattgataaatgacacacttcccttggcctaggaagaagcaacagattctgatgtttgcaaaatttgtcagtgtggcttatcaagaaacagactctatctctctatttatctatcatctatatatttgacaaaacattttgaaaaatgacttttaaaaatgaaataaggaatgtaaagtcacaaacagcccagggacccaaatgagaaagcatctgtcagagattcatcagtcaggagtacctattattttaacattttcatggtcatataagaggaaagaacaggtaaaacagccaaagtatcacctgattcccactgatttagaacagaactgcagaaatgttgaaagattttttattagattaagcttcccagcaagaaatctagacagcaatctgcagctagcaacatgccttcggaaaaccaaatacgagattcactgacactgttttgtgagggcctcctctacccctcgtctcccctacccctcgtctcccctttttcacataccccacactaggatcagagaagtttggggaaaaatcaacagaaacaacacgccaggtagattatggccactgcaaccttgctgcagcttaggctaggctcttaggatgaccttctcaaaatccttgaaggagaagttggctgaaggaattttatgcaggtctggaatggtctcgtctctagaggtctagatccaaaaaataaaaagactgcaatttttaatctaactcttaccagaatgaaaaaccatctaaatgctccctaggggccttaaattgttatgttaccaaaaatgctatgctgtgggaaatactaatattaagtaaatagcccctgtcatttttaccaaggacatttgggggaaaaaaagtcactgatgaataagtgaaaccatcttaagttgctgaaactgacataatgaaaaccaccatctttctaaattccttagccaattaactaagggaggggaccacccctcatattgccttatgcccaattcctgcctccaaagaaagaaaaagtaaaaactaaaaggcagaaatgaaatccacaagcagaccgcccggcgccacaccctgggcctggtcgttaaagatcgacccctgacctaatcggttattttacctatagattacagacattgtatagaaaagcactgtgaaaatccctatcctgttttgttctgatctaattaacagtgcatgcagcccccagtcacgtacccgctgcttgctcaatcgatcacgaccctctcgcgtgcacccccttagagttgtgagcccttaaaagggacaggaattgctcactcggtgagctcggctcttgagacaggagtcttgccgatgcccccggccgaataaaccccttccttctttaacttggtgtctgaggagttttgtctgcggcttgtcctgctacgtaacaacttgtatcattcatcactacatttatttccattaacctatcctagaaccaaaagatcctagaaccgaaagatgagggtacataattgaagggaagactcacccaggaaagaaaaagaaaaggagtcagactgggctatctgagaattcacaaaggaactagaagctgtgtagtcaaaatgttcctggcaacgtggcaaatgtatttcaaatcaaaccatgcattcactagactcttcttttctaatcttttgttttctcttggcctgagtcaaagtcctttgtaaaactttcatggatcacatgaggaggaaaggggagaaggagaagcaggcagacagggaggaaatgagagggtgttcctgctggcaaactcagtggggaatgaactacctccttcagagggaaaatgaggtgggagggacagagagccacggaaagaaaggtaccagttcccttgcaagatgggggtaggagagggctcttctcagaaaactagaagagattttggtgatgatgtcagaattggagcatctgccttctaaggactttgtctgccaactggcatagggagcactgcccagagagccagttctccgtgtaataagcaaaggcaggaaatgggcagggagcagtaaactcagtgggaaaagccacatttgaaaaacttgggagagaggaggagaaaaaggaagccacacagaattttggtgccacgaggaggaggacatctgtatcttgtatttgcatggtgttttacagtttagaaaacacagacaccatcataggtcactgtgaggtgggcacatttattactattttccagttgcagaaatcatcacccagaaataagggaaaaacctgattgcaagtcttcttatatgggtctgttctttctactacatctaagacatttctctgtggcatgcctgcactttgcagtgttatcttccaaacaccatctactttcagaaccctacacttcggagaaactgtacttgtaccattcttcaaacacgctacaagttttcctgcctctatgtatttgttcatactatttcttccccttaaacttctttacccaacttggactgttagaatgttgcccaaacctttcaaggtctaaatctccatgttacctgtttttcttctatgctattttttttaacatgattctttgtattacagatatttacaaacatttcttctcccatactaaatttaactttgtattcattttactgcctagtaaagctccttgcatagtaaggaaactagttttgaattaataggccagtcaaaaaaaaaaaaaaaaaaaaaaagaaagaaaagaaagctttgtgagttcttaatatgtattttttgtcacattaagtgaaaaaaaaaaaaaagttccccaaagtcatgaaaccaaagcagattctatttacatttagtgtaagattttgctaactgaatactatatcccaagtttatggggaactatctatacttacttttatatattgatcttacattttgggtgtgtggttatgaggttaattcattaaaatgagtaaaggctcttaatgattctttcttgactttatgggtcatgtgtctaagtacagaagttagtacacataaaaaactgtaattgggtactaaaaaatacatatacagattgccccatatctaattttctaactttaagtgtataattgtcagaggcatttgaagcagagcaactccatccatgaataagggctgggtaaagtaaggctgagacctacagagctgcattctcaagtggtgaggcattcttagtcacaggacgcgatacaggtcaaaggccttgctggtgaaaggatgtggtaaagaagctggtcaaaacccaccaaaaccaagatggtggcgaaagtgacttctggtcttcctcactgctgattatatgctaattataatgtattggcatgctaaaagacactcccaccagcaccatgacagtttacaaatgccatggcaacatcaggaagttaacatgtatggtctaaacagggagaaccctcagttccaagaattgcccacccctttgccaaaaactcaggaataattcaccccttggcatatgattaagaagtaactgtaagtataatcagttgagcagcccatgctgctgctctgagtagagagtagccattcttttattcctttactttcttaataaacttgctttcactttatgtatttgccccgaattctttcttgcacaaggtccaagaaccctctcttggggtctggattaggacccctttccagtaacacaactgtaggcttttattgattgaaacataggtgataaacagaacttcaaatttcctttgattttctgtcatggcctggattaatcgccacattttccctaattatggccatcatcttttccagtgcaaaagaaaaactcttcaccacgtctttctgcagagtttccacccaatcttgttttccatcacaggaaagtaaaaggaaagcttgcaagtgtctgtagtcatcattcaactactcaacttgactagaccatcatcacctactcctttaactttgtgctcagtaaactgtctctctcagatgaaagtcattgctattagctaccaacacaattgtgccatttgattttttatttgtgacttactgttccagagctgatccacagttaacgaaaattaaagccacaaatttttcccctaattagacatttgtgccttccataatgacacttacatacaaatgacactcaaatgtataagatgtaggctatatgcacaatacacataacgaacaccacatgaaacaattttggaatttaaatttagattaaattggtatttaaagttaatcctcattgaatatgaaacattaaaaaggcaagcttaaaaataccaagcaatttggcattattcagtacagcatgtcaattcaccttattcaaaagcaaaccttttgcaaagcaaaaattctcccattaaacccaggcattaagaagaaataaactcttaattacttaaggaggaaatgctctcgtttcatggttagcaggttatcaatgtaaacaatccagggagctttctcaatggctcctgtttcaagagtcccagcctctattccccattccccatccgccaccctctttctacacaacaggagctaatgtctttatgcgtaccaaaaaagacactactgaccacaatgggagagcttaggtatttgcccacactttccctgcaggagtaaattcagtagaaccctataattctgaaacagtcaagtcatggaccatctgactcattaaatattccaggcagccttgtcagtagtctggaagaccttgcagttataatttcttccctctgtcattcctctattaatactcagctaacttgaatttcaacatgagctttagactagctgaagaacatttattgtgcaagattcataaggtacagaacctattcatagaaagcattttggcatccaaaatatgtgtaactaataatgaataataatagcattgtctccgaaggcaagagcacaaaaatacagctatgaagcaaaaataaactcctgacagtgccatatgtaccctaaaggaaataagtaaaaagctttttttctgaatattagttgtcactatttcatttgattatttcaaaatgtaacttttcattaacttaggtttatcatggatttgcagatacactggtatctaatagagaatattaaccttagactatcaagataaagcaaatccatgaatttcagcatttttttttaagacatatggtctcactatgttgaccaggttggttttgagattctgggctcaagtgatcctctacctcagcctccaaagtactgaggattacaggcttcagccactgcacccagcctagcataattctctatagcttttacacttgtccaactttaatggaagaaaggcttctttgtacacaaatctgacaacatatctttttttctttagttgtgtatgcctatgatggtcaaactttggactattaacatttttattctcagttgcaaacactaagaaccattctacatttcctctgtaatgcaacaattttgctgatgccttcagtaattatgacaatacattttttgcaatagatatggtaatttgaaaagaacacatttaaatatatggttttatgcaacagctatcaaatatgtaaaattcaatatcccaagagtttgtgcatgttgaggaaagaaatccaagaaatatttaattaaactaatgaatcatcattttctcactggtcttccatgtgctgtatttattaagagagagaatatgggctctaaagaccattggtctgacttagggtgccatttctcgcattttcatgatctgaaagtaaaactagagcatttcggcagtttcaagttggcacgagtgcgttgcttcctagcttgaaatgcataattaaccagaaagctagttgttgagcagttaaacaggctgtccaaaaaggcccccattgctgttcaaatgaatgctgaaaagtagggtgccacagtgatttttttgttttatagacaagctacatacaagcaattgacaaagactaattttcctttcttttcaaagcccatgaaagcttgtgggtaatagcaattatttctatttgtcaaatacttgtatccagaagtggatttataatcccacgaaaattctgtaatttactgaaccactgagcaggtccatgctactccccctccccagccccataggatgtaattcatttcaacagaggattggagacaatgatgtaaatgaagcagtcctcacaaggcagaaggggaaaagtgtcaggggaacatacttcttaattcccataagaaataccccaattactggacagagtgccaaatttcagaacataaatgaatcccattcttattaccgagtggagaagatgctagggcaagaatagtggcttagagttagaaggagacatacacctacaattgctaaagcaatttctgcaagaaaaatttaaataaatatgggaaacattatggatcaaatccaaggaaggtcttaaatatatagtgctcaagaaaagtgcatgaatgtttccatacctcaaatatggtattttaaaagagcttgcctttaaaatacaatggatgtgtcatgatctaacagttgtccgcttttccagcacatccgactaactagaattcttgggagatcccatgccacaattcattttccaatttctaacaaagacaatgcacttcacatttttacttttgcattccagcacttacttgcatggtggtttatggttggtttgtgtgtgtttcttttttagaaatgttagaatgggaaaaatgaggtaattcttcaactgactcagtctttaatgattttaatgagttccagtgtttatgcttgagctaacaggtgccttatttttttccttggctattctttcttcccttgtcctcctattccgggcaatccatgcaacactccagctgtaaattattctgatggtatgaataagctttgacctgaaatcaggttagtaactaactgaaatctaacttacatttccataaatttgctgttttgaaaatgattagcatgactttgaaaaatctgttagctgaatcttcaaagactactataatcttcacaaaatcattttatgtaatatgtcttccatcactgtattctatacatacaacatcctctttctatagcactgaactcccaaattgtttccactagtggaaaaatgcagttaatattggattcatttgttgtcagtcacctttataaaatatacacacattcaaatgcacatggacacaggctccgcgttttaaattccgcattttctcaaaaatttaaacatatatgccaaagattatgcaaaatatgatctccctatagaacattttctttttgttaggcagtgtaaaaataatagaatgtatcactgttcttggagctttgtggattcctagactttgtaattcttcatgaatgcagagttatttttccaagatgctagaagattccccaggccattttaatagttctattattaaatatataataaacatgattacttatttattgtataatggatgtataataaataaacgtcagaaaatttcaaaacttctaaatgggttattgagctatcaaagtctgcagcttttcactatcagacaagtgagggtaggaaaatgggccatcacacgatctaaggtgaaggctaagggcagacggtatattagtaagctagaagaggggaatatcttcccaggtggactgataagatcagtgtggcagagctgtgggaacccaaggccctctgttactcaaggctgtgtgtgcagtgctgagaggtcagccatggaggaagcaacatggtcctgcatttcgatctaagcctacaatctaaccattgtcagctcaccccatttgtttcacgtaaaagcaatgctcagagacatctgcagagggacctaacttctcaaacttgccactttggattgaaaccgtatatgatatgcattccccctatctacgtcacatgcatatacatagcacagtaacaaggcaatcctctgtgttgtgttctcaattccttctccacagttttttttacttcatgatgacaatgcaaagagtggactgaggactaggcttaccaggttctaggcccagatctgcccctttctaactgtgtgatcttagtatgtcactcagcagatttgtgtgtgggtgtgtgtgagagggagtctcactctgtcatccaggctggagtacagtggtgcgatcccagctcactgcaacctctgcctcctaggttcaacagattctcctgctcagcctcctgagtatctgggattacaggtgcccaccaccgggcatggctaatttttctatttttagtagagacagggtttcaccatgttggccaggctggtctggaactcctgacctccagtgatctgcccgcctcggcctcccacagtgctgggactacaggcataagccaccacacctgacccaccagattcctcatggactggttccttgtctgtaaaaatgagatgatttattagatgctatctatacttccttcacttcttcaaacgtcagtggtttcttttttattggtagttttctgtcttcctgccttttgcctgtgtccatttttccattttcattttatgaatttttaatcctccacctcagtgaacagcctttccttccacaccaacaggtcctctgtcctgaaagaatatcacagctctatattggagctcccacagctcttggtgcactgcattttgattgctgtgctgcataaactgtcaatttctttccaaaaagacatcctctatcttgtttacccttatgtccccaacttcctggcactttgtgaatattcagtgaatatattttaaatacttgaccttcctaaccttttcttggaaggacccttcaggtaaaggagatggtcaagaggagttgcatttgcttttctggccaactctctttacaaggagccagcctcctgttcagtctcttctgaggtgacttttctatcctgtggatcttcactggtgactgtaactactaaccagtttgcatttattcactcacaaatgcagggacacacatataaccgtgttaggcatcacagagcatatcccataagtgataaagtcacaaatatgttacccccataacaagttaataatcttccagcatgccagaatgtcagtttagccacagaaacagccctatatattcttctacaatctctagtttcttttctaccctttcttccctatcacacaactcctaatgtagtttggggcatcaaatatagttcaatacatttttatgccaaaagtttcttcggaattgaaccagatacgcctgatctaaacttataccttcaaaagtctttatgttgttctctgtgagatacacagttactcaaataatcctcccaggcttaacttatcaacagtttgataaattagcttagactgtggatatcctcactgcagcacacctctgcagattcacacaaacaaaggccaatttggaagcactaagtgaagagattctctcctgtttcattttctccattctcctcctaaaaccacaggaaattttggcactttggacattccttttacacaagggacacagtaaaacataattcaactgcttgaatctgggtgaagggagacagcaattaggacagctttggaaaaataagagagtaacaagtaggtggcccaactgtgggaattgaaactacaataacagcttctaatgaacaagtttctacacagagaagcatgccttcacacacacaacagtggtaaaacagcacgaaagacctgtatttcgaaggggcaccagttagatatttaaaactcacgagtatggtcaagatttagtcatacaaatttattatcccttgcacttgactaattctgttatgctgaaagatagagcatttgagcacatttcaacttaagtattgaatccaaagacactgaaatagaaaaaaaatatagccataagaaccatagaaaaatggaacaaaagaaagataagagaaaaaaacaaaattttctcggtaactgtaactacataggaatgaaaaaagttgtaactatacagcgttttaaacagtagtcaatgattatatgtaaatattgtttttgacattacaaatataccaattcaagacagacctgtaaagtgctgctttttctgtagtcatttacattttgagacaatgagacaagaatacaaggtccttttctcagaacaaatttccctgcaatagtcacatcggtacagcttctggtattcatgtaaaagaacctattagttgactaaaatacccctgtaagttcccaatcatattttgttactagggtatattctaatttttttcctacgggaaaaaacaaatctgtacattcaggcttcaggaatatagttggagtaaagagaaaaatcaggatttctgccctgcattatggccaaaagataatggattcttaggctctttgtcaaaaacttcctactttacaattgtccagagcaagcttctggacagaaataaatttgaacccccaaagattcttaaattcacaaataatcagaaacattcacacataacaccacatcagagcttccatttatcaagagcaggtatgcagtcattccttgagaatactctaattcttacagcccaaactgcatctactgtatagcttgctgaatagaaaaagtgttggaggtggtggcatataatgaggctggagagtggaaaggaataagagcaatagcatgctcaaggttttggagttgattacagtagaaatcatcttgctcaaaatatagtgggatttatgcattccagtgccacatcatccaccattatccatctaaaacacagaaaaggcagtgagaatgtagtcattcatgtgtggtccccttgatcctgctttgccttcaatttcattactgtctgccaaccaaccaattaatctgaaaacttatcagtggtgctactgcatatctggcatccctgccccaacaaaactggagttctgtgagcgagtttaaaataacctagtgaataggagcaaccacggactaagagtgagaagggaaaaaaagggggaggggagaaggaatacagggaaaaaagggggcaacttctggaagcaaatactaaagaaaacatgaaataaaaactttatgttttaactttttaataaatcatggggcaagggatagaacacatgactctttgaagttttagacaataaatcttggaaatgggttgttcgattattatagtacccctccgagggcaatgaaaggatgtaatgaaaaaaatcaggccatcagaacaataaattatcctgacttaccagaaataccagcaaaatctttcaatatgacctgttactggccaaattaggaggaaaataacatccagcgctagggatcacattgaaaataatttcatttgattttcattaaaagctttccagatagtgactggtaaaagaagcccatatattctatctatagtttaatgtatatgagtactacaggaaagaagaaaactttagagataatctatttgcaaatatttccggggaaaaacaaaattgtgagattttcctatgatgaaaatatagtaattataattatttttaaaatgtattcttttattttttaaaaattagaaaaaatgttttacatgtataacatgatattttgaagtatatgtacactatagttaaatccagctaattaacgtatgcattacttcacagttatcattttttgtggtgacatgctatttaaacatatcttcccactctgtgagctcacctataagttatcttcaaaatctgataatacattgcatgtcattttcttattaaaaaagcattttcacataccttatcttgtgatacttaccatagcactttgagaattatttttgccatttatcagaaaagaaaactaagttcaggagtatataactaaattagccatgcacataataccagcaaatgggattcaaaatgggattttttgaccccaagaatgtgccctttctatagtactgcaatacagctgcaggcttgataaatgattttgaaaaataattaagtttttttagattggatttgattttggggccagcctaaagttgtatggcactaagactttcatacgaaataaatgattaggtaagataatgccattaggaactttgaaaaacaggtattatctatggctctgaagataatttcaaagggcattttaagaagagttttgaacactaatagttactattcaaatctacgcacatttcaaaggtaactgatttaaagttaataatagctagcataacactttgcacacagcatacactcagcaaatattagcaaaaacccttaaagtacttccatatataagcactggtaaggttttctaacaaccagtctcatcagaaaattacacatgcccattaggaatgtaaattcaggcagattctcttaaaatagctttgtgaaagttattataagccttaccatgtctataaattttggtctatttattccaatttgagaatttagcctaaagaactaatctaaaatgtgagccatgatttttttgctttctcaaaaatgtttactatgatattatttatgtataaacgttgtctttaaaaaaacctgaaaaaacaaaaacaatgtcaaaacaaaaacaaacaataggggcctcattaaataaattgtattcatttaatgaaataatacttagatattaagactttaaagaattttattcatataatgaaaacttctaacgcaaaccttcacaaaaaagcaagagtaaaacaaagattatacctgtacacactaaaatgtaaaaagtagccatctctggtttgtgaaattacaattttctccttgtcttttaaaaatttcttatattgggtatcctgtttttatacagacatctaagttattttataatcaataactcaacagtcaaaattgaatttttagcatgtgtcaggcatagttctaacctttttgtacatactatataatttacttttcataaataccattgatatagaaaaatttactttgtttttatacgtggaaacaggcagagagatattaaataactagcccaatattactttccaaataaatatttgacctgggtcttgaaccaaatggtctgattccagaactcatgttcttcatggcgttgctatactcttcatgttacacaggctgcttagcgatatgtcagaatatattaatgtcaaggagaaagtgatctcatgcaactgcgaccatgtctataaaatgttataacctttttggtgagatggactgatggtgtattaagtgtacttagcttacctcacatataactagttttcatgaatgtgttacttctccttcccgagaatacaaaagctgttttacatagagggatattacatctattttgtaatcatatatttacaaccatttatggtatattaggcactggattaaaagctggaaataactagcaagttatagcattcattgccataaatttaacactaccttggagtgggcatacggttttaactgaaacagattcttgaccatgggaatggaggcactaccttaagagcaaagagattcagattgtttccttgctagaacatgcttctgaggcactactgactgtatagatcaaagacagcacaggtaatgttattgacttcagaaattcctgctatattcactggctaatattatgtccacaaaaccacagctgctaaaattgcaaaggcatgagtcagtcatgacaataatttagagtattatcatgataagctcaactaggaagacaccaacctcattttactatggatgaaaactattgatggatatttttggtattattgattccatctaaatatcctctgaaatgctagagtgtaatctaggtattttttctggttatcattgctgatttttttttattatactttaagttttagggtacatgtgcacaacgtgcaggtttgttacatatgtatacatgtgccatgttggtgtgctgcacccattaacttgtcatttagcatcaggtatatcacctaatgctacccctcctccctctcacctcacaccagttagaatggcgatcattaaaaagtcaggaaacaacaggtgctggagaggatgtggagaaataggaacatttttacactgttggtgggactgtaaactagttcaaccattgtggaagtcggtgtggcgattcctcagggatctagaactagaaataccatttggcccagccatcccattactgggtatatacccaaaggtttataaatcatgctgctataaagacacatgcacacatatgtttattgcggcactattcacaatagcaaagacttggaactaacccaaatgtccaacaatgatagactggattaaaaaaatgtggcacatatacaccatggaatactatgcagccataaaaaaatgatgagttcatgtcctttgtagggacatggatgaagctggaaaccattgctgatttttaaaatgatctatttaagaatctttataagcagagcccttttttcttaataaaggaggaattcagaagttaataacattggtctgctttacatcctatacttgttttccctccaaattatatgaaagtcttatttcaaatgcaagtgaaaacattcatgtcctgtagcttgagaccttactacatataatatcactgcacagcatgatacaaattaacgtctttaagagggagctcaaaggcatacagaagtataagacatgccaagaagtttcatttaaatttcctttgttcataaggcaaatttttatatttactaatccttggataaatataacataaatacatagaaaaagaagcattatgttttcttaaactataggttgacccattgcaagcacatgatgatgcgtctcactaggtgtgcatgtagtaaaacagattgatttgccaaccaacagttaagaaaattaatttgttgagcatcatattttatactaattaaaaaagaaaatttgtaagaattatgtaagagaataacctaacattaaatggcaccataatggcatgaacaatttagaaacagaaagtcaataccttggtttctctaatataaatgtgttgctcatgctcttcaagcattttatgaaatgaaacatgaatcaaagtcattacagagctaatgagtgaaattgtattatttgctgtctctcattttcagtgttgattttgttggaaaacagtatcttaagaccaaaactctgggaactgttgagattctggccacaaagacagctagaccgtggggaagcaaacatctgtacacatctgcagccatatatgaggtccctcatgagacttagcaacaaggtgtgttttaatgtgacagtgtgtctgatgtgtccccagcacattgggaccagtacacagtgttatttgtacatctgctgagtaacattgagtgtgtgggtaactaaagccctcagtaattattttacttaatgttttcaagcttaattctgatcttgtacttgcatgatttattattccttgtgctaaattcttcaatgttcttgccttgattgatctttcattatctatcacttaactaaaatattaaattctttaattaagtcatgtttaaatgaggacttgttttagtctcttggaggtttattcattgcttaggtactttttcaataactcttctcttgtttaaaatcaataaatatgattaatttgccatacatttatgataggtcaatatatttattatggaaacatatagctaacttgatttgaattaaattggtttatgcctacagatcaatattgttctactcctacaaaatcaccttgaaaaaaatactattggttaaataaagaagacaatgatgtatatttataagacaataggtatcaaccagagaaaactctttgcagttggcaatattgggaaagaaggccacagacagatttatgtcatctagatatcaaagagaatgaaatacatggctcagaaatttgttgtaaaagggaatggactcgtatttaaggacaggactctgaggactattcatggaatgcatgaagaagactgataaggatagcctataaggcacagtatagtagtatagtagaagtgcaccaactatttctccagacttgaacaaccaagtctaagagtaagataaggtaagacaaggtcaggaagtctcagggctggagaggtggtgatgttgctgaataattgctttttaaagctggaggggacttccaagagtctctcatttaagaagaaaaattaaagacataattggtaacggttttgactgctgcagaggcaacactttgctcacaatcctacagatctacttcacctgtaactacaattttcctgaagacatagaagaaaaatcaattgttctaatccatatggaaaaaaaaaaaaaagaaaactgccaatgtggtttgactagcaaaccactggagttgtggcttaagcataaaggattacttcttccattgccactaatctaattactttcccctatctgtctccattccagcaggcatgtttagtagccaagctgtattacaaaaaaggataggatgtgggtaggtaaagcaaacaaacggcaacatcaaatgcaaagtctttcatttcaaaggactaatgctctcttattccacttgtctccaaagaaaagcaatctcaaccaggtgtggcctgttatcccagcactttgggaggccgaggtgggtgggtcacctgaggtcagagttagagaccaggggtgggtcacacctgaggtccggagttcaagaccagggtggccaacatggtgaaaccccatctctactaaaagtatacacacacacacacacacacacacacacacacacacacacacacacacacacattagctgggcgtggtggcaggtgtctataatcccagctacttaggaggctgaggcaggagaattgcttgaacccgggaggcggagctgagatcacgccactgcacttaagcctgggtgacagattgagcgaggctctgttttaaaaaaaaaaaaaaaaaaaaagcaacctctccacttttctgagacagcaagcacagagatgttcaaattaggttgactatgccatacttcttaattatgtatctgcataattattaatagtgccctcttttactcacaaaagtgctctgatttggacaataagttatattgttatcctaaatacattgtgacaggaaggtcaacttatataagacactaaaacaaatttgacaaaattcattttagtagatcatccatttaacatatataattctacaagttcataacttatcaagactcactaagaaacaaagatttaagctatttttatatatttgttgtctttcaaaatgtttctttttggcaaataactttactttaaaaagtaaggcatagactaatttagaaaacaaaaaaatatcatttcctcacactttactctaaatcttattcagtgttatgtcattttttaaaaaaatttttgctttctcttaggacagcaaacatttttgagatggaagaaaacccatagattatttacttcaatgccttaatgttactatcaagaacactgaagttcagagaaatgaaatgactcacccaaagctgctggtctggtctaggtagcgaccaactaaccagaccagtagcctaatgagccaagttggttctggaactcctgactcctaaatacttgtttccttctgcattccattctgtctcctggattatattctctattttattaggttggtgcaaaagtaactgctggttttaatttaaaagtagtaacaaaaccagcaactacttttgcaccaacctaatagaagcctcctatcaggaagaacttcatcaaaacctagctttgccctaagcatcacattttcccactggaaaagggtagataaaaaagcaaaggaccaaaaataaaaatgataatttaccaacctctctctcaggaggcaaagtacagaggtctctgcaaaggagcattttaaaatgtcttaggttattgatatttgattgctttttgaagattatgcagagttctcctatctctcagtcttgtgattgtcttcagtatgaccaattgttatttttacttatttttttatgtaacttttcttttaggtttggggtacatatgcaggtttgttatataggtaaactgcatgtcatgggggtttggtgtacagattattttgtcacccaggtaatatgcatagtaccaaatagatattttttttctgatcctctccctaatatcaaagaagagcaacaactttgggaaggttggcccaggagacatcattgggaattgtaaaccaaacaagaaaaacataatcaagacatgtttcttaatattcaatttattacaacattttattggctctcaaagcaagtgttaggattagttttgctgaagaatttgacaattttgtttgtttcttttgttttgtttttgtttttctgagacaaggtctcgctctgtcacccaggctggagtgcagtggtgtgatcacagctcactgcaacctagacctctccggctcaagtgatcttcccacctcagcctccttagtagctgagaccacaggcttaagccacagggataaaatgaggatttaaacccaggctagtatggccccaaagcgtgggcctttagtctttatgttaccagcagaaatggcctttggatggcacagtgtccacaatgaacatctaccattcacttttattccatgttcatgtttaggaagcaatatgtttaaaatgaagatagctggagtcaggcacactgatagcttggatggatacacacacacacacacacacacacaaggtaaacgcacagagtcataaaacagtaagctggaaaactttagggtcaaagacccagatctacttcaaaatgtttcaagtgcttcatatataagaattgatcatagaattaataaccaaataatcaaaaccaggtcgatttaaaagaatatagtttacaatagctatagaagtcatgaaatattgagaaagatgttccttccctaaaataattcaaacctatagaggacacttaaattatccaaacaaataacaaccgcaagatagtttagctctagatattgtcagataaatatctggacttaatattctttacattattttatttgttttatgtttacttctacacttatatattcatatttactgtttattacattacattatattaatattattccattttactagaccatgtgtaggtcagataaattacttcctagaatatatcagcttatagcatcccagaaacaacccacaaagggttcttctttgcataatacaacagctcagaaagactcccatatctgatcttttgtcttttctcagtaatccgtctggcctacttcaacaacatgtcaggatattctgaggtactaggccacctgagcctaagacctcaaaagcactgagcctcagctcatcagattcctggctaagtactttcaatgtctgtagtagcctcatttgctcatgcttaataagctcataccatttagagaaaggactcaagtgtgagtaacacatgcttcccctagtaatgcacagcattaagaagcgaagtagaagacaaaactctctccctatttcacattcttctgagttcattattgccatgaaaaacgaatcagatttgagttgttcctaatctctgctcttctggtctccatcagagagggcagccaaactgtgacaggagccatctgggatggggacaggagaggagagagagccctgtagttttcttctggggaaaagcaggcacagggggtaggttgctcctagagtggacagcaacactgacagctcatcatcatttattctcagcctaaacaccagtggcaagagccccatcaggtggcactgagagaaggaggccaaagaaggcacagagaggctttaggggtgactaaacatacacactgttgtaggactgaacattcgtacatccatctcctctagtaaagcttgaggttttctatggcagaggctatgtcttaggtaccagtgttgtcacagcatcttgcaaggggcttggcatgggattgatgctcatagaatatttgctggaagcaggaatcaatgaatagggcccagcccttctggattccaccggctacttctggcttctcaaacacactcaggcacgtacacttgatttcaaggacaaagttgctgtctatttttaataaagaagcagcttgagtgaatcccatttctatttccttactctcatactgtcttctgtttgcgtgagcaagagtatggactaattccaggcttcagttcattttagtcacagcagaaatctaatcagggctgtatattctgtctctgtccctctgtctgtctcctttctctccccctccttctttctctgcctacctctccttcttactcaccctgcctccacctccttctctgcctccctccatctttgcccctgtctctttttctctctctgtcaggtgatatacaaatcccaggaacacagatatacacactgaactgaatagctcatttttcaaaactgtgtcaagattgtaatggttagtgtgcaagaaggaaacttatccttgtaacattaggatttttctttttctttaattgcgccctaagaattaaaccctatgcaaataggacttaattttgcgttcccactttttcctttaataattgtgtgtatatgtgtgtgtgtaagacaaatgttctttgttgaaagctaacagttgcaggcttcttttaaaggttataattatatttataaacacattgctatcaggtttacaccaaatagaccaataatttgccggcaaaaggtaaaaaatttaataaaaccaccttgttcgaaaacaaatttgttatagaaacacctgaacattggttttgtataaagtatatgcaagatgtaactggacattcatgtgattttaggtagaattttttgtttgttcttgtcctccagagaggattcagaaataagaatgacttggaattgggcatttaaaaaatatatctaaaaattctatgtgctgcggaggttggaattctaagttttttataagatgaactgccatgcaggtcacttattctaggaaagtctcctaataaataattcttactattaaccacctccagggtcacagaatatgttttaacctctttttagtgctgacacaaggtaatagcatcccctgatactaattctttgctgtcattaatttggattgtctggtaacacattaaaaaaaaaaaacagaccaagaaactgctatttcaagtacgaagaaaagctgcattcattattcagccatataaggaagttaaatgctacagcgccaaagcaggcaatgacagaaaactaggaataaagaagtttctttttaaaaactaggaacatagggaaataaatattgtgtgagagaaaaaagccaaaaccaacaataactaggtaggtcagctacacggagggactaaaacattaagcattcccttgcctctcaaactcagctattcatggccttctaggttaatggagagtggggcacggggtgcaatgtggttaatacacgttctagaatcccagaaaagataaatgactgctctagtttctcatcttctgagcagcttgagcatgtgttgaggttactgtcactgcaccacagcctgatacatattcctccttgtgtatgaaagccattcaaaggaagaaacagccctgaataagactctatgggaattacagtcaagcagtgctgctgaattctggatccaccctttattagctgtgtgacccagagaaagttaaatctctaagcttcaacttcttcatctgtaaaatgagtctaataagagtagctacttgatatagttgcaaagattaagtcatacggatactttaagaatagcatgaaacttgttgtttaataaatcttagtgccatcaccatcatcaccaccaccaccaccaacaccaaaaataatcaccactaccgccatcatctccaacactatcaccaccaacaccatcagcatcaccatcactaccacctccaacatatctagaaccaccaccattccaaccacaaccatcactaccaccattaccaatatatccaaaatcaccatcaccaacagcaccatgaccatcttcctcattttacaggtgagaaagttgactcagaacctcagtaactggctgaaaggcacaaagctggtaggggacagagagctcaaatttccaagtttagcgatcctcctaagcccatctttatctcaggaaatttgtcatggaaaaatggtgtggccttggtttcaagggtcaccacaaggcttcagaatacctaggaccccagatatctcatatgtaagcatagaaaagcaaaaataaaatcaaaaaactatatctggaaaatatcttagggtattttattaatatgtgaattgctaagtatactgcaacacctggttgccctgttatcatgagcaccagcctgaaaggtgagggactcaggttctgcttttcgttcttaccttcatatcttcaactgtcaccaaagaacacaatgcctattcccatatttagccctgtgaagacactataggaaagaaagaaactgtcatctacagcaccaagtcctcaggagaaaggcaggaaatgaaaaagaattgtttatttagcctggctctatagtgaaacagctgtataagtctgtgaaaagaaagggccctggcttggctcaacctttggcaaatacatgggtattatgtaggcagcatgtcgagccaggagaggaggcaatggaggagatttcctctaatgcttcccatattgttaattgctgctttccctcccagggccttctggacttcccaccagaaatccagggcaggaactgcaaggcactatgggaagacagcagcttgagtcctgcctgcccactcagcaccttccactgggaccctcagcgggctcacccaaggcagttacgaagattatctcatatgccacttacccacagtacattcagctatcttctcaccctttcctgccacctggcccagagccatttaactctactgttgcaaggctaaacttctgagtttcatggcatttatactgtaataagggactaatcgatgttctaccccaaacagtaaatctccaatggtcagatttcagccatggaggaaatatgatgaagatattttataggaaaacctcaatagttcccatgatattacaatgttgcctataggcaattttccacatctcagctttgttagctgacagagaagcaaaataacagcaaataaccccttgtatgtcttagaccctcaaggttgctctactcaaaagaattaagtatacttaaatctccttcccttggttaatggtgtcctaaggaaagaaagcaaagaaaacctcttcccatttcacaacttagtgtaaaatccattcagattttacaagatggtgacagagcaataactcttgagaaaatgatgtgacaatagctaattgtcaatggctaaggactcctcaaaagctgctcaatatccataggattaaagtaaagcagaaccattcctagagacccaaggactagttaacaaagagaaaaataaagtactaacaatattttactacaaatctgttaaattctctttaggaccttcaagaggcaaagtagtatggaagaacaagcacataaccttttatttcaaatagaaaagggttcaaatcctagatccataatttattagcactttgaaaaaaattaatctctctaagtttcagttttttcatctgcaaggtcacttacttcattgggctattataatatcacatgtatgaaaagcatttgagaacgggaaaacaatacgataataccattagtcttccaaattttgtttctacacattccacaaacaaaaagggttctacaaatagcaatcctttaaaggatgtattcaggttggtttaagtacccttataatgatttaaaatcccattatacaaaatgtacttttacttagcctttcattaattttgataatggtcctgtctattgaaactgcccatactcttagatttaccaaggtatgagtccatcttacaatgcacatcccattttccttttaaattatgcttttgtcctccaaaagcaaatgaaaatattttatctaaaatcaaggcttcctatagtttacaaaatgtctttaaaatgaaatttgtacttatcagaatatacaccatctcattatctcccattttagagtataaggagcatattttttctatttctgttataattcttagcccactgatggccacaaatctgtagcttattaagtatgtgcagattaactgatatataaattctcctctgcccctaacccagtaaagcaatcagccttctatgtaatggccttgaatgatgactaagaaaagagcccgtaatttaaacacttcaatgtggctgaactatgaaatctcaattgctaagacaaaattcctttacataatgatattataaccccaagctttaattagtgctggaaaaataagattataatagcaaatatggcaatctggttgacaccataaacaacctttctgcacacaatcaatttaagctcctggcagtactaaattcagactcataaatgttttttggctcttatcctatcttatttttataatagctatgcattcagaaaacatgcatttataaaaacatcttttagttataatttaggtttgcagatgatattatatgtgatttggctctaaaaagacataaatattctgttctgaaaagataatccactaaagcagaaatccattcaaatgctagttattccatacaaatttcttacattaatacattacctaggaaaattatatgtcagtataaaatatcatacctccatcgtatgctttaaaggtagcagataaaattctactgctataaagtaaagcttgaatatgttggagttattaaattgtgtgcagaaattagtatgtgctaacagcctttcttgtcttgtgatattttttctaatatttttcatcatttctgatttctccacacaattatccttctgttctgatcacttcaaattttcttaatatcttcatttcaccttgtttacatctggctgtcttattgtattttgttctactctcagaattgaattgccatctcacatagctaagtctatagagaattctatagaattctctagaacaagaaaagaacacaggtcccataaatagcaaaaacaaaatatttattttccctggaatataataataattccatagaacccatatactactgaaattttttttcctttctagtcttttttccaaaaagagtaaaatgtgatataaatattgagcatcagacagctatattggttaagatgtcttacacatactatttcctaaagttaatgaagttacaactacactgaaaaatataatagttgttaaaacaaaattaagtttgggtaggcccgttgtttaatatgttatactatgactaggaacctctggtaagctgatattctaaggagtatattaagtaaataatctaacttgcatactctgatttttcaactctgtactttaaatatataatactaaacgctcataatcttttaaattgtcttccaaaaataatactattgctgggctataactaattaaatttgatttgtatctacattagttaattagccttatcatttttccaaaacagttaagctaatgttagaccttgaaataccaaacaatattttgtaataattattaccattaaactagaaccattaaagaacaatcattaacagcacttcaaatgtgtagatattacctaccaaaccacaaatcaaattagcatattcttaatttattttttattagctgttaacattagacagaattccctgttgtaagtcaaaattagttggcattggtttagtatgtgtcattgattgagtttataaaaaagcatgtgctagctgttaattatatctatttaatgggattttgctttgtaattttaaaatgttttgctgagaatatattttattagaaattacaagcatcacttatcacttatcaaattgaaataaatcaactcatttatgtgagaatatgaataaatatttatagacatttttatattataaatttaaatgactatttctacactaaaaataagatcaaagattaggaatctatcttgtttttggaatccaacaatcattaaagctgtagtgcctcttattctccatccttgatcagattggaccttatttctacctttgttagggacttcttaaaattagcctttaaatttaggcttttccaggaatctctttatggtgctctggaaagaataataaagtctggctttgtgcacaacattaaacaaacatttttttttcaaagtacttaataaagcttggtggcgccatcagccatgtttaagtactgtaggttttgaaggaggacatctttcaagattaactatgtaatttgatgagatataaattcattcttaaagataagttgggtttaatctacatagtctgactccattgcacgatgacaaactctttcacttggatctgactgtatggaaataagacaactgccaaaggaaaaataatccataaaaaaataatgttttctaagctgctaagagggcagcacaactccatttgacccagcaatcccattactgggtatatacccaaagaaatataaatcattctgttataaagacacatgcatttgtatgttcattgcagcactattcccaatagcaaagacatggaatcaacatatctttgataatatgtttttctagaaaccttgtgtttgaatcttggtgcttaatttaaggttaagtcccagccaaacaaatctgtacaatcaacagacctatttagcatctacaaagcttgtcagtaatacaactctacgaagtcaagatgaaatctcttcaaaattaaaaatctagaaaaaagaaaaatgtagggctgtaatttcattccacttataagttaaatgctttgccatttctaaaatttcacatttcaattaagcaaatgaagtatagtaacaattttatagagcaagaaacttgcgattgatcttcaatactcctaagaacatatatatagagatggcatgaattattagccaattttcaccaactccaccaatgtttaccaattctcacaagaaatctaaatttctaaagatggaatgtggcaatattccttccaatttaattgcataggatgaatgttttaaatggaacttggcagaataagttattctatcaaatcaatgtcaatcctttttaaaaatccttttccttattcttctgcatcgtaccacccaaaagaaggttatttatggtttggtaaaagtcctgaactgcagaatagatagggaaagactgcttttcagataaaccagtatagagtccttattcttaagaaaaggtaagattaaattttcaaaagaaaatatgcttagtcaaacaaacaaaacaaaacacagatttaagttgttttaagggctacccttatgagttcatttaacgacatgaaatatacctttaacaacacgcagtacacttttagatggattacaagtgctatctactacagaagggttcaataattgaaatgattagaaaacataatcattagggaaaatataatcaatagggaaagaattcctagcaaaggaataaagttcatttgtgttaacctgggcacacatgaactttccaatgcaagaccactgaaaaaattctttcttggatatgaaggatattaatttgctactagatcactatctttcagtaaaataagtatcccaacaaaacacatctcaataagtgtaacactaacaacattagaattaacataaaatagatattaatcaaaacactttgctccctacaaacatcagaagatggatattataatccctgctttgcttgatttcattgtgatattgtactcgacactacttatcactatagtataacaacaaagagatgtaaagacactggaaggctctctcaggaaaatctgttctctctgcccatcccctccccctttttggtttgttttctctcactttcagtaggagaaatttcatatttaaagagcatgcattcaccatttggcatatcatatgccattatcgtaagagttaactattttcgaactgtatttatatatttatttttcttccctgaaatttctaaatgtccagtgcttcaaccaacataatcattcattttaacgtcgtttgttgtactgaagatattatagtcagcctccctccctctctccctccctcctttccccccagaaattgttcatagagtcaaattttctggtttgcttttggtgagttgagtgcaacacactttcctaggcaaagggggaacagccctctaaatatcaactctcagtcgaagaatcacttaacaactgggtacttcatattactacatgagcacagtgccactgtaaagtaccacgaggaagaataaatttttccttcttttctctgacctgctccctgacaactagacacgtggacagaaccttatttctctctccatcactgtatcagtggggtacagggtttgtttaataaggatgtaaaataaaaccggacttgaactacaaaagggctggatggcctttcccatgttggcataacactgaagaagcaggattggttatgaagtcataatttagcattggcatttaagcagaaacattaacttatattgtcacaaaacacaatgtcacataaaagccacaaaaatattttcagccagccctggtagccaagaaattattttcagggtgtttcctttttgggttttcccaatttgtactcagaaacgaagttagagacctattgtgatgttttaaatattccttttctgagtatataccatgtgattcaaaatagaagaccaatttctcagcctgtcttaagtcatctgataaactgtgtcccatcactcattttatcatagtcacaatgtagttaaaatgtgtaaatgtataaaagtaaaaataaaattctgatgtaaataaatttaagatctctgtgtgcagagcatattgataactggcacccaagcaaagactgatatcttgaaagggatcttgtataaaagctattccattccttgcatgctatttaatttaaaaaatgatgcacagactcacattcataaacacactgaaccacacacacacacacacacacacacacacatatataatatagaacttacacaatttcatcattctggaattcgagctctccacaagtgtcctcaaaatcctcccctccacctctggcagtcccttcgatggttttatatggaacgataacatttcctcgagctccagatgttctcaatactttcacctccatgatgccaatgctctcactcacatgagtcacaggttcctcaaaagtaaaaatgcctgcgtggtcatcatcaaaaatagttacagtggcagtggagggagatccgaggcaagcaagtgtagaaacatgattggcttccagtatgccatcttctgaagcttcagaagatactttgacattgctgagatgcacaaggaaattttcatcctcctcaaagatatcatcatctatgatacccactctgatttccttctgggtatcaccaggcttaaacaccacagttccttcagtaaattcataatcagacccagcatttgctgtgccatcctctgttctgaagtcaacaaacacagtgttagtcaaatcaccacctctgcggataatggtaagggccacagtaccacagttctccagacactgatatgtcccttgttcaaagaagatcttactaacagggtcattttcagtcacttcagtgttgacctcgtgcatgctgacagccttccttgcttggtcagctgcatgcctctttaaaatgttgccagctccagtcatgaggcgagtagcttgaatgcgataaaatgctctacttttttgctgctgacttaggacttggtagttagctaattctattaattgctctatttctttatctggatgcttctgcttaagttccttcagaatcctagccatttctcgcctagcttcttcatcatcttggtccctctcatccacctccagaaccagagcaccatctaagaaattttcaacatgagaattgaccactttcccgtccatttcaatttcagtcttagaagatggcctgtctccttcatgttcaataatcatccccctctgcttgccagctcgatacctcttgtagacatacttgtaaaacagaagtctcctatccgctacccaagcgaacacaacacagatgggaaagaagaagaaagtaagcaaaccttcccagacctccacaacaccaggagatatgacagacaaaataatgtaaagccaggtgtaggcaaagatgctccaggctgctgtcacaaagaagacacgcaaatgcttaatcttccttgtctctccgtcaggcaccacataaacacagagtgcaataatgatgaacatattgaatgcagcacttcccacgatggtgctaggaccgaggtctcctgcagtgaagttatggccacacacttcaattactgaaaggagaatctcaggagcagaagatcccagggccatcaaggtcaggttagaaactgtttcattccagatcctcacagttgtcttggtggtctctccattgggtttctttatggttatttctttttcttgagatgtgatgacttctatagaggacatgaaccgatcagctatgatagagactccaagaaacatgtagaccatggccacaaaatacacagtagctctagcaattttgtccccaaaagaagggtcttggggttcccaaatgggcaaaatcacccctttcttacagtaatatgatccagtacattcaccagtttcatttccttctccttccatttctgtctcagcaattacatggtccacatgggaaaataagagactcacagtaactaacagatgaaatcccattgaaaaggtgggtgaaagacttaatcgccgcatgttgtacatgacacttccaactgtcacaacctactggtaaaaataagatgggggagagggcagaaaaaaagtcatgtcattagagctgcagccaaagcattactaattacttatttttattactcttaccaaaatttgtttatatttgaccatcacaaaaccgaaatttgtttatatttgaccatcacaaaatctatggtgaatgattgttctaagactccatcagtgactaagcaatcctttgtaaagtttacaactcaatctttctgtgaatttactacatgtagtacccattcactgagcaagatacacaattgacttactggaaaggaaaagttcaatttatatagccttgccttattaaacacacatttatgcatgctaatagccaaaatcacaggacttttgaagcattaaacaatttcctcctttttactaaagcagattttcttctaaatttgtgttagtacatcatcttccaaaaacggtttcaatgccaaaagcaccttattacaattgatgctttgaaaatcagactccgaaaaaatcccaccaacacaaggcctggtgattatcttaaacgccagagagcatcttacactgtatttcatgaaatcatgtcctattgctccacacttacttggaaacaaaacttcaagcttgcctgaaatcaaagctcaatggcatttgttcttgaggagaaaaaaattctgctataatgcaatatttccacacattaagtacagtttttaaaagcatgttttgatgagagcacatttctttctaattttcagccagcccaggtctgctgatacattagcagctgggcatctggttcttcaagcacagctcttcacatctgtgtacagagcctgtttttctgcaggctggaaagggagataaacaggccaaggcctagttgtgggtaagcgcctggcaggctgtggaatcagcgtcaccaaccttaaaatgttccttctcggtgtcggtcatattttccatggtcattctaaaatacatattagttctgtcgagggttcaagtgaccaaaaaatgcaggaccaataattccatttaaattagctcatgtggcatgacaagagtgaccacaaaatatacacatgatgaaggactgtaggcaaggagggccatggcaacagagtcagtgagcagcacacaaagcttggtaggcatagcagtggactcaaccaccatggccttaagtccacccaccagctcaagcaaaactctactcagaccttacatcccttctgcttccagaacctgggatggaggtgaggggaaactgaagtagaggaaggtctgctccaagtcaaggtgactgtctcccaggccttgcaggatggactagttatgacatcagataaagcagcaataggaagaagccctgagtcagaacatacccttatgtcctggaaaaagttaaaagaggaactggattacaggctttcatagcttcgggctggctgagagccaccccacattcgcctacactctctggctcatgtttgctgctgatggcttatactgcaaactgcaccagtgcccaggagaacaccgctgcctaggacattctggcagaccctgagagatcccaccatagactaaagccctttatagctcatcactacagggagataagcttctttgacatttttcccatactaaagaaaatcagaggagggttatagcagtagaattcaaaactaagtaaaaggctgaaaaatagaggtagcatattttcaaaatatgcaaaagttctggtcagtatgtctgcttgttcagtctttgaaaggctttgagatttctgcttgaaacaaggtgaaatttaaccatcctgcaagaatgttggaagatctagttccaactcccttgtgtatccatttcatccacaatatttatgcatgcttaatatgtattttagaaagacttactagtctgtcttctagatcctgagaattcaccagtgataaaacaaagtctctgtcctcacagagcttatattctaatggtggaggaaacaaacaaatataaatatcagaaggttaaaaactcctatggtacatgtgtgtgcagaacaatctatagaggacaaggagagtgtgagattgtgtgtgtgtgtgtgtgtgtgtatgtgtcagtgtgtatacacgtgggatgcatgatttcatactagatggttaaggaaggcctctctgataaggtaacacttgagcaaagtcctgaaggacacgaaagatcaagttttgtggatatctgtaggaaaagaattccagcaagtgcaaaggtcctaatgggaatcatgcttggcacagtctaaaaacacagaaaaccaatgtagcaagagggtaatggaccaagggggcagggctcaggagtgggaatggatcagagaacactgaattgccataaggcatgggctttgatggggtagaagatgagaatcactgggaggttctaatcagagggtgatatgatctgatttttcttttagaaggatctctctgctggttcagtgcagaaaagactgaaggggcaagggtggaaacaaggagaccagattttgcctactatataaaatctaatttataagtgatcccaatacttggcaggtatacaaaatggtacagaagatatttaacatttaaaatggtgaaagaaatgtcttggggacctgaaagaatcagaaaggtgaaatatttgtgataaatagtagtactgaacataaacactgaagggagattcaaacctgtgtctgtctccaagactgatataactaaccactcccttcaaattactgccaaatcgcatcattccattcttcacgtttcagccaaaatgaaattcctaaagtgcagatctgacactcttcacgtcccttaaaactcttcattggtttcccacttccctgaggacaaagctcaaacccctcaacaggctttctaagaccttttatgatctggcatctgagctccagaatatggaaattattcccattccctgaacaaggtaacaatttcttacatccaagtctttgcagattattctgtgtccaaaactattttgctttttccttcttagaagcaagtttcaaaagagctgaacaccaaattataaccaatttcctgagagaatactagattccattcttaaacagtcacagataccatgctaaattgtctctatacatatcaattatatttaatatttccattagccagcattgctgttataaaatgcctagtgttgctatttccattatagtccatgagaacagcacccctggagatgtgcaatgcacagtaccctaacaataatcctaaatagtaggtactattagcccatttggaggttggataactgaggcttagataggttaagtacttgctgaaagtcatacagacagtaaactcctcaactaagacccaacccctggtctttttccaagactgatataactaactgctccattatatcatccctgatagtgtgtgaagtaatctttgagaactattggggttggcttggactagcccgttggaaagcctcttggcttccatgcagggtcaggagggcctagttagcaaaagtcttgtggaaggtttccaatagcctggcttttatcttatgcattagactcaaacagacaagcatcaataactgtgatgtaacatgagggctagcatgttcctagagacagctgcccttcaatctggtcttttagcaattgcctggcaacctcttcctgcatgcactgtcagggcaatctcctgggccagccaagaaaaagccctgccctttatcccttccctagcccacatcccacaatatgttcttagccaaaaggtcaccagatgtctaaaggtagacaggtcagtaaaaatccatcatcattatcagagaaaaaggaagggggcttccggtgttaactaaaaacattacaattatattcaaaagagagcagtattataatttgtgaacagtggacacagcacactgatgtagcttattggcaatgaagcaattggaaagaactctctggacttaaatttctttttcttattaaattaataccaaattcaaatgcccacgaagatgtggaatagatgttatctaaatgtgagttccttcttcatccttttgttttctttctttcggggtctttcctctatcatcagattcaaagtagttctactaaactctccccattttccctcaaatatacatttccatacaaattaagcagaaagataagaatagagactgtggatatgttgatttgctgcctggctttcttatattctgccttaatttaccaatacaaagtataggctgatttttatggtggattcagatcaactcgtacaactgtgagcagtactaacttaaaatatccattacatcatgaaatgagactttagcacagtatcaagaatacccaaattatcttctgatcactatttattttaaaacaacacacaacccatcacccacagattacagacccaaatgacactgacaaaggatggtaaaaagatatccagctgtgagtagtccagccagttgtgtcggaggaagaggtcacagctacaaggaatagaaacccacatctacaagagatagatccaactgctttgtaaaggaagagggagagcttttggagcagaggcctgaagagtggttggcagcacggtgaccattccctgctggaagctatagccagttttgactaccaaggaggacgtgactcagagcaaaggcatatgctggcattcctaacagcccaatatattggacagtcatcctaatggcatcctcttgattggcagctggggttattccaaggaactccttgatggccttcatcagtacttggaattcccttctatgtaattcttgctgactgaaagactcaaagctaagcaattaatctgtttctaaggcaacattaaagcaaccataaatccttatccactaccaaggcaagcacttccaaatgtttctagacaaagagatgatgccagaggatgaaggcttttctcatctgaccatctcacctaaagtgaaaattactgccctggctccagcctcaggctatcagaccatggccagatttcaggaaaaaaaaaacctcatttacacagagaccctctactaatacctaattttcccttccaaagaaagtttcctctctgctgtttaatactttgggacaggtgccgaaggggatgggctatgagcggtcacatcataggctcaagcctttctcttaaactcacaaaacagaagtcaggcccctgccttatgaccaaaaatacccgctgaaattgtccaggaaatgaagaaactagggtgaaggtaggcaatgtggtcacaaaaggaaagatagacttaggatataaaataacgaagttgttgaaaactcatgagatgcactgttggccctttcccctactttatttttcgagatagcacttattacttttttgtttttgtttttgagacatagtcttgctcctgtcgcccaggctggagtgcagtggtatgaactcggctcactgcagcctgtgccttctggattcaagcaattcttctgcctcagcctgccaagtagctgggattataggtgcctgccaaccatgctcggctatttttttttttttttttgtatttttagtagagacagggtttcaccatgttgaactcctgaccttaggtaatctgcctgcctcagccctaagtgctgggattacaggcatgaaccaccacgtctggccagctcttattacttcttacatgctatctattttattcaatggttctatttattgtctttctctcttcaaaagatgcaactctctaagggcagggattttcatttcttttttttcattgaggtattcccagttcctagagcacagcctggcacttagaagatgcacaacatctgcttattgaatgagtaaagtaatgctcacagggtcacgtgctgattcaccaaatctccagtggtaaaccagaatctgggaaatgggcctaagcatttgcagttaaaaaatgttgtctgtgtgaaatggttgcaccctaacatgagcagagttcaaaatcagattgtaaagtcaatgtcagtgttaggaagagaggaaacacatgattcagactcatgagcaaagactcttgggctggaaagactgatctccagcataacgagagcacctgggccctgacattttccccacaacctgggtgtgtgtcttccagcatcagccctggcttgcttattttatatgctctgttaagagggccctaacactttggacatactcaaggaagtacatcttcccatccttccaatacaattaaaagacacatattcaagcacaacaaaaatcaccttcattgtagaggccctacacaagggaaagaacaccaagcatttaaatttaaatattaatctgcatgctaacacggaaatatgggtagaaaaaagaaagctggagaagagagagtctttcaatagaaaataaataaaaaagaatgtagaaggaagatgctctgataatcttgggctccatgtgaagttagccaggtttgtcctctaattcattatgccagaaccacagagcagggtttaagggccctactcagggcactgatggcaataatgactgaaatcatggactgagcatctacttgtcccaggtactgtgctaattactttgtattcactgtccctgacttttctgacgatactacaaggagatattatcattcgcattttacaaatgagaaaaataaatggttcatgaaagtaagctggctagagtcatatatacttaagtgacagaactagaattttaattcaggcattttgcattaaactataacgatttccaaaatggcagacacattttattttcacgacaataagttaacaatgttttctggggacagagagctcaagatttaggtacttaacctgccatgctgccccttcttcccacctgaataaatgtgtgtaggttgcattagctcatcaaggagcctcacatgtttccactcctgcctgatgccttcccactccccaagtaagtattgtaagcacttctattcgtcacatagcaagggaaagatgatccatgtgaaggatcatcagctgaagacagaggtctgaaatcactccaaactcatgtagtaaactcaaggtttttccatttggtcaggagaaaagcaaatgaagaaagaatccctagcagtaagcaagcaaaactaaaataaaagaggggaacggataatgaacgggagccagggagaatgatacagaatgttgctataacaagtaggttaacactttgctctaataacaataattcagtattttttaaaatagaatttcattgcagctcaaaaatttactgtcttgggggtcatttttcttaacatcttaaatttaagccaataagtaatccaaagaaatgcaaaaacaacacattcgtttatggttttatctgccaagcttttcttagccactcatatatgccagacactgtgtttcaaagataaataaaacatatctccaaaggagcttgtattctagtggggcactggcagaatcaaggagtgagtcccttctgtggaaaccaggacccttccattactagagattcactgaagagaagagactttcctggcatttgaacattgacactgagcactgaagtggactacctagtccccaggttaacgtaccttgagtcttgagttaataaacccagcattctagaaatctcggactgctcagactgtggtcctgcaagctagagatttcaattataatgagctcccagaggcagagccttggactctgtacatctttcaaaagcctcctgatagacaatggtaattctttcacataataattgttcaccactaaccctgaagagaaacagcagcctttctttgatgtttgaccttaaacactgaaaaagaatgaggtcatatacatgcttttatatctaggtcaccaaaaaggattttctacctaaaaatatttccccaatagctggttgacatttaatcttaaaaatctgtatatatagtgagcccttcctatgtttctagttctagaggcaatgaacccttcatttattcatcaagcctctatggagtagcttctatgtgcaaagcaccataacagacactacagggattgcaaatatgattgacacgtggtccctgtacttactaaatttacagtctgcaagcgacagttactccaatgaccattaatactaggaagaattgacaaaatgtcataaaaggaagggatgggaaggatgacaacggctagagaatgtgacagcacattctaaaaggaagaaatgatatggacaaaggcatagagcaatgattctccaacttcagttcacctaagaatcacctggcaaactaattaaaatgcagttaacagggccctataatcagatacagttgaggaatctccaaatttgaattttaacaacaatcccaggtgattgtcatgtaggtggtcttggaccaccctttgtgaagtgtaaggcagaaagagcagaactgagtagaagcacaggaacagcacacagggcatggggcttgtttagcaaacagactggaagtgcgtgtctgaaaatcagaaaacagtgtttgttctaatatcagtaagatgttgatgttaagtaatatgtcagctgtgctttccctctcacagactgggtctccaggcaggatcaaaatatgaagccccgtagtgaatatgtgtccaggaggtgggggactagagggcagaggaggacagatcttaataggagaaaagaggggccccaaaagggagattaaagcactggaggtaatataaagttcctacttcatgatgttgctgcaggtgttttgtcttctctaagaagaaacaagcaaggattactaggtcactacattggcaggtgacaaagacttaggataaagggacatcttcagagacctattcagtttctatatccaaaccctaagtagaggtagaaaacatgcagaaacatgaaccccaaaatgaagtactgggtggtaaggaaagctgtgctcttcaaatgacaagttctttagggggcagcccctactctttttcttcatttcaactcaagaacgaatccctgtggtcactctttcttctttctagtctgcctcttggaactggggatgtttaatacagaaaccaatctcaagttgaatgacagtcaatccagcaagatttttttcttttttattttttaatcttttttaacaaggtaaatgctggttgtgtgagcagaggctggtgaatttcatcagctttttcagtgagtcattaagattcatcttcaagtagatagcatttcagaagacagaatcctatcaacttgaggtttttaagtcttagattttcctgcatagtttcaaattacagtccttgaaagaataagctcttcttgaaaagagtggaagtaggaagtaaaaagaaacatattttaaaaagtcaaggtgatgggtgctcacataagggtgactctccatcagtgttgtatgctacaattttctaaagttcctgacaatatactcagtgacaaagttctaacaccaagtgtctatttacatattacaatattgtatagtatatattacctattacaatacactttaaaaatgaaactcaccttagaaagaaactagtcaaatcttattatttagaggaccaaagggagtgttggtgacatgggaaaacacaacattcttacagaaatctagtagagaaatacatggtttttctctactagctagggcatctagtgaatatgttctttaaaccaatcttatatacctgtgtttgaaaaattattaaaattggcttaagtggtatggttttaacgttagtaactatgctgacactgctagattattgtcttttggtgacagatgaggattataatagatgtgaatttatctatcacaaaggtggtcctaaaaggagccattgaaaaaggtagagaaaaaagtcactggaggaagaaattctatttaataatttaattagcaattgaagataatttctatctatgaagcctttgctaatgcaacaattattttcatcaatatcaatgattaataggagaacattcattcattaaaaaaaatcaaacgtcttttatgtatatagcaaagtgcgaggcactggggctagaaccatgagatagacagacgtaatctctctccttaaggaacttattacctagctgggaagacagatgacagatgttcatttaaattactacccaaaatccataattatgtccatcacataaacagaaccaatgacaaaaaccacatgattatctcaatagacgcagaaaaggcatttgataaaattcaacatcgcttcatgttaaaaactctcaataaactagggattgatgggacatctcaaaataataagagctacttatggcaagccaatagccaatatcatactgaatgggcaaaagctggaagcattccctttgaaaactggcacaagacaaggatgccctctctcaccactgctgttcaacattgtattggaagttctggccagggcattcaggcaagagaaagaaaaaaagggtgttcaaacaggaaaagaggaagtcagattgtctctgtttgcagatgacataattctatatttagaaaaccccagtgtctcagcccaaaaactccttaagctgacaagcaacttcagcagtctcaggaaacaaaatggatgtgcaaatatcccaagcattcctatacaccaaaaatagaaaagcagaaagccaaatcatgaatgaatttccattcacaattgctataaaaagaataaaatatttgggaacatagcttacaagggacgtgagggacctcttcaaggagaactacaaaccactgctcaaggaaataagggaggacagaaatggaaaaacattccatgttcatggataggaacaatcaatattgtgaaagcaatttatagatacaatgctattcccatcaaactaccattgactttcttcatagaattagaaaaaaaaaaaaactactttaagtttcatatcgaacaaaaaaagagcctgtacagccaagacaatcctaagcaaaaagaacaaagctgggggcatcacactacctgacttcaaactatactactacaagactacagtaatcaaaacagtacggtacgggtaccaaaacagacattatagaccaatagaacagaacagagacctcataaataacactacacatctacaaccatctgatcttctacaaacctgacaaaaaccagcaatggggaaaggattccctacttaataaatggtgctgggaaagcaagctagccatatgcagaaaactgaaactggaccccttccctacaccttatacaaaaattaactcaagatggactgaagacttaaatgtaaaacttaaaaccataaaaaccctagaagaaaacctaggcaataccattcagggcatgggtatgggcaaagacttcatgactacatcaccaaaagcaattccaacaaaagccaaaattgacaaatgggatgtaattaaaccaaagagcttctgcatagcaaaagaaactagcatcgttttcttaatccagtctatcattgttggacatttgggttggttccaagtctttgctattgtgaatagtgccgcaatagtggtggggtggggggaggggggagggatagcattaggagatatacctaatgctaaatgacgagttaatgcgtgcagcacaccagcatggcacatgtatacatatgtaactaacctgcacattgtgcacatgtaccctaaaacttaaagtataataataataaaataaaattaaaaaaacaaacaaatgtataaatctttttactaaaagtgataattcaaaaaaaaaagaaaaaagaaaaagaaactagcatcagagtgaacaagcaacctacagaatgggagaaaaactttgcaatctacccaatctgacaaaggtctaatatctggaatctacaaggaacttaaatttacaaaaaaaaaaaaaaagaaaaaacatcaaaaagtggacaaaggatatgatatgaacagacgcttatcaaaagaagtcatttatgcagccaacaaacatatcaagaaaagctcatcatcactgatcattagagaaatgcaaatcaaaaccacaatgagataccatctcacaccagtcaaaatggcaattattaaaaagtcaggaaacaatagatgctggtgaggctgtggacaaacagaaatgcttttatactgttgatgggattataaattagttcaaccattggggaatacagtgtggcaattcctcaaggatccagaaccagaaataccatttgacctagcaatcccattactgagtaaatacccaaaggaacagaaatcattctactataaagacacatgtacacatacgtgtattgcagcaatatttacaatagcaaagacttggaaccaacccaaatgcccatcaacgagaggctggataaagaaaatttggtacatagacaccatggaatactatgcagccataacaaggagtgagatcatgtcctctgcagggacatggacgaagctggaagccatcatcctcagcaaactaacataggaacagaaaaccaaacaccacacgttctcactcataagtaggagttgaacaatgagaacacatggacacagggaggggaacaacacacactggggctttctgaggggttgggggcaaggggagggagaacattaggacaaatacctaacgcatgcagagcttaaaacctagatgacaggttgataggtgcagcataccaccatggcacatctatacctatgtaacaaacctgaacactctgcacatatatcccagaacttaaagtaaaaaaagaaatccataattattaactcgaataaatggctatggaagtaaaaatgtgactataaaactaagtaacagaggacttcacctaccagagtattagaaaaagttcagctgaaaaataacatctaagctgagatttaaaagacattctgcaggaaaccagccaaaaggttgttgaattgtaaggtcttaggtggacacttttgtaattacccttctctgtaacaggattattcacagacgtaccttcttagatatgctggggtatgagatcatgtttggaagggacaaaaagtagcttctataatttatacaagactttttctctctgaggtcagagccatgcaactgcatttaattgcattctaccacacttatagggtcaatgtggtagatggaaggttcactggtctagggactaaaagaaatgagtgctggtctcagctctactgaccagtcatatgtccttggagaagtcattttccctctcttagtatcatctgtaaaactgggaaattctgctaacaatctgcagctgtgatattcgaatcctacactttggcattcagtgccatctataatataacacctgtccatctgtgcaggtttactgttagtcaatatatcagctagtagtcagctgagctactaaatgaaaattacccaaatatgtaccacatcatcttttctaatgctttgatggttatcttccatgacccatctcaaatgtcaaatttcccttataaaactactttgattgctaggaaggcccttaaacgtcatctaggccaggtacagtagctcatgactataatcccagcactttgggaggctgaggaagaactgcttgagcccaggagttcaagaccagtctgggcaacatagcaagacccctgtctctacaaaaataaaattaaaaaattagccaggcacagtgacatatgtctgtggtcccagctactcaggaggctgagccaggaggattacttgggcctaggaggtagagacagcagtgagccatgatcatgccactgcaccccagcctgggtgacagagtgagaccctgtttaaagaaaagtaaaattaaaaagtcatctgtctccctagcccccacctttcccagtaagaaaacttggggcctgataactgaaagagacatttcaaacccaaatatctcagaagtgatggagctgggctctaaaacaaattctgtgaatttctaggccatttctcttcacactacaccaacaccaattgctaggattccccaagcccatcaatgtttcatttgcgtctctcataatctatactgtgtgtgtcaagagttggcaaactatggttaatgggacatagtcaacctcctacctgttctcgtaaggcgcacaaaattaaaatgtttcttaccttttaaaattactggaaaaaaaagaatattgcatgatgtgaaaattatgtgatattcaaatttcagtgtccacaagtaacattttatggaacacagccgtgcccattcatttatatatcatctatgattgctttcttgctataacaccagagttgataaattatgacagatcctatagttcacaaagccagaaatactgactatctgggcatttaaaaaatcagctctctgatcttcggtatatgccattttgcgtgtacttatcttcctttaccttcctgtggcaaccccttcaccacaccaatcagtgtattcacctgggggcacacaggcaggaacaaggctctctctcaccatttatatcttcagtaatgagctaacagttgctgagcacccatgtgtcagaaactgttccaaatattttactaatattaatttattactcctcacacaaaaccacaagcctttttaatatttttattcccatttaatagatgaagaaagtaaacacggaaaaggctaagtaattagcacaatgtcaaatatgccatcttttgaattcaaacgaatgttataactatcatgaatatgtctgctgacctcagagacctttagtctgaggaccctaggttggttcattttgttagtcagtattctcaaactagatgaaaagtcgtagttccctttccaccctgaagaatccttattagacattcaggaattcctgaggcccagaaaacacaggcaaatttctggaggctttctacacagggaaagaaaaagaaaaagaaaaagaggtaacttggatgaaatgatttcagagtcatagaactggattctactatctcctatttcagtcttataaaatcatttaattttacatggcctccatttgcttatttgtaaaatataaacacaaagcaaaactaggtgatatcagatgtctcttccagtgctagccatggtatgaagcaacagaaggactgataaagagaagctcttaaaaagaacttctgacagctagctgcatgtccaggggaagaaaggcagacagggaggagtcaggggaaaagaagcactgactgcccaacactgattcacaaatttcagctttgaagggtccatatcccccaacatttgaaagatcattttggaagagtgacttgaaacttctgagagacatttgatgggtacctctccaaactgtctgatgccacccacagttgggtctctaacacggcccccagaggaagttaaagcttggatgtagagtaagcagtctcattctctcaacctgctaccaggatgggatgctattcatggagcacagcagagaaccaaagggtggccctgggtcctgagctttaagggaaagctgaagaaatgggaagctagagaagttccagaagctcaactgtaaaagcaccagcataaccatttggtgctaaagagataaataaaaaccacctaccctagtagaggaaacagaatcatcacctttaataaaggaacaagttagcaagtggtctgtctcttgcctcacctctgactggtatagcctctctcctccaaggccatgctggaagttcatcctacattttggtttcaagtataaaatgcatttgtacaatggcttatgttgttatttgtttcagatcctgtttctgtggcatggtcctgactgggacacagaacggaatgaaagggtctagaaactgccctaacatttctccacggttaccttgtcgtaaataagctggggctctttgacatgtttcaaaagtggctagccttatttgctttcaaaatccttttcactctttctgaataaattaaaatgcttcctcctccgtgaaaccacgtccaatgttctcttcttcctttcaactccttcagcactttgctcagttgcagtggagtgatctttcttgctcagccttgtacttcagcataggtgttctagaccatgacatccctgggaacagagaacagtgtagagcatggcttttggagagccttccttattaaccattacttgttagcccttggcccaagttatttcactgaaccatagtcttcatccttaagtcagaaaaatgatgcttccttgtcctgcagaatactcataagcatccaatgagaaaacgtgtgtaaagcattcagactagtccctggcacataaaaagtgctcaacaaatgtcactaacttttcttcatcatctgcattctttgaaaagccaagcacagggccttgtatacactgaatgctccataaatatcataatttggttgaagtaaattgctgaatcactaccttgtttgacttgctctcacattggatccaaccaggaaattattaattgttctcacttaccatgcaatgatatcaacaaagtaattaatctgtctttttaaaaaaattaagatgatctttaatatttacatctagtttcctagatctattacatgtacaagaaaccatttgtctgaattggtatcacactagcattttctaggttacgggcattaatacatattgcagaatgatacagtcgaatctattcaagattttaaggatataatttcactctagggaaaatattttgcccactcctcagaggacttaaatggctaaatcttcaagaaagtatcaaatttgtattacccttgttgctctagaagccaaattttggagagtttatctttgcctttgtctggctactctctatccctccccatcaacagccccattcctgggcactcacatcgccccaaacttccccaccaaaatggccctgagtgcactaactgggcagcaacctagttttaaacctctttcacattctctgtattttcctgtgttccaggcccccaggactttgtctgccagttgacctgataaaccaatccaagttaaaaaaaaaaaaaaaaaaaagaaagaacatatgctaatgatttgtgagaattaatggtagctccttctcggataatatttcattttattagggtctattagatagaattcctttattcaaatgaatggttctaattgtgaaagtttcagatactattttgcccaagaaataaatgctttgaacctgggaatgctttgcccaccctcaaatcactgtatagactgctgcctgcaatgcacttgcccttgatcacaaaagcattttctttgcttcagctgccagagcttttcctcttccacatgttcccctccttctactgaaactcactaggaagtttcaggtaaggtggaaatgtgattcacttaaacttttgtcttgttactgtctacactcttggctgggcagatcaaaggacaatcacaaatgtaaatttaaaacacctactgttcaatatagtctctgcaaagagaacttacaaaaatcacttgaggcagcaaggactacgagcaactgtcttataagtcaatgcactggaaaatacatcagaaaatggactgtttgattaataagtactactgagaacctagtcattgattaggtcttcaaaatatatattgtgtaaaacgtattttgtaatgtatatgtgtgcatggaggactggggatggaaggtgacagagtggggaggccagggagagaaagagagaaaaagagattttggaagaggaagaaagaaaaccgaaagtaatcccgctgcacttaatgaggccccattggactagtcctgaatccaaatctgaatctcaaaggcagacgctgaaagctcacattctcagaatctagtccatcccaatgggtcagaaaacacctgatatttatttccactaaatctcagctatatctctagggaacagaaataccttcgtttaaaaagaaaagtggaaacagctagtacagaaatccactggttttgttagccacctttactaccaagaattagagccaaagtgatagacagctaagggaaccataagtgatgtcagataggattctggaacccagagaaagtcaggcagaacgtttgccacaagagggagcagtagaatttggtcagatgggagaccatttggtaggggttatgatgaggggtgtatgaggtatgggaggttatgatgaaggatttaactacaagtatgggtgatatttggataatattttagcaaaacacatttatccttgggggcaaaaacaaaaagataaagggaccaggaagagtagagagataatagcatgttgattcctaaattcttagcaaatataaagtgacaatttaatgtttacttgaaagcaacatactacgaaaatataaaacatgcaacatatgtgctctaacagcctcttctagaggctgcatttctttttccagatctaatttatatttcagtttgaattttgtttattgccatatttttagggcagtctccttcttatctatatactatcctccctgtacctaaaaggcatcacaaagaaagaacttgtctcactgaattgcaacattaaaaaaaaaaaacaaaaaacaaaaaacaacaacaaaaaaaaacacacagacattaatgtcccaaaatgcacttactttgagacaaccacatctatgagctaaatgaatgccttggctggctttttaaaggggaattgcaacttccttggatctgcacagcttttctcatcatttattttgtcaaagaaatagattgaatactaagaggaatcatgtgtttattttgcaagtaaataaaagtctatatttgcctggcaaaagcatgttaaacatagctttttaacagatgctgaagttctcttggaatatattttattttttcaaaacacagaaagcttaacagagcaattaacataattcctgcaaatagtcctatagatgttactgactatacctcactttccatttgtaattttattgggagtcaaagcactgttactcccatgctcttttcttcccctggtcaacaaaagggctatgtgcttaatctgaaacgttacagtaggaaccactatataataatattaaagtaaagacataggtagatagatacatagaaaataagccttcatattttagttcattactctcctccttcagccctgttaagctttcaagacagtaaagtctgattatcatgacactcttacatcctttgtagccctatacagctcaacaataaataatggtttatctctgttcagtcctttttgttgctgttgtttttctaggaattaatcatttttttaaaaaaagacaacaaccattttaaggggacaaaatcagggcttcttttatagcaggtgtgagaaatcttagctaaagagccgtgagatccaaatggaattcttcaagcaggcagaatttgtaaaacgaaaaccatttaagagcacacatcttgcctcttgatgaaataagttggtcctcccccaccttctcactcacaaggccccaaagatggagctagttttcccttccttcctcctgctttcacacccgcctaacctcccaattaagcaagtttagcaaacccagggagctcaatccaagtaacacaggatttgaaagaggaacctaaaaccaatcatccctcttccggctttgtcttcttatttgaaatgaatgaaacatctagattcattttcctttttttttctgactcgctgcaggagtagctttgagagagaaagagaaagcatgtgagtgtgtgtgtgtgtgtgtgcacgcgcgcgcgctggtgggggcatgggaaagagaggtatactttcagaattctctcctggtggctccctctttcccttgggaaatcttcgcacaagtctcagattgtgcatgttcaactgctcatatctggagatactccagcaatgcctttaaccagatctgatcagaaatctccacctactcagctagaggctcctccatgatcaggacgcttgtactgtcttcaccacatctgtcattttttaaaaagcttcttccactacacctcccactgatatcctttttttctctttttagtctttacacctccagcaggacaaagtttgtattgttatattcacaaccactagtagctgactagcaggagagagagagagcggcttcaggagagccaggttcgggggcttcaaaaggatacctagcgcaaagcatgactttccaatgactgcgtacaacatgcacattgctctcttctaaaaatgctttgttaaatttcatcacccctgttctcaactcaaccactaccactttggagagggaaatacaaattgccagcccaagccattcatcaaacagcaacagaatccacggggtggtgggggggatagagaagaggcgggggtgatgcagggggtggatttaaagaatcaaggatgcacacgtactgtattttcaagagcatcgcctgggcggatttggtttctttggccggctgtccagctataagaccgccctcttcttcattaaggaggagccaaaaaggatatcttcacatctcagaacacagaccatttcccccaagagccagcaaagctccagaggcagagaatgcagctgcaaagttcccttccaatctcttggggaaagatgcctgtgtgtgcagaatccccaaagcacaccacggcacagtgcccagagacgtggaccccgcagcccactccctgctaccccctacatttcttcctcgtctgtctctgccccgccacacctccctcctctccgcagtccgtggtgaatgagcacccaacgcccgctggaaaacagggggctcggaaatgtggccttggggaaagaccccagggattaccggaaggagggatgtccgcggagaagagtccagtgggtggggacgcctggatccccagcagctctgcattcggggtggacttagctcttcgcgccctgaatcctcagagcccagcgcggtgcagggtgcagcatctctccttagcagccctttcttcctccggcagcctgcactggcaggcaggcaggcaccctcacgcccagacgcaccagcccgagcaatttcactctgggaagcgcggacacccagaaaaatgtgcaggcgcgcacacaccacatcacacacacacacacacacacacacacacacacacacacacacacacaaatttagaagccgctcgtttgccaaagcagagggaagtgtagccttatgagcagcaaatggaaaatagttcttggtctctgactaaatgccttctgcctgtccatcataagatcctacctggtttggggagtgtgaatggattcttcctccgttcctccacgctagtagaaaatacggcgcactccctccttttaaacagctcccgatcaggaagaggtcgctcccatcttctgtgggaagcacaaagcaggcggcggcggcgggctgactaccgtgcagcgccggcgcgagcgggagccgcggcagcgggcagcggtgcgcgcgggcgggaggcaggcgcggaggccgggaggctgggagggccggggcccgggcgcgcgcgcgctccccctccctcccgcgcacactcgcccgcccgccgcccgcagcctcgcactcgctcacacgcgcgctcggccccgcggctgccgggcgccccggggccccctgcgcgccccttgggctccccaggcgatcgcgtcggggcaaagccggcgcgtttctggagcaccgagcgggtggggagcccttccagcctcccagcctctgccggcgagcagctttttcgatttcctgccggctctcggccccgcagtgcgttgtggccgcgcgctagcgctgtctctcgcacccagcccatcgatgacacgcgcacacaggcgctgcaacttttcttttgaaccctcttcttctcttccgcagacagaaccctgacccccaattcgcctacccgtttctcacctctgactttgttaatccaactatctttcttccctcacttcctgcccttctgctaaaggaagctttcttttagcaaaaggatctgggcatatatcaatgattttttttttaatcctcaccctgtgtttttctacgtatcagatatgcacaactatacgttggctactagatgctgacacaagcaaacagagatattcgggggagggtgtcccccggccaagaactgggacagagtctctgtgttggtatttccctcaaagatgcgtttcacctgggaataaagacccagagtctgtttcgtgtgaaaggcgtgctggttttaaactacagtgaggagtaaaagccgagcattaaggttgagtgggaaaaaacctaatgcagcaatcgacgaaccattctttgccctttccaagagaagcattatcattgccaataaatcactttcctcataattaataaaggaacactgcaccaggcctttcctctcttgacagctcattcattcttacaaacccttaatgacttcacgtggtgaaaggctagacctactgtggagttcactagcttccaaacctggctgcgcatcacacacacctgggaatgtagtcagatgctgtagaatctgaggccgaatctgatgcagactctcccgttgtaggtctcaaatggggctccaaattagtatttttaaaacaccagttgctatcggccactggtgtcgtttgccaaggtgtgtgggggggtcaggagcagctacttggggaaggtgggagaaggagggacctgcagagcacaaggcagaaagttagttttttttcgtggagacgtccccccatacttacagtgcaaccagggcagtcaccacgactgatagattctgactccaggaacctcagtttgcctccgcaacaaagagggggcggaatggaagaaatagcctcttctgcccctgtgccagtggctctcaaccctccttgcacctcagaatctcctgggccgtttttaaaaatcccagtgcttaggccacacccccaaactgattaactttgactctctgcaggtgggccccagacagccttaatttgtttttaagatgcctggttgattcctatgtgcaatgaaggttgagaaccactgctctaggccaatactcctcaaacatgaatgtgagtatgaatcacatggggattgcagattctttttcaatagacctggagcaggcctggggtaggcaagtgttgaagtgatgctgaggccgtctgaatgaggacctcactttaattagtcgggtctgttgccagcagtcttggatactggctttgtagaggacactctaagctgcttcacgtcttataaaatttgcaggaatcgttcttgcctaagaacatttttctttccttgctataagttaaattttcttggaagctactttccacaccaacttggttagactacacttactagtggatataaacagaatgacctgtggggagagacagaaggtcactgtctcttttagaatatgtcctctaccaaaaattacttagagtccctgaatttaaggcagtgtgagtagcagatatttggctcacactcaatgaaaggggcttggagagaaaagtggctgccttctaaataacactaaggaaagcttataactaaagactccactcaataggaaatagaacacagccaaatgaaggaaccaagagaaagctaaatgaaaatgtgagtgggccatatttcactggaatagattttgtggaaagagtgtagcctcttattgctatgacgggccgcttagtgaaagctgagattttcttgaaattttaggcatgtttgtgacatggagtgacaagaaccctgttctttaaatgtttatactccagtgatgcccaaagtctgtcttaagactttttttttttttttttttgctttgaccattgaaactgaaaggctacatcttggccacttgattcttcctcttttccaatcgaaactgcttttagactgatttggattcttgggaaaaaaacaatattaaatggtcttctgtttatctagaactattggagaggcagcctagtgcctagtgatttggcatcctttttggttcagtcagtttctgagcccctaattttctttgcctttcatttctctttaaaggcatttttataatggttccagggccccaaggcaaatcaaaccttttgctccctcctaaatgtcatacatgagtgagtttttattgcgagaattatcaaaggctgcatcacaggcacaaggctgaggaagactatggctctaagaaaggaaaaagtgaggctgctgcagtctgtggctttggaaagaagacatgttgaatggaggaaggtggtaatttacattctaatagcagtaatgtttcttaattgcagtcttccatattgattgccattctttcctctggacttggaattaagagtcaccgggtctccactgttatctaaccaaagcaatacgacacaaccattcaggggactccacagggatatcactaagatttgatatattcgaaagatgttctgatgttcacaaactatttcctaggaaaccttcaggggatctgttagcaaactcattttcagaccaagtgtaaatattgtgaattaggccctactttttatctagtctatagaaaatttagacatgtgatcaggttaccaagatttttaaaaatatttaatactttactaaagcactcaatatgttttcatcatagggaaaacaagcacaatactctgtttaaattcctttcatttttactttgaattacataaatcagaggtacctctattgtctcttccattgcttcgggcttctgaaatatgttaatacagtcttagtcgtccctcacctcatttcttactctgccagccttcactaatcacctatctgttcagtcacaggctcagtttcatagtgatttctacataagaaaatgttattacataatagcccctagcctggccagtgagtggagcttagaattagccatttttccatacctaagaatctcaggtgaaccattgggttcccagttttgttctttaggttttctttgctgatgagtagatccagggttctttgctttggggatgactttgagaattctttgttgacttctaagtgctgttgttcctcttccctggagacttgttcctgcagttaaacttttacttctctgttttgttttgaccaactgaacaccactcttgtacctcacccagttgtaaaccctgctactgcacaacagtccacagactggggcagccttcctggcagactcacagtcacaactctcctcctctctgcattaccgtggggtcaaccacttcctctgagtcgccaatgaatttgtcacagtctttggacatcagggacctgcaattctacatttgagcaactgatattaaagaattgggtttgggctgggcgcggtggctcacgcctgtaatcccagcactttgggaggttgaggcgggtggatcacgaggtcaggagatcgagaccatcctggctaacatggtgaaatcccgtctctactaaaaatacaaaaaattagccgggcgtggtggcgggcacctgtagtcccagctacttgggaggctgaggcaggagaatggcgtgaacccaggaggcggagcttgcagtgagcagagatcacaccactgcactccagcctgggtggacagagcgagactccgtctcaaaaaaaaaaaaaaaaaaaaaaaagaattgggtttgtacaaaattctgagacttctgtttttcatttctgccccttattaaattaaggaaatatctagtctctgtcctgcaactttatcaatggtaactcaatggcagaatcattatctagagctattaatttagaggtcagaaaataatagcagattggttaagagccaaggctttagagtcagaatatctgtgttagatttttcagatccagctgtgtgaccttggggaagctttttaacctcttaaatctcaatatctttgtttggaaaacatggatcataaactctccctcaaggtgctgtgggaaggataaaatgtatataggatgcttggcatagttcctgatcatagtaattgctcagcaaacgatattgctgttattattactggtaaagtttcataaacatgatgtcaatgtaaattttaaaatttctatataattagattctacataatcaggtcatccaattattgatattgattatgctgttgtttttgttatacagagttctatgcaatgaataatccagaaaaatatacatttctacatcaagagagtacttttcctctctgtaatgaaaaaagctgcttgtgaactttctgattttgtaagtacatagtgtggttagtgattgattaaaaggggcaatgaattcttctctccttcacaataattctgttcccttatgtctgggtatcaatttgatcttatctctattataaactgagggtagaatttcaaagacagtcattttacgcaaatcctgctacaactaaaattttgattgtcacattacattaattttattaactgggaactttttctgtagggcgtaaacttcttcactaagtttacacaacacactttcctcaacattgattcaaggactcttcatcaaataggggctcaagataagctccctggggtgctttgtaccaggcagttgttccctacaatccagttcagaagcaatgtccctgcgagattacacttcagcctttttcataaatctcttttccaaggcaccgtttatgatatatatctccctcgctgtatcttcaattgctggtcactgattagactcttctgagagctgccactgttttagtgcttaccacaatgcccagacagtagcccttgaagatgaaacctaaggggaaaattgactaaacttatgggtgttgtaatccatgattttaatgatgctgattctgctactactggaagtgtctggaaataatgaaactgtatgctctcgtctctttaaaaatgtagactcatacagtgtgacctaaagaatccttagtaatcacaaacaagtaatacttagaaactgcattctattttcccattcttttaaaagtattatccagtcacacaaaagtcacctttgggtttgtttcagcattcctaagaatgtctttatcaaaacaaaggataaattgtttgtatagacattaacattttttgccacctccaatttaatttttatgtaagaaatccttgtgaactagttggggctgctatggttactctcattttacagactgagaaagaaagtacaaagggatttgccgaatcctggctgtacgcatgtatcagctgggttatttaaaaaaatactgaaagctgggtcctacccttagacattctgcctctattggtcagaagtcgagtctgggcactgttttgttttgttttcaagttttttgggatggttctatgattcagccagggctgaaaaccactgacctaaggtcaaatagctaatttgtggcaaagacgagtgataaagctcttttacgtctggcacaactcagtttcttttctgctgctctatcaaatttcactattaatagaatataaaaatgaggacttttctgggaaatttaagaggacttacaaacgtttaagtgcctttttgagtccctaaggggcaggtaatgtaattcacctgacataagcagattggaggatatgatctagaaagtccagtccattactatggggcccccttctacttgaacatttattcctcagcatctagagcagtttttggtgcatgggacatgaattagtagaacatgtatcgtcccctgtaaggggactggtgtagatggaaagaaggattccggtgatagggtaaactctttggcctctctccagtgcaaattgcaacttaatagcaatcatctctttgtggctgcagttcaggctctggttagctgacacagtcaccatatctacaccggtgttctgcctggccacctgctctgcgatgacagacagattgtctgtgacactgcaggacgaggaaccacacagagacagcaatctgaccgagcctcaggcttgagtttgtaaactaaccctttgtcagttatctcaggaattacttctaagctcttatttggaccaatttgtgactaagtcagagaatctcttatctcctctattaagaagggttcactaggcatggggtttataagcattattcttgtattcttatttattatttttcaagattcaaggaatatgtaagtttcctgattatgtcaatcgttggtcatcaagcaactcttattaaaggaaaaaaagctgggtagaacagagaaaaataaaacacagctgagagtagccatgaattcatttgttcactcatttctttatggattttttcaacaaatatttataaggatggactccggaccaggcactgtctcagacactggagagacagcagtgaaaacatcagtagaagtttctactctcctgggactcacattctagtgaaaaaatgacaggcaacaagcaaaataaacaaattaacacattgtagggtgtcatatggagaaactgctatgaagctcataaagcaggaaaaatggaatagaaaggtttagggaaagtactagtttaggtggtcagttctgcagagacttgaattaagatttcctgttgacaccaccaaaccttttttgagagtcccaaacagataaaatgatataggacagtatatttttttttgttttgaaaatttgtttctgccctgtactgagttttattttgtttttaggaattcctgcctcaaagccatcggactttatcagggtcagcagcagaggcatggccatatgacttgtaccactgcgttttggagcatattcatattaaatacatccaagagttgtttcaaaaagacagactgccaccaggggttgcacataaaaataaccattccttctaaggcacagttgacacaagaattctgagtgcctctttggtttatattatagcatcttattagtgcacctggatgaccaactttataagtaagctctggtgggtgaacctcttgccacaaagtcaacagcattggtgggcagtgttgggggaggccatgggaatcatgcatgtgtaacttaatggtggtcccagtgctgctttctatgggtccatcatacctccttttcctttttcctgaattgttacctgaaattatactatacacaacacacacacactcttccacaaactcacatactcattcgcatacatggcttgtaaatatggccaaatatttaattattgaaaaatcaccaattgcaaatttgcaaatacccatgaaaatcatagctgacctcttgtttttgtaaatgttatttaacgtcaatggtgtcaatggtgttttatttgcagagtcttgtatacttcttttcacgtctacttggagactcagggcctaaagcagattacaactcatatactgtgcttttttgaaatgaatgatatcagatttgaagcctaaaatagatatatgaattatgtatctcatggatcttaagaaaggatttaatttttctcttattgtttcttttgtaaaaagaaaaataaaaatctctgaatgttgctcaaggaaaagcagagcttggatagaaaattattccacacagcaaagtgcatacttcacttgtaacagatagatcaataaatatctgttgaataaatgatgcaatttaatggaacatgctactttatagggtaatcatttatattttgtagcagattactggtttaatttttaagtcattccagctgcaaatagggagtgactactccattcagagccatgaactaagttctgtggtgattaaaaaaatgaattagacactctccatggcctctaggaatttagacttataggtaaaatcagactgtaagtattttttaattttttttttttttttgagacagagtctcgccctgttgcccaggctggaatgcagtggcatgatctgcaacctccgcctcctgggttcaagtgattctcctgccccagcctccccgagtagctgggattacaggcaggcaccgccatgcccagctgattttttatatcttttgtagagatggggttttaccatgttggccagactggtcttgaactcctgacctcaggtgatctgcccacctcagcctccctaagtgctgggattacaggcgtgagccaccgcacctgactataaggatttttcaagaagtaagtgctatggccggatatgtactttatgaaggtaaatcttgacagtgtgtctgagatgtgtttaagtgggcatgaccaaggataaagagaccagagactcacataaaaggactctaaacaactactgagggcgaaaaggaagaatatagccatttttttctttggcccaattcttagcagaatcctattaccgctcagcttaatcttttaaaaaagtactgagttttcattttgagaggaatcactctggatggtttcaagtgcaacacatataatttctataaagtcgatactattataggaaaaaaatcatttttaagactggcatatcaaggtgcggatggagggtgctagtctgctgtaccaggcagagaggatatttcaccactgagatgatgaatggtagcaataaaaagcagacagacccttcgttggttttattattgtgcctaacttctctacagacaatgcaccccctgatcctttgcaacgtggatttactgctcccactgcctgtcccccttggtgtgctggtgtttctaaaacagattatagtaatctgagaatatccggtcttctttctatgacatagaactgacttgcaagtaaggaggaggtgaaaaaacccttgcccactccgcgcccctgcacaaccaccagacatttaaatttactgtgagtgaaagctaagtctgacaaaggatggattttataaagagcctcttacttcccttaactaccactgattttactattatttcagaaatatacaagaccagtgaaggaaatctaatatatttgtaacatttaatcaagtctttttgtcttttgatcatatatattcagaagaacattgttttgttaaaggcagtcttatttgttagataacaagtccaaagataaaataaattgtttgatttttcatgtgtatttttgacatctttctgacactgttaatctgacacaaactaaaacactatacattcatcgttataagaaatctagtgttgatttaacagtacttgacattataagatatatttataaaatggaaagaatatgctagatttttcgatgtttatcctctcattttaaagtaaaatcctcctttttttttttttttttttttttgaggtggagtctcactctgtcgcccaggctggagtgcagtggcacaatcttggctcactgcaagctccagctcctgggttcgagcaattctcctgcctgagcctcccaaaaagctgggattacaggcatgcaccaccacacctggctaatttttgtatttttagtagagatggggtttcaccatgtttgccaggctggtctcaaactcctaacctcaggtgattcacccacctcggcctcccaaaatgctagtattacaggcgtgagtcattgtgcccagccataaaatcctacatttaattaaataaatctaatactttttaattcttaatcaactataactaaataaatttaagtaaacttatttaaataaataacattctatttatatatgaatcctagtgttagaaaaatacctaatgaatttcctgacaagttgggaatcttttcttttttttttttctttgagaggcagtatctcatattagagaagatcagagcaggcggggcatggtggttcatgcctgtaatcccagcaccttgggaagcctgggtgggaggatcgcttagcccaggagttcgagaccagcctgagcaacctagtgagaactcatctcaataaaaaagtcaaaaattagtcagatgtggtggtgcatgcctgtatttctagctacttgagaggctgaggtgggaggattgctttagcccaggagtttgaagctgcagtgagcccagattacgccactgcccttagcctgggtgatagagtgagactcagtctaaaataaaatataaaataaaataaaataaaataaaacagcaggaatgagcttgagttttgtgggaataaacttgaattttggtagttgcctgctagctgtgttatgatagataaaaattattcgttcattcactcatttgtttattgagtagtttttgagtgaccactaagcaaggtcctgtgttagacacaatggaattatcagtgaaaaaaaaaatggggctttcatcgtggggaagaaaactaaccaaattacacaatttagtttttaattaacattgtggtaagtggcagcaagaagacacagagagtgggcttagacgttttctaagagagagagctaaccttttttagtagactctgtaaagctccaaaaggtaaataagcattggctaggaaaggagggagtgaagtgagttcagtagagccctggacaaaagcagcttcggacacaaaggccctgagatgagatgcagttgaggaactgaaaggtcagaggttctaatgcacgcagccagtgagggagaaaggggtgtcagcggcggctgcaagataagcatagtacgtgttgaacttgtcggaattaattttttgcttttgtttttcctaagatcaaggtgatatctgcttcattctaaagaatcgccttagttccactatagaacaattagccttacagttactaaattttctgccctttttcacttctctctctcatacaaaatttagcagaattccttctaacttaattattaaggggagaattgacaactggaagattaaaaacaaattaactcatattttctatgcatggttttactttcattgctatcccttgtctggggtctcctgtgtgattattagtaattgccacaatgaccagaattatccaccagattgcttttcagattgcttggtggaatcttgttctttttttgcccatatcccttcttgatatgctattctaaattactctcagacttacagacaagggaggaggattaaagaggatatatacatacacacacacacatacacacacacacacacacacacacacacacacacacacacacacacacatatatatatagagagagagacagattgatggtgtctcgctctgtttcccaggctagaatgaagtgacgtgatattggctcactgcaacctccacctcccaggttctagcaattctcctgtctcagcctcctgagtagctgggattacaggtgcatgccaccacgccaggctagttattgtatttttagtagagacggggtttcaccatattgactaggctggtcttgaactcctgacttcaggtgatccattcacctcggccccccaaagtgctgggattacaggcttaagccaccacacctggccaaaagaggatacatacaaatatatttcgggcagttccctgaaccagataggttcagagagattccctaaagaagaaatattggtagccaatgtaaacaaaaacagcactggctgaattctagcatagagacaacgcatttcataactttaaaagattccttcatttctacctctttgtttgcagttaagttttctccattgtggcatatgagcaaaacaacaattagacccagtctactgtgcactctattaggagttgtgaaggagaggacccatttgtttctcctctttgaggtaaagggaagaggttccaaaagaattgctttaaagattgtaagaaggggagactggcatctgtttcccaatcttagcttccagctttcttctgtatcatatacccctagagttggtgaaagactacagaggaggaatggagtggtgtggggtttgtcactggagaggtatttaaaacagtctgagaagtggggatgtggtgggggcatgacattggaactgcagacctgccaaggactctaccataggacacaggatgtattttgagtgaggccaccagttggtgggagtcaacctataagaataatctggtcacatgtaagttcccccagtgcctggaggagatgctgagtaaagagtccatctcagtggggacagttgagtatttgatccaaccacactgattagataataaatgagattgatcagaagcaggtgccaatatgaaggagctgcaaccttgccacaagaggtgttctctccttactcctctcccacccccagctgtgccagaacactatagaagcacagaggaaaaagggcgggtgagagggtagataatatctctcttctttgcaaatctctagagaagaagttgtcaactagggttgtaccactccctcgggggcaattttaaaattcatggggtattttatggttgtcatgataatacgaaagttgttatggatatttatttgactagagccagggatacaacacatcttgcaatgtatgggacagtctcctaccatagacaattgtccttcatgccttatagctttcaagtgttttacagggcattcatgtaggtgaggaacctattacatatatatatagtatttttggcatgcttacatttacactgatttttccaggaatataactactgtgtatattgaagaaaaagtgtactgttttacttggaatttaacaaaagtttttcaccattttgataaaaatcacttcactgatggcaatgttgcctgttagcaagcatttatagctgttgcctttggggtagttctacataatggaacaagcatctgattactacatcatctcttttaatgtggttctatctgagtgtttatacattaagtaacgtattaatttattataaaatgttaccatttatttcccttgtatattatagttaggtcattataaagaattttaatatatatacatggaatatgttatattcgtaattttatttcagaataaggtgcgatagcgtatttttttatacaaggagtactatggtctgaatgtgtcccctaaaatttatttttaaaataaaatgtgttggaaaacttatcttcaatgcaacagcattgggaggtggggctgcattggaagtgtttaggtcatgagaaccctgccctcatgaatggattaacaccaatatagaacggtcttttggggagtggattttctctcttctgcccttctgccatgtgaggacacagtatttgtcttctcttgccctcctggcttctgctatgtgaggacacagcaagaaggccctgacaagatgccagcaccttgattgtggactttccatcctccataactatcagaaaataaatgtctgttctctataagttacccagtatcaggtattttttcataacagcacaaaatggactaaaacaagggggaaattgagtccgaaggaattgataccctcacatttataactctctagagttaaagaaatatagtccactgtggcaagggcaggggttgggaaagaaatttgaattgattatgacattgacatttaacaataaataggactaagtcaatttcaaaaatgaggctctttcaatcaaaagcgatggaaaattttgtggaacgatatacccgtcaggaagctggggcagcaaagaagcttcacaggggctacactcaagcatattattaaaacatgtcttaaaggtcctctacagcttttacatccaataagatggtcagctgcctgccataagtctgaggtgtatgaaaagaaaatatgtagtttcagttctgctactaattaggtgctggtaaatccacaactgctctgagccttgcttcccttgcaaactgagggtgctaatctgcttctttctatattacgaggatcttgtagtgcaataaggataaagtgctctgtaatgacaggaaatatgattctttaccctcttgcattacacagtacccaggcccatgctgtgcatattataatacctaataattcatgttggtttgttgaatgtgtcttttttctccctaaggagcatagaggctgaaaattgcaacttggactctgtatttccaatacatgctgcttaattttttcattcacatatttatgcacctgaaaaactatatatgattacttgacatcaactcattagaaatagccaagagagcattaaatataaaagtgcccagatattgagattagtaaattaaataccttacaggaatgagttatctaaaaaaaaaaaaaaatgtgcagagaacggaagagaagtgacatagagctttaaaagatggattaatttgagagtgaaatcccacctggtgcacaccagggggacagttaattaaagcctctgtagaaaggaccagagaggatccccaaggctggctggaggctaagctggttagagcacagtgcttatgatgccacttagcatatggatctgactcccagaagggttgctcagcttcaatttttacgtgtccaaagactccactattaaccccaagctgcctatctgaaaatgctgtccttttgcatacagctgagagtgtgttggagcactgatgtatatgaactcaattttgttactaaaggagcatctcacagggaaatgatttgccccataaagcactaccctatagagctacttctgatgggggtgggggtgaaagtgctattaactgctattcagtacagatggagagaggacaaaagtcaaaacaattttattcactcctctaaattatctttctctcaattaaaaacattggcagctgctattgttgtctccttttatgttccttctacagaataatgatttgctgcctttttgttccttttagagacaatttctttcttaattaaaggtcatatagtatgtctttctatttgacattcgcataaataactgcatagtgtcggtcttgttattcctgtcagaacgctgtccactttaattaaatcccaattaatttcctcttttcccaaagaaaacaatggtggttttctgtaacacttttgcattcactagtatgttcaccatccttatctattacattaatgatattaaattttatggttaccacctttgcaatcttcacaaagtgatttttgacaacaaagttggagtaaagaattgtatcatgcatgatcataagactgcatataaataagccaaatgtattcactattaaatatgggtataactttaagcaaatcacttcagcttcctagatctcagtttggttgtctataacatgagaatgttgaactgatttcagtctcttttacccatttaaacattgagatattatgatataaaatctgtgtttaatcttttggtttcaatgcttcctacacataatatacccatttattttaatttgatctacattataccttacacacaagatgacatggaaatgttattatttccctccactactgacaattattttatcatgtacaaagtatactcattcatttttctctggaaaaataattttgagatattactaactttagtaagcatttacgtatttaaaaataagtggcgtttagtggtgtttatgtatattctacatattactattattggccttgacagaaatacagactttgtccatttaaacagtttcttctaattgacaattacttagtttattttaattatgaagactttttatgtctttctacataattcttagcacggctcattaagtttaaataagcgccttctgaaacacgaataatttttagattattacaattctctatttttaatttctgcttaattaaaagttacttttcttttctgtattttgtgtattcccagtgtgcataaatcttaattatatagtaatctatgtttaaatacttttttcctccttttttatcatagtaaatttcaaacatatgcaaagcagaaggaatagtggaacaaaccccatatacccatctttagcttcaccagttgtcaactggtgctcacttttgttgcatctaggtctcttcttcacccttcaccttcgatgactttaaagcctttcctgggctgggtgtggtggctcacgactataatcccagctattagggaggctgaggtgggagggttgtttaatcataggagttttataccagcctgggcaatatagcaagatcccatctctatatttaaaataaataaagaaaatcaaaaatcaaagtaaagccaatcctggatataatattatttcatcagtaaatatttcaatatatgcttctaaaagaagtctgtatttcataagtgcaaaaatattaccacacttgaaaagttaataataattccataatctcatcaaagatccctgatggtctcattaacagtgtgtgtgcagttggtttgaaagaataatgattcaagtagcattaaagcattaactatgtttgcaatgctttttaaacatacatgatgatatggtttgactctgtgtccctagccgaatttcatatggaattgtaatacctacatgttggaggagaggcctggtgggaggtgattggattatggggtgaatttccccatactgctgtcatgatagtgagttctgatggttaaaaagtgtgtggcacttccctcctcactttctctcccatgccaccatgtgaagaaggtccttgctttgccttccatcatgactgtatgtttcctgaggcctcccagtcatgctttctgttaagtctgaagaactgcaagtcaattaaacctgttttcttcataaattactcagttttaggtagttcctaatagcaatgtgaaaacagaataatacacaaaacaatgtttataaataccactccctcatcctttttatttttattttttttgcaatttaatgtttgaggaaatcaagtttttgttccatcaagtttcacacattctggaatttgctgattgcatttctgtgttttcttttcatggatttctctgtcccctgtctttcctatatatgtttataagctattgaatgtattatggattttgttgtgtatatatcttttattttgtcatatcaaaaggaaaataatgtctgcttacactcagtgttgctaaaattgtcaatgtgttcaggtatcgtcaacttgattcgtttattataaaccttcccattgaatgttttcagcaaccattgctaattattgcctaatcctttatttccttggtgatttcaaaacgtttgtatcctaaaactataattactttatcattattaactgggatttttaaaataactttctctcatcgactatttggtttccctaaagttcagtttcaacattgttttagtactttcactgaattctacttacgcacactctttccctatttttctgcatactcttcttattttctctggaactaatccacattttaatgtatctttttccctttggataacagcattaaaactcagtttctttcaattaaagctctacactttgggaaaacttaaaaatttcccattgtgtttaaatcaaaatagtttttctgtagggcaatctagcaaactttataaaatttttaataagcatagccttagaataattatactagaagtaaattatcctaagaaaataattgaaaagtatgcacaaatataaaggcaaagaagttcaaaatggcattatttattatagcaaaaattactgaaaacaatataaatgtccaacactaggctaagacattattataaccatggaaacccattaaaaatgggattgtaaatgtatattgacatgaacagaatgaagtattgattaatatagacctatattaacataaacacatattgtgttaagagcaagttataaaacattacatataataagatcctatatttataaaaagaataattttatatgtatagctatagatatatgtatagaaaaaaataaaagactatccctcaactgatatgtgtgtttgtcaacttctggatggtggcttttgaataatcttttctttctactttatttactttcattaagacttaattttttcacaattaacaataaaaataaaattaaaattttatcttttataattagggaagtgttttcaatcaacaattgtttaattgccaaattaaactatcaattttcaatgtggaaataaaaaaagatccttgtcacttaaatgtaacacataccactgtatcttcttctcttaaatctcatggtacagattacaaacacataagtggttttgctattactatgagctctacaacccagcttttaaaatgggaagacttgctgctttttatcatctgtgaaattgctgattttacactgaagtggctgctggaagcttttcactgaaggcttggtttctgaaacagcaaacctctgccactgctaatggagactacatatgaagcaatttaatctttagaaccaccctctgacataagtattgataactttattttatagggaagaaaaaacttcatgtcattcagctcctaagcagggccgtggacccagggtttttttactgcagtgtccgttctttacctgcttgaccactgcttttccacctcagctgcatttccttcttttctaccttgaaagtcctacctgacaagcctgtgtgacaatcacacagaaaacatcttacttaattctctatcaccatatgaggctggaatagatgacctcatccatcaatgtctaaactctcatggcattagcacactttcagtccctgtgaaataggggcgtactacctcccacccctgatcctatggagtgagacagtaataaaccgtaagctaagcacactgacttgcttttgctgcctaaaaataatgtttctccatcagtcatatagaggaagcacacccctcattaaaataagaagttactgacctcaggcatctgtctggaaataccctattcatgtaacccaaggaaataaagttgacaggaaatctgaaatgattaatgcaattgcaataaatggaaacaaattttttgaaattacaaatagtaaaaacgtcagctacctttggcaagataggacaaggtccattttttaataaaaactttctaagacaaaacttcaaaacatatatttctatatcatgctggcaaatcttaaagaagtaagaaatttaaaatatgttcatccagctacaatgcatcatctaatagatgtaaaaggcagggcatcaatcacattaggatagagaactcttcctgcttgtgaaaggaggagaggaggagactgcggttgactatgaacaaacatgacctatgtctgaaccgggggaattgtaaacatggggcatggaagtggaggaatcaaagtggtatggaaggccaagtgctgccaaaggtgaccttctgactttcatataagaaaatgtccactttatatgacaaccttgcagtaaacttacacacgcatattgtggagtaaagaaaaaaacttgaattggaagatgtggatttaagcctaacaacttctatgtctcaaattattcctttaatctctgtgagcttcgtaaaattgccccttttataagatggaaatgaaacattccatcttccttactccagggagttggagatgacatgagaacacacatgacaaacacttgatcaaatataaaagcactatattaacatgtctgaatttttagaattgtttgccaattatcacaaccctatctgttgtcactgcacactcatctagctgtttcatagatgaaacaaagatgtttcaaccaatgtaagatctttggttaaaaaatatttttttttagagacaagggcttactatgtgcccaggctggtctcaaactcactccttgcttgaagtagtccttttgctttggcttcccaaagtattgggattattggtgggaactaccatgcccagcccaaatgtgttttcaacacctaccatggcccatacccattctaggtgctgccaatatattaataaacataataaaactttctgtcctcatggagttaacataaccaatcagtggaatctaaacttacggattactagatttgtgagagataattcatgcaactaagtctactagaagcacactatgtgtcaagaacaatgatgaagtagaatatactgactgttattgtggagctcatggcttagaatgctctctagagactgtcaagtttaaggtgagttacaatacagcataatacagcacagataatacatacaggaggcagataactcagatttggaagtcaggagggtaacctgagagcagcgctgctcacgttagaagtcagaatggcgggagggggcgggagggttgcaattttcacattctactctgtttcccgagtatagtgttccctggctggggtatgtccaggggaaaaagacctgagatacagaggacctaagaatcacagcacatggaaaatgaagaaagaactgaagatattccacctggaaaatgaaagacatagaaaaatacctaattataaataaattaaacttatttggtatgattccagaaagcaaatttcaatctatggccaagtaaaattttcctaaaatccccactcctgcctcttcaattgcttctgggaatatccatccctcactatttaaccagctaacatctcctcctctccatctcaacattccttttccctctcccctacttgatttttctccatagcacataacagtttctgacatacataatgttaacttatttattattaatctgctttttccccaaataatatgtcttgtaaagacaaacattttacatgttttgttgattgctatatttcaacttcctagaagtgtgtctggcccataaatatttgttgaacaaatgagtgaaagttgttcagaatatgaaatgggttgccacacagagcagtcttgctgtcgaagacaaaggatagtgggcttgtttattacagtattaatgagatgggtaagaaacagaattaaatggacttatatttttttctgatagaaatatatagacttttccttttacacacccagtggtggggaactcatttcctcaagcaacttgggtagataactctattttgaagtttattgttaggttgaaccaaattcttccactttgaaaaatagatttagtgatcctaattttaatatgatttgatattcaatataaatataggcataatctcatttagtatcgaaaacttgccaaaaatgtaacttccacaaatcgtagtcatagtgcaaatagaaaaataagttacatgatctagaacattccagctaagattattccttctgctgtcctttctgtagtgcaaatgttgagaactgcctctctcaatagactatctccttacaagactggctttcattgactctcatgacactgtgtcagaacaattgttctctaggaatatgattttaaatatatggcatcctggcttgggaaacatcaggagattatatacttaggaattaacagattgtcttccctgtgaatactaattttcataagttcagtctttgttgtattctttgggacatgtatttaatctgcataatgtagccttatcacatgattactggttaaagtaccagaaaaagaagtttactcttggacaaaaacataaatggtttctcagaaaagaaaccttaaatggccagattaactttaccattcaatttctaatttttttgacacctcactacttcctaaggttttaatgtcagcttccccttttaatgtcagcttccccgttttcttccagagttcctgctagtattttggtactattctcagaaatggtggtaacagtagctaacaatactaaattggctatgacagttactaacaaatattaatgttcctagtactgttctgaatacttcttaagtatgaagttacttaatcttacaagccctttgatttaggttctaatattattcatattttatacttaaagaaactgaagtacagaaatattgagtaaatccaggcagtttggtttgggagcttgtgctcatggctataatgttagatcatgaaacttttcattggtttccataaattcatgtttgtaaggctttatttaactgtatatgcaaatagtttggagtaatcatctaagtctacattaaaaacttttgctgaaagaataagacataacaaatgtaaaaataaatcattatttgtttggagtcctggtaaagatatataactaaagtgatcgaggttactaatatgtcttcattgttttaagtttaacttataaaaaaattatttaggaatcgatttgttgtaatctcaatgtcttggagcagcagttctcaaaacttgtgaacttctttctgctataaaaattatttatttatttatttatttattttttgagacggagtctcgctctgtcgcccaggctggagtgcagtagcgtgatctctgctcactgcaagctccgtctcccgggttcacgccattctcctgcctcagcctcccacgtagctgggactacaggtgcccgccacctcgcccggctaattttttgcatttttagtagaaatggggtttcaccgtgttagccaggatggtctcgatctcctgacctcgtgatccacccgcctctgcctcctaaagtgctgggattacaggcatgagccaccgtgcccggcctataaaaattattgaggacccaaaaaacttttgcttatatagataatatctgtaggtatttattgtatttgaagttaaaactgaggatttattaaatatttagtttttaattcatttttaaataataatatacccattatgcattaacataaatacatatgtacatgacatatgtacatgtacatatacatacatgtacacatacatgtacacatgcatacatgtacatgtttatgtaaatatataaatacataaatacatattttttacaaaaataactacatttgccaaaataaagctctttagttgctgaaggatctcaaaatcacacttttgagaacttccatcttagaatgactggctaggaaaaaaaatgaaataaaccctagggcattctcttagatcattacctaagccctagattctcctattttcagtactattttcccccaaaaaacataactttctatgatgcatcacatcatagaaaaggattttgggagaatttgtctcctctgagtagttttctgttcaaaagataataaccttaacaaattcccaaactcatttttttctttgagaggtattgttttggcacaaagcatgaaaataaataaatgatgacaaatagcatcatttttcaattcgattaaagcattttgaggttagttgtggaacttcttgatttttctatgcaagtgtaaaagtctattacagaactgtgactcttttctattcatatattcctcatattatctaatttgcaacaaccaattttcacttgtctttctcaaaggggagcctatagaaactctggacccaaggactaaagcaatgctgtttcagtttcccagggatgcctcggacctttatcccttcttcatacctgctggatatcaggcattcttgatacctgctggaggcaattcattcatttagggagagagaaataaagtcttagccttcagctgggaaagactgaaaataaacaaagatatatttctaatgttagatactaataaagcatataaaaaagaaaagcaagctttggggaaatagaatgactgagaggatgtttaggtaaggtgcttagtgaaggcgtcattgagcagatcacatttgaccagagaccttaataaagtaagggagagtccattatgggacaagattagtctgggcagaggtcatggaaaatagtaatttcctgaggtcagaagaaacttgacctatttgctttagaggaaatagtgggagcaagtgtggttagtgccaaatacatggtagagatttagaagtaaaggagggtggcatagctcagggatagatcatatagggccttgaacaccataggaagtcattccaattttatgagagtgcaaaaagccattggcagagtatctaggaggagtgatcatcctttcagatttttctgatacaatcaactttcaatagtgagtcttgttctttcctttatttatggcatcaaatttaatgcctactgcatatttttgaagcagtgagtgaatcagtaaatcaatgaataagagttattggattttctctaattttttttgggaggatgttctggaaaatacaggaattattgttttgtgggtgcatttttcctatagcaaacataatactgtccacgacaatgtcatgcattatttgtcaagttaaatgtttaaaaacatttaatactattttctgaaaacagaaacagaaagtccattaaataataaatttcctgggcaacgtgatctttttcagtttatttttagtagtctgaactaccatggtatctgatatctgaagaaaacactgtttctcttacaagagagaaaaccttgtgttgtagtcatggattgagagctgaagtgttgcagctccctatttctagaaccttctgaacacatgtgagtaaatcagttcaatcctatgtgcttctggttatttgtctgtaaaatgatccacctactccttctcccagccccctccctatttctttgtcctacacggttgaaaagaagataatttattgtcacttaaacaatgtcttagatacgaaccctcaacttttcaagcaccacccaaatgccaaagactcttgatgttttgcggaaggaagacaatcagaggtttggcttagaaagttttccttcctctggctgaagatgaacttcacagcatttttctccactttgtacacgtaagccacatgagtaattttcctttaagttgaactactgaatttaaataaagatgagtgtgtttttgtgtgagttatatgagtgtgtgtgcctgtgcgtagtgtgtatgtgtgtgtgcacgtgtgtgtagggggagatttgaccaacatggggaatgaatgcaaagacattgaataaccaagtttccagccacctcttagttagcatagcttgatgtggcttactttccagaatagttgtgacttggtactttttaggagctatttggactgaagctcagggaataaccagatgaccataatgtatcaagaacttctcagaaaaaggtactgtataaataaatggcacttttattattctagtctgcctcctttggctataggttttgacatcaaactgtgaaagtcagtaatacagtttctgaagagctgttttactttctttttttctttttcttcctgttctctaatatctctattctgttttctgaaaatactcagctatgccttggctggggatgataaaacccttgttcacccagttttcctgattgatatctccacacaagctgatacacccacccgccctcacacacaatcagagtccattaccatttttctgaaaaaccaaacaagttacttgtttaaggcagttctacctgtcatggtgagacaactgttatttgagccttaattagcagagtattgggctgaaccatgtgtcttttgtgtcctgtttgcaggttaaactcaatatgacctttacagatctaaaggtcctaacaaattgcaatatgcaatcatttttgtatctacaaacccaaatatttaaaaaataactatttaaagcaacatgagttagctagtcaaatgtgctgtccatttaaaagtctatgattttctttggtaaaaagctcaggtagttttttcactgagtttttttcagtaaaatattctataaatatgagtgtatttctctctcccttctgaaaaatcaatatctgatgagttccaaaatctctcatagacctaagtttttaatttgacttttatactttgatagactttctgaaggaaatttatatcaatttccctggatgttacatttcattttcaaccacctaatttgtttgtttttttttttttttagacagagtttcgctcttgttgcccaggctggagtgcaatggcgcagtcccagctcactgcaacctccgcctcctgggttcaagcaattctcatgcctcagcctcccaagtagctaggattataggcgcccgccaccacgcccagctaatttttgtatttttagtagagacggggtttcaccatgttggccaggatagtctcaaactcctgatcgcaggtgatccgcctgcctcgacctcccaaagtgctgggattacaggcgtgagccaccacgcccggcctcaaccacctaattttaaacttcaggagaacgtataaatttcaccaattcacaccattaattcagaatgtacaaagatttagacatgtgactgttgtcgaataaacagttaacatatttttgactgaatgttggagctttttggtggaaattcaattttaaattagtatctttttcaaataaatatttaagagctgtcaaaatttgtatcttttgtatgtaacttcaacttctaaatttaaaattactgtctttgtctaattattttatattttagcatagtcacagttaattaattgttctactagagcttgaacccacattcttcatttgcagttcattttctgatcatgcattttctctggtttgggcaaaaaataaacatttttttaagctcataacaatttatatcttggtcatctggttggatattactttctctctcaagatattctcatttggacataatagtagtaggtatttatatattctatagatgaggaaacacagaagtttcttatcttgattagaaagagaaaatatttcaggggtggtaagtgagcttttcatgctcctatctgttaaaataccggttttatctctaactggggaaggtaagtaccaaagtattgacaatgagtgtttccatctcagcttcggcaacaaggtactttggcatcttaacattcctggatttgtgaaaaacaattaaaaaaccattaatattgggagaaaaatataagcccagttagtatcccttgcattgtttgtcccttcatagtgatccacttactagctgtgcagttgcctaccctcagctcccattccatgggccagtaattaatgtaccagggtaatttcttcctgacgccacagtctgttgatatagttatgaaaactaactgaggacctatgataaggtttccacagtgacttgattttactgcaggatgggactaacacaggtcaagaaaaaactgtaaaactggaaacagtgcacgtttattgtttttttttaaaaattagatactgattttttctggtgccagtagagaggccagaaacatttaatcttcagaactaaaccccaaaacctcatgaaacattgaaagaggaaggcaaaagttgctctcttccccaaatgtgaactacttattgcatcaaagattaagctgtctactatggtctgaatatttgttccctctaaaattcatatgttgaaatcttaacccccatggtgatgtatgaggaggtgtgactttgggagatcatgagggctctgtcttcattaaagggattagtgtccttatgaaaaaaagtcccagagagactctcaccccttgcatcatgtgtggacacagaaagaaggcaccctctacaaaccagaaagcaggttctcatcagatacggagtttgctggcattttgatattggatttccagcctttagaactgtgaggaataagttttgattgttgataaggcagccagtttatgggatttttgttataacatcttaaatggactaagacactgccctaactttgcttagattaaggaggttgagtgtatcagctgaatcctgaccaaaatttcttgttggagtggaaaggactcaaggacataatttaacaagttgtgctgggcatgtcaagtgctctagaaatttcatgagtctcctcccagtccacatattgtcgagaatgaatgagctcactaatctgctacaagatgaagaccacgacgttatacaggctaattctgagtcactgcatcagttgagaccagcagccactgacttacaaacacaacccaacttattttttgaagagattcgtagtagccaaaaatcgcactgctgtttaaacacaaatacttaagaatataaaagatcataaccacaaccttttaattataatgatatcctttaatgtgggagaagaagagaggagtatattatttgaccttagatgtaactgtatggaaaaacagggcatcagtcgcaaagtcattttacaaaagaaagcatattttcttgtgtgtgtttatgtgtaagagtgtgtgtgtgtatgtttgtgcatccatgtgcacacttgctcatacaccatagtattttaaagaacatagtttaccatagggaggaatggatataaaaaaggtgattaattagttctgtggcatatcttactatagctttctaaggttcacgctttttatatcacctcacacacaaattaatgccatatttatttgaaagcagcacagtgttaaagaagacaaaagagacattgaattcagccatacctggctttaaattcctgtcacatgttagctgtgtgattttatgcaaaattatttagtctgcttgatctttagttttcttgtttataaaaataagagtgtcacttttcttacagaactgttgtaagaatgcaaccagattttttagcttctagtaggatgtctgataactgttagatccttcttctttctctgtaagaaccatagttcgatctggctaatacagtcttatactgaatagaattatcataatctctaccactaggcttgtgagtagggggagaaagtggaatcataattttttattcctgaaaatacaccaacggaaaagtaatgatttctaagtcttaactctttcagacaagctgtttttacatgctgaaaagtgagatgccagttcttcatgtctccatcgtttctgtctctttaacagttcagaacattcctttccctggacaaattctgcaaaatgaagttaggtttccaattcttctatacccttttagttggtaatttttgagtcaggattatatagatcaaaatttgaatttcagagatggaagagatattagagaatagttcaagttttaaggcacattacaatcatttgagaggcttgataaaaacagagatttgtagaacctgtcccaaaagattctctttctggaggtaaaggtcccaagctcctgcatttttttaaaatacatattttattgtggtaagaatgcttaatatgaaattgatcctcttaacaaacttttaagcgtgcaataagatattgttgactatagctacaccaagtttctacattttaaaaacgaatgtcccagatgtctttggtttagttgggccactctctccagagggagcactactgccttaaagtctttctaattaacttttcacacattgcagggtcatttatagcctctgactcagtgcagaactgccaggggaggctttgggttttgtaagggttgaagcttatacaatatggggcctacattaagaaaacaaagtttaaaaatcttgtatttgtaaattttgccaagcatatggccatgtgaatgtactgctagggcttctctgagggcctgagaaggaactcatgtctttagggtccctgaagcataagcttcatattatatgcactgctgagtaccaccgatgacaattcatccctgttattatttctattttatgggatgaagaaacgaaggaatggagactttaagcaacttgcctgtggtcacacagctggtaagtggcagagtggggatttgaatccagacagcctgtctccagtctttgctctttgtgccatgacaacgtaatgccacttatagacacttcctgttttctgaaacccagagagacaatgtttttccttatttctatgacagaagccacagttagcactttttttttttttttttttgagacggaatctcgctctgtagcccaggttggagtgcagtggcgcgatctcggctcactgcaagctccgcctcccgggttcacgccattctcccgcctcagcctcccgagtagctgggactacaggcgcccgccaccacgcccggcttttttttttttttttcttttttgcatttttagtagagacggggtttcaccgtgttagccaggatggtctcaatctcctcacctcgtgatccgcccgcctcgggctcccaaagggctgggattacaggcataagccatcgtgcccggcccacagttagcactcttaatgaatgaactaaagtgctgaagacaataaataaaaatatacaataattagctgaacatttatgtattagttattaaattaccctatgtatttatgtattttatattttaaaatctaaatttaaaattcacaatcactgaaaatatatatgttaaaaaatatatatatatatgataaataattgatgaagtctctaggtgattaaaagataaagaagatacacatctggcccccagaagcttataatctaatacaccaagggtgtgagtagagggagagggtgggtgagataggtataaagttacaaacagcatgaggaagtatttgaaagcttcagcacttggagaggagagaaagcacaatcctaacctccgcaagagaatagctacagtcaacaaagccaaaacagaagaaaaaactaacagagactgctaattctctagtccagtattttgttggtaacagatccctcaattttatctgctcagaataaggattatattacggtaaagtgaggccacatgactaggttctgcctggtaaataaacagaagtctcatgtggcaattttcagaaaaccttcttaaaagatggctgacgtacttcctttgcttatttctcttccctctttgtcttttctgctggatggaattcaggctgatggctggaacttgagcagccatcatggtccacgagacagtacactaagaatgacaaaatatcaagataaaagaaatcctggtgattataagccactgtatcagccctgaattgcttatctccagattgtgatcatcagagagagacagaacactatctagtttagaaagcatttattgtgagtttctgtcatttgcagctgaacttagtcctaatggatacaaatctttattgagaatgctgacctcaaccatcattctgttaaaaaggttccaatgcatagagagggtataactgtgactaatataacatgactatatattttaaaacaaatgtgttaaaatgaatccaaatgaaattatccctcacaggctgtccctttgggagaaaatattattccaatcacactatcattagtcagatgagtattacagcttttcctttgagactgtgttgacagtggtagtgggagcagcagcaacatccaatttccagctaactgcagtgatgatagtgccatttggaaggactggcattatccaatgccagaggaactgtggtgcaagctttagcacccagggatctgtgatggatgtgatctgactgcctgtccttgtttctacccatgctccaagcctgctgctccactcttctcagggatgctgtgagctttctcgtatctttacaatagattatgtttatgtatccttttcagggaggcctttcctgatgattccgcataaatagcaccccttagcactccctgttgctatcacccgaatctaacgcgaggggctttgaaatttgagaggctgaaatgtgtcttctggaatatggggaacagtgtttgacctaccttcggaaacgttaaacgtgagggttggtactatcagctgagttagcaaggaataaggaaaggagggctgaggccagcatttaggactaaagtgagcaactgcaggcacattccaaggatgcgataagtgcttcttttggactagatgtggaccactaacacagaggagctggtggagggtcatgttaggttctatacatgagggtcacttgatgtgtaatgaaatctcagcagaaggatgctggaggtggaaggggaagccagagagatatgcattgcttgcatcctatatttttaatttaatgttacgtgatgaagtctctgaagaattcaagaaaatttttataaaagaaagtgtttgacatctgctaaattcaaagaagtcatcatactaaagaataagagcttgctggccttttcttatttctattgcttctttcccttccccagccacattcaatctgcttggattagcaaaaatagaggaggaggagtagaagcaggcaggcaaggagagaacaaccatcccctccaccttcacgccgcagacaacctcaacagggtcaagggaaaagggtttaactatatatcaaattaatgtgattattatatggaaccggacattctgctttctaaattggaactacatcaatgtcttaggcgattgtagaacttctcctaacaacaacattttcctacttattggccaggtttatatctaggtaaaagaatagtgggcatttaaaaataactgatttgaacaagcaggactcatggaaataatcataaaagcaacatgctttttccttccgctattcttttaagactattccctatgtctcttgcttgctcaactgccagttacttttaaacgtctggggatgttaagcaatgagccaggtgatatgttcttcctcactctggttatttccctcttttctgtaattcatctttatttcaacaatcattgtggtcattttgctctgatttctcccatcagatgaaaacacacactaaaaatggaatactcttaaatattttattcattgataaaactcttgccttctagagtaattaccacttcaaagaaatcctcaagaagacaactttagtaacaagaaacttcaccaatcatggaatttctagcaaaagagagagggcattttatatgtagcattttttttggcagtgctcaaaaaatactgtgtagaaaattccatatatgatttggtcaaattggacactcaatatttgtttaaagaataaattgatacataaattgcccttatacaaacttattaaaatgatgtgatatggtttggtttgtccccactcaaatgtcatcttgaattgtagttctcataatggccgcatgttgtgggaaggacacagtgggagttaattgaaacatgggagcagttaccttcatgctgttctcgtgatagtgagtgagttctcatgagaactgatggttttataaggggctttcccccctttgctcagcagttctcctgcctgccgccttgtgaaaaaggtgccttgcttcccttttgccttctgccatgattgtaaatttcctgaggtctccccagctatgctgtacctcttccctttataaattacctagtctctgatatgtctttattagcagcatgagaacagactaatacatgattaatgtcttctgaaaaaatacacttatgatacaaaagaaataatatgctgtgaaagagagtactgatatcctctgcttcagtatgaatatcaaacacagtagaacttatttcagcatgcccttggatctggatgcttaatcagatcaagtaccctgaaacacaattctgccattaggcaataagatatattcctctttctaacaaataattttcatactccatagtgtgttttataaacatgacactctgtatttgatttttaaaattgttacattttttaaaacacacagataatatatcaatgaatacaagttagaaagaatgggtagaaaaagggaaaatatgtctaaccacaccatgttaatgaggtttcctattagtagtatcttaatatgttttttttaatttctttttttttttattattatactttaagttctagggtacatgtgcacaatgtgcaggtttgttacatatgcatacatgtgccatgttggtgtgctgcacctgttaactcgtcatttacattaggtatatctcctaatgctatccctcccccctccccccacccctttgtagagacatggatgaagctggaaaccatcactctgagcaaactattgcaaggacagaaaatcaaacactgcatggtctcactcataggtgggaactgaacaatgagaacacttgggcacagggcggggaacatcacacaccggggcttaatatgtttttatgtaatactgcctttaataaagttgcatcgaatcccttttgagcagaagttggtattgtttaaatgtccacttcatttttcaattattcagtctataatatgtatgtataggaaatgtgcctgattaccaagtcagcagtggtgaaaatcatactgttaggccttcctgaggaggtagcatgtgaggtaaaatcggtaagatgtagaaatccatactttgctgatttactattacttagatttttctccttaatatttgacattttaacacttttggtatctaatgtgcatttttcctaacaattctagaattgtatgttacagaagacagatgattgagaggaatatttcacatctcttgttctcttttttaaaaattctacaattaagacagagtctaattggatttcctttatgaaaccactgtctcagagctcttaactgtcttcttaaaaactgcttttgtgaaagcaattttatcaaagtggcatataaaacctttactaatcctatagttttggaaaagatatttggatatattaacacagtagtcgggggaaaaatagtgaattcctactcaacagagaaacagcagctctaccaagatacttccttaagaataaccaaaactgtctactcccactactttagtgttcactgtgactccaagagaggggaacaggagtgaaagaagcccattgcggaacctgctcactcagactggttttctcactgctgctgaaaaggccaagctgggttgcatacttgagagaacttaatggtcagtcatggcattgaaacagacacatgcttaatcactttttcatgctccagtaagtaaattgttcatggacagataacaccatttaatctctgataccacttcatggaaaaacgatactaccagccacagggaaagagaattttaaaaataatcataagtggggttaaaaagtttaaagccagctgactgaatatctggctttgagtttagcattaactttcagatagaaatgagtatctgagtaaaagtttacccttttagaagcaagagctactaaaaggtggatagacagaatactaaaagtctttgtccatgtgtgaaatttcacaagatgagataaactgccagtccagctttttctataaccacaagggggacaccttctgtagacagaaaaaaaaaaaaaagactgaaacaaaagtaaaggattttaatgaataatcctcctctcccctcctgctagctcaccaaggaagctagtgaaagactataaatgacagggaattaccgtgccatagaatttgggagattcaggcccattcgtattctctcatcttatttcacagatgtgcaggcagaccctcttgaaacatgattcccaagctacccactttctagtttgtgtgtgtgtgtgtgtgtgtgcacgcatgtgtgtattttaagcccatttagcacgtggagaaaatgaacatgttcccttttaactgttaaaagggaagtctcatatgacagtgtgcttttgagcaaaaccaactccatgtgtgtttaagtgaccaaagagttggggggagaaaaagaaaaacagacatttttgtactaagccacgaatctcctaattcttcccacctgaaatcgtcttggattttaaaggttatttaaattcacatgagttctttctttgtgccgtgttaatattatatgcaatttgatttctttgcttgtctgagatttttcaggactgtgtttatgtcttataattcttaatatctttattgaaatagttcagtaggagtgaagagagcatatgaaatgctctgtgactgatgtccatcttcagagagagagacttacactgctacatgaaactacatacctgggacagaggaaattatgttggatttggaagtagaatatctgtttcagagtcccacaagataatcctaactatagcaacaatcatactctaacgataagaactgtcattgattgagtgcttattctgtgtcgggaacagcattaactactttaccaacattctgtcatgtaactgttgcatcaacccaaggaggctgtctgagtttctgttttacagatagcacagtgaagcttacagaacaagagaaacctgcctaaggtgacacatcgctagcaatttataagagaaacataattaataatcaagtctgtctgctccatttcacaatctgtaaaacaaaggtataatctacctcaaattttgccaggcttaaatgggattacacgagccccgtaaaccaaaaagcatacgtgcaaacacatgtattaaggtgaacatgccatatagacgaggtacaatatcaaaaatagactccacacaaagcagggtgcaaggcagaaaaaagagaaaggaacttttcttcccatggtcacggtctgtgccttttcacccaccgaaaagtctgttctcacttttctgacattcaatgttactcactagagataccaacgcagttcttcccagctggtgtaacgggactgtgacatactattagaaggggagtagagtagagtttcactttcactttgggattagaacactttagttggagaaggagagaagatagcagaaagcttgaagacaaaagaacaggcccactcagctctctcccttgatagagatttggtacttaaccttgaggcttcagctccatcgagaaccattaagtggcttcttgaccacattccctggggttagtctctgagcatgggaaaggatcagaaggtttgctgccacaggaacaatccccaaactttagccaataaaacacttttctaaatccccccaagccaaaacagtgtccccttattaagaagccattagtcagattttacaacctgatatgaagacaggcagcccccttacattcacttgatgatacactgctaacatttttacattgtgtcactaaatctgtgttaaacaagcaccaaaaactatcttttccctctccgatcaaaaaacactcctgacaatttcaatgacattaagcatatgtaagattttcttccaccatgaaactagtgaaattgcgtggatatcttacttattttcaaggaagctatgcatcatctaaacatcaatcatttggaatatacaatcacgtatttataagggcagatacaatgtacttgactttgaagcatgtcactcattaaaaagcatggcaagataagtttcttgttactgttttaacttttgatttttgatgtggattttaaacagacactttagtatttcaaaaggaaataagcacagaataattttgtcatatagctttcagatcacttagtcctcatttcacaggctataattgtttctccaacttttccactaatatatggaatgcataaactatgtttgtttgtataagtataaatatattaacttaagactgataagaacccagtatttcaataagtttcgaggaaacaaaagtgagtgtcctttaggtactaaatgaatcttatatacatttaaaattttacatatatgctgaagacacaaagttgactataacatcataatgtttttagatgatttgtggggatgggtaggagtagtggattcacaactatctatttggataaccaggggtgtccaagaataaaactcaaaatgaaagacttctaacgtcaacttggcaaatatattgaacacaaggtattaataacactagtgaaaagaatcaaaaattataaagtgcagtgaagttttataatgactgaaatccagttggaacatacgggaaaagatgctgattatattatagagaatcatatgcatcgtactgagatacaaaataaaaagatccgcaaatcaggaataatgaagaattgacaagcaatattttctgaaatctcaacttaaaaacccggccattcactataccttctatggaatttatattcctttaacgtaagaatgttaaaaccaacacgaaagtgtctctctctctataaaaaggccaatatttgaaaacattacttgtttctctcctacatctacaatttaacagttgtgaaagccttaggaagtcatctaattcaagctcttattttatagtcaaagaagcttaggtttgtagttctccttgaaaaggtccttcacgtcccttgtaagttggattcctaggtattttattctctttgaagcaattgtgaatgggagttcactcatgatttggttctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacagtttgacttcctcttttcctaattgaataccctttatttccttctcctgcctaattgccctggccagaacttccaacactatgttgaataggagtggtgagagaaggcatccctgtcttgtgccagttttcaaagggaatgcttccagtttttgcctattcagtatgatattggctgtgggtttgcaatagatagctcttactgagatacgtcccatcaatacctaatttattgagagtttttagcatgaagagttgttgaattttgtcaaaggccttttctgcatctattgagagaaccatgtggtttttgtctttggttctgtttatatgctggattacatttattgatttgcatatattgaaccagccttgcatcccagaccactgctcagtgaaataaaagaggatacaaacaaatggaagaacattccatgctcatgggtaggaagaatcaatatcatgaaaatggccatactgccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctgcaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctattttataaatcgtgctgggaaaactggctagccatatctagaaagctgaaactggatcccttcctgacaccttatacaaaaattaactcaagatggattaaagacttaaatgttagacctaaaaccataaaaaccctagaagaaaacctaggcattaccattcaggacataggcacgggcaagaacttcatgtcaaaaacaccaaaagcaatggcaacaaaagccaaaattgacaaatgggatctaattaaactaaagagcttctgcacagcaaaagaaactaccatcagagtgaacaggcaacctacaaaattggagaaaattttcgcaacctactcatctgacaaagggctaatatccagaatctacaatgaactcaaacaaatttacaagaaaaaaacaaacaacccaatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaagatgtggagaaataggaacacttttacactcttggtgggactgtaaactagttcaaccattgtggaagtcagtgtggccattcctcagggatctagaactagaaataccatttggtccagccatcccattactgggtatatacccaaaggactataaatcatgctgctataaagacacatgaacactcatgtttattgtggcactattcacaatagcaaagacttggaaccaatccaaatgtccaacaataatagactgaattaagaaaatgtggcacataaacaccatggaatactatgcagctgtaaaaaatgatgagttcctgtccttcgtagggacatggatggaattggaaatcatcattctcagtaaactattggaagaacaaaaaaccaaacaccgcatattctcactcataggtgggaattgaacaatgagaacacatggacacaggaaggggaacatcactctctggggactgttgtggggtgggggggaggggggagggatagctttaggagatatacctagtgctaaatgacgagttagtgtgtgcagcacaccagcatggcacacttatacatatgtaactaacctgcacattgtgcacatgtaccctaaaacttaaagtataataaaataaaataaaataaaataaaatttaaaaaaaaagaagcttaggttcagaaagtgtaaataaatttacaaagatcacaaaacttgggagttgggaaaccaagcctaaaccacacttctccctctattacaatccggaaatctttcctcagtattttttttttttttttttttccacgacagagtcttgctctgtttcccaggctggagtgcagtggcacgatctcaactcactgcaacctctgcctcccagattcaagcaattctcctgcctcagcctcctgagtagctgggattagaggcgtgtgccaccatctatgtctattgacaaccagtcagtagctatgttccatctttgtaatgggttttcctctttctttttctctccccaacattcctttcctttcctctcctctcctcttttttcctttccttccttcctttttatcttttcttctttcattctccttcacttgacatcatttccttcttcaaatattaatacaacttggataaacttttttttttccttatctacctgaaagtgtgtgctttctctcctttacaggcctctgcaatcactacaataaaatatttgaatcatttgacctgcattttgtaataataataataatcataataataaactctgacaggtctggctgtcccacttccatgtggtgactcccctatcactcttgtaattgctttcagctacctggacattattttctcctcaatccaatagcttttaagaaaaccctgtttagtgcaatcattaaaaataaactctggcttccaaagaggaaacacaaacatgagagattgctcttgagattaaataaatgataaacatttaaaaccaaatggtgtatatgtgccacattttcttaatccagtctatcattgttggacatttgggttggttccaagtctttgctattgtgagtagtgccgcaataaacatacgtgtgcatgtgtctttatagcaggatgatttatattcctttgggtatatacccagtaatgggatggctggttcaaatggtatttctagttctagatccctgaggaatggtcacacacatatacatatgtaacaaacctgcacgttgtgtacatgtaccctagaacttaaagtataatatatatatatatatatatatatatatatatatatatatatatccaaatggaagctagatattgttttgttccattttttcttttgctcatgctcagaaatatttatatcattcattaatggatgtaatttctgtcagctattggcagagctggcatttgaagcaagtgcttctacctgttggatgatcttagttatatttctaaggaactgaggaacaacactttatcatgtaccgtgtttatatgctttctcatctactctcttatttgcccctataaccctaaacctagtgatatttttattattatcataaatttacaaatgaaaaaactgaagcaaagattgaagtaaaaaaaatcatgcttctgggaggtaaggtttggtacccaaaaaaatcatactgctgggaggtgaggtttggtactgggtttgtcaactttgtagtctgtgtacttttaacataagccctacaggtaaataaaagttaaaagatgtctcagttgatgcatgatttcttgtgttcatgataacaaaaatcattatgaatatatgattatctgagtcacaagacatcatggaatgagtgtagattttagtgtcaggggatacatttaaattctggctattttgcttataatgtagtaggtcaacaaatggagtcatactaattattgttgttattaatctctctatgcctgaaagcaaaagtgttttatgaggaaagtgtataccatattaaaaatgtaggaggaaagcgaaggatccgagttcaggacaaactcttagagtgtttttttcttcttcttcaattatgcctccttatgttttcatcagatgagaatgactaggacaatttaagtaaaattgataaggaatatcagggaaaaatgtgtgtaggagcaagtcacagatgtatctgttggtgagttaaaaatcaacacgaacaatgagaacttcgtgacaaaatctaccaatctattatcttgcacaactgttgatagtgaactttataataagaggtcattccagtggttataaagcccagtctcctcattctacaggaaaaacagaggtatggagaagatcaatgactgaatttacatgtcttgtgacaggattggaacttgtagccaggactcaggattctgagtactgtagttttgcttgcagtctccaggcactgaaagtgacccccatttaaagaattaccttctttattgataggattaggcttcgtcataaagaactgtcaatgattcagttggtagatgccagaaattatgtgattctcaggcaacaaaaaattatctatctgtctatcaatcatttatctatcggtctaatctatttagataaataaaacagactcattcaggggctccatttgaagtgttctttggaaaactctttcagcagttatgaggtgcccactcattatcattgcctgctcactgtcaggaaacattttgactctaataaatgcaagaatacaaagcccaaatcaaacttcagatgccatctgagcatatgactctggtacctttgggatgttcacactgctctaaataaacagattacttggctagatttacttggcatgtctgcccgtgcacactggaaaactgggacaagtttccagatccaaatgggtggaggaatcaagcagtgcctgaggttatctgattaaaattcatttggaaaagtattattcaaaaggatttcagaactatctgaaaagacagcatggctgtatggcacgtatttcaaacagttggatcaagatctgaataatgttgctaaaaatgctaatggaagcttctcagtggcaccatgtgtggattttgcccttgataaccagataaaccagagcttgacttttaaaaggttattctgaggatatttgtgcatattagaagatgaaatcattacaagcagggtattcaattaaaagagaaagatccgaattactttctcgtctgtgaatgtcccctcactttgagcctggtaaaattgacagtttttgagattgatgagtttgtatagtccttacaataaatagactgcatattttgcagttactcacccacagcctacatatccttcaaaatgtgcatgagtaatgttaaaaaatctgtttagatgatttccaatttcatcattctcagtaaactaccgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtacaataaaaaaaaaatctgtttagaatttagtagtcaggtggactttagaatgcaaagaaaaaataggattattaaaattagtttaacagcatggagttaaataaagaagggaaagacctcctgcttggggcatgtgaaatacaaaagaaaaaattaacttctaagcatccattttcttctagtttctcatccaatgagattattttgacttattagctttggtattcaataaagatttatcaagcatacccactgtgtgtcagacactgtgtcaagtcctgagtatatcaagataagtaagattgatatacaccctcaaggcacttagagtctaatgaggagatagaaaaatacatgttgacaatattaagtaccattacagagatatccacagggggcagtgggagcagaaagggaaaatataaatcagtattgggtaagggggagttgagcctcacagaaagaatggttctttaaagctctattgagggttcatcaagtgaaaaaggagggaaaaaagcactcaagaaagaaggtattaaatatgttaggaaatggagatctgagccactctgactagttcagtgaatcataagtagtttggaataactgggacaaagggtgcttatggggagacagtgagagacaaacttagggctactagcaattgataataactggcagaactacaatttcaagggtctttggtattaagttaatgaatttgaattttatcctgagagttatagggatttattgaaagatttttacctgtgggtgtgcttgataaaacttgtgttttagcaaatcactttggcaacaacgtggggaatagtagggagcagccagggtggaggtaggatatctcttagcatgctattgcaataacttatgtaatataagaggcagatggtaatggatatgagagacattcaggaggtatgaactattggattttgggactgatttggtgtgttgtggacacttaagtaaaaaaggggatctaagctgattttcagtttacagttaaccaaagagttagataaatcagaaaggtcagtcaggtggatagtaaagatgatcagtttaaatcacaacatgttaaatttgagtctttagactccgcagaaatgggctgaatagacagttgcatatattggttggacggtgaacaataaacattaataaagtgaaactaaagtcaaatataaacatgatggtaaaacagtacctggctgctccaaatttgttcagacattttgcaaaagtaaattatatgccaatgtattaaagctttttaaaagagaacattgaaccaatcagtagtctttaagggactctagaggttgaaataggaaccacaagattgcaagtataatttcaatgttcaaattaaagtcattctaacttcataagctttagggatctaaaacctatcagacagataaatgctgttggtttctgaccttcactgggatttttaacataactacataaaattacttaaggccaaatagagaaatatggactgaacaatacaatttaatgtaatccttcctaacaactgtgctcaaaaattgccaactctagatgaatagtgagtgggtgatgtgctgcaaggctctgtccttggttttgtccaaatactttgtcaaactattggatgaagatataaaatccattttcactacattttcaatggatatcaaagttgaagactgaaagcaggctagatgacatttagaatccataaaaatcttaatagaggaaatttaataggggtggatctgaagatcctgcacctgagctctcagaattacctaaaaactatttcttggctgagttggggctgtcaactcgctcaacatacaaactaaattaataataaaatagaaataagagcacattcaaagaaaaaccttcaggcactgatataagccagaatccagttacatgataagagaatagactaaagaaactggagccacagagaaaattcgagagaaacacaaataattgttgatctgtggagacttcaaagagtgtcacatggaagaagaatcatgttatatataatcgtaaggactggaactagtggtatcggacaaaaagaagatacttttttcagttcatctctgtgctgcgtttgctcacagtggagtagaggataacattgactttagagtcagacttttctagctctactgtaattagctgtgtaaccttggacagatttctttagcatttttctgtctcattttcctcatctaaaaatgaggatgataataggatccagctcataaggttattgttaggatttagtgagttaatataggtaaatcactgagaaaagtgtctggcacataggaattgcttttgtgccaacttccactgttaccaggagcaaaaggtgagttgttccccaaggaacaagagaattagagagatattcttcaagaagcttttaaaaaagtattggtcatttgtaagccagggtctgtgagttggtgacagttcccaactgtcctagaggctgtctgcccacacacttcccatcagagtttatggggggagccaactgcaggcaacagtgttcatcccaggacctaggacaatcttctggttggttatcggaccagctcaggcactcctgtcattgccaaactcatcttctagtcttcatactttaattttccatacatgtctctgacttctgtgtcaataaccgagtcagaatctgtttttctggaacacagtctttgcctctcatcccaagtccttgctggaggataagggcagtgaagcaataagcctttatttaaaatattctcgggtataaactgaagtccatggagccacaagcacaaagcaaatatttgatgttttatagaaagtgggaaaaggcttctttctatctcgagatcagaacaaccttgagattttactagcagctacattagtgtgttgttgtttctagactgtggtttgtgtacacatgtaacaattcatcatcttgtacacattaaatatataccatctttattggccaactttttaaaaaacaaacaaacaaacaaacaacaacaacaaaacccccaggatttggagtatctcatacttctgagttacctacccagcaatctaattaaaatttctgggtcagatctttgaatcatgttcatcatcctttccactctatctatggaccatacctttctcatattgagttccactcatattgtgtttcattgtttcttaaaacaatgaaatccatggacaaatggccttgagaaacactgcattactataaccgtggcttcaatattcccaagacagattaacttattaaaagccccaataattcctccagaataaattcccctagagtaaatttatctgagtttaacccgtagttgctagtttgttcattcataaagttatttttagcctgtggtccatcaatatcttataaatctaatatttggggaaaaaatggaactattaattttagcagccattatttgaactaagtattcatttattcttgaaaagaggcttttaattagggaaaacatatgtctccattttcttgggacattcccagttcattgatgttgatccagtgtcattattaatagctccctctttctctctgaaaaatataattgttctgataatcaattacatagacactgaacctataaggtaaggtattatcatctgactttttttttttttttttttttttttttttggcttttgcctctctagtgtctatcctgcctactgcagccaggaagaacttttacaaaggtaaactagatcatttatttctcagctcataatcctccagtggcttctaggaccctcagccaaatctatagctctcaaagacctagtgatttagctgctggctatatctctgatgtaatgttcgaaaaactctcctacctgttctcacggggctgcttactgtccctaaacatatcaagttgttcctacttcaaggcctttcctttgctgcatttttctgtctggaaatctccccggttattcacatgacttgtttccttacttcattgagttttctgctcaaattttatttcctgtgatcaccttatctaaaactgctttcttttctctatccttctctatctctttatccttctttactttgtatttgttttctgtattgtttgagttatatatcaaacaccccagtgacattaacaccctggaaacttcattaagttgtatttatgtactctttgtaaaacatttctgctattttcagttcttcaagtaaattagcaaaatagttaggaaataattgcatacatttgctcactttaaaagactgacattttaaataatgttgtcaagtttcatttatctcccttatttctggatattttgattcacaagcactctcttttgacctgtatgcttcttttgatgaatatggatgcaatctacctttctttgggaaatgtatctgtaactaaatcagtaacttagaggaaaggagctttctagaaatcacccagtacattctcctggtcggatagggaaatatactaaggaagataaatgtttctttcatgtacttcaatgtgtggatggacatctattttggtttgtgcttcatcatgtccttttgggagttgccccttgcccacgtagtagggatctcaatccaaggcctcatctcatttgccacttatgtgggacctgacaaaagctttacaacaagaatatgtcatctccctgtggatgcagagtgtcccaggtctcagattatcttataaccagggaatcaaagtgtcaaaggaacttttctttctatctctctactcagatgtactctgcaccctcaatcaagatcttaccatgaagcatcaaagactgttttcatcatctctagacgtcttaacatcatcctcacaagaatttaaatctccccttgcccagcatccatagcaatcctccaacaggattctgatatgttccatttggttctttctaggccaatggatatagacagaaaagcaaacaaagtgaatataatcctagaaatggatctaaatactattgaacttatagtcactacaaaactttctttagaaaaatttgtactcattgctacatggtttattttcccaatttagcttccctttcctcatgtcattcatctaacccactgaagaaggcacaatcatttagccagacttccatcttccctctcaggtttgcggactatggtctggttttcaacctctgcaattttcttttctttagattctcaaatttcattaataaattatttgagggtaagggctgtgtcttagtcatcattttgtacaccaaaatatagtgtttgaaagatagtagatgtgcaataaatgcttgttgagtgactaataataactaatatttattgagtaattactaggtgacaaaaactaaacatatactttatctcattggttcttacaataagaatataattgcattttaaaaatatttttattcctttagtacagttgtgaagatttattagagcattcaaatactttcatgtgactttgaataataaacacattactcagattaagtaaagaatactcatttattcacttaattattcatcaaacattaattatctactttgggtcaggaaatagcagtccatatgcaatataaggaagatgtcacagatctggtcacattcctggttagaacccttacctcctactctccagccactgatttcagaacaaagttccaacttattagcaatatacaggattctcatcatcgcctcttcaatcttattcctgactatctcatacctaaaagctcgagcaatagcaaaaccctaatagagattaggctagtggttatccttgaggggaaaatggtctggaaagagggataaaggggccttctgaagtactgagaatggttctgtttcttgatctatttgatgggtatatgggtcaattccatttatgaaaattccttgagctgcataatcacatgtttctgtaggtatgatatacctcaataaagagtaaacaaaagaaaacaacaaagcaccttttgtaataatgaactatttctagtttcccatccataatttgtcttaattttcccttttctctagactttgcatatgctgctccctcaacccacatctctactggtctgtgccattaactctgtctcatagttctcaccgagctgctttgcaacggcctgtttttgcatactctaagttcttcagaaccatgtctccagctactaaatgaacttggtatagtgagatagtcacacaattacactggtgtactttttattcaacatagtgctagaagtcctatctagagcaatcagacaacagaaggatataaagggcatccatatttgacaggaaggagtcaaactgtccttgtttgccgatgatacaatctggttttggaaaaaccaaaagactccacatgaaagctattcaactgataaacaaatttagtaaagttgcaagacacaaaatcaacacacagaatttagtagcatttccatatgccaacagtgaaacaatataaaaaagaaataaaaagtaatcccatttatattagccacacataaaattaaatacctaggaattaacttaaccaaagaagtgaaagattactacaatgaaaacgataaaacattgatgaaaggaattgaagaggacaacaaaaaatggaaaattaatccataatcatggattggaagaaccaatattgttaaaatatctgtattacccaaagcaatctatagagtcaatgcaattcctatcaaaatgccgatgacattcttcactgaaatagaaaaaatagtcctaaaatttatgtgagactacaaaagacccagaatagctgaagctatcctaagcaaaagaacaaaactggaggaatcacattacctggcttcaaattataatgcagagctagagtaaataaaacagcaggttactggcataaaaacagacacatagaccaatggaacagaatagagaacccagaaacaaatccacacacctatagatagtgaactcagttttacaaagttgccaagaacatacactgggaaaaagacagtctcttcagtaaataggcctaggaaaactgaatatccatatgtagaagaatgaaactggacctctgtctctcgctaaatacaacaatcaaataaaaatggattagagacttaaatctaagacctcaaaccatgaaactactacaagaaaaccttgaagaacatctccagcacattggtctgggcaaagatttcttgagcaataccccacaagcacaggcaaccaaagcaaaaatggataaatgggatcacatcaatttaaaaagcttctgtacagcaaataatacaatcaacaaagtgaagaggcaacacacagaatgagagaaaaatatttgcaaattacccatctgacaaggaattaataaccagaatatataaggagctcaaacaactctatgagatacattctaataatcagatttttaaaaatggcagcagatttgaatagacagttctcaaaagaagacatacaaatggtaaacaagcatatgaaaatgtgctcaacaccactgatcatcagagaaatgcaaatcaaaactaaatgtgatatctcaccccaggtaaaatggcttttacacaacagacaggcaataacaaatgctggtgaggatgtggtgtaaaggaaccctttgtacactcttggtgggaatgtaaattagtacaaccactatggagaacagtttggaggttcctcaaaaactaagaattgagctacatttaatccagtaattccactgctggttatataccctgcaaaaaaggatatcaatatatggaagtgatatctgtactcctatgtttgttgcagcactgcttataatacctaagatttggaagctccctaagcatctatcaacaaatgaatggataaagaaaatgtggcacatatacacaatggtgtactatttagttctgatgtttctaaacatcaaaagaattgaactcatggacatagagaatagaaggatggttaccagaggctggcaagggtagttaggggatgtggggaaggctaatgggtacaaaaatagttagaaagaatgaataagatctactatttgctagcacatcagggtgactgtagtcaataacaatttaattgtacattttaaagtattgtaaagagtctaatgggattgtttataactcaaaggatagatgcttgaggcgatggatatcccattccccatgatgtgcttatttcacattgcatgcctgtatccaaacatctcatgtaccccataaatatatatactatgtacccacaaaacatttttaaaaattactaaaatagaaaaaaataaaaaagtcacattggtggaaaatgctcatagagctcaattctaggtgctacggaaacacaataaatgtgtgcatgcatacacacctacaaatactcaaacatctatagtaggctgaatataagtcaaaggggagcagttgatttgtgcaattgtcactccccaacaaaaacaacaataacaatattcagaagacttatctgtacttttagaatcactatgcatacatatttggagtactggtgttaaagatgtcaacggagcttaaataggcattctgtaagttaggcatcccactcttttcacatgtagacttgttaaatcacttgtcccagatgttaaaaccataggtccatgtcaaattaattcccttagataaatgactaatcttgagttagcctaatttcagtactgagaggttagggagcacaccaaatcaattactctttgtctggtttctaaaccatcgttgaacataacaagcttgcgctcagattaccttctgcagaatttctcagagctagtcatgtgttagtgtgccttctggcacctgagatggagacacattttatgcaatatttcatagatcctttttttttttttttttgaccatggaaagctttacttcaccaaagatatgaaaagacaattcttttccaaccaaattttgaaaactgtgatttagaagtttacaacgttggtgaatttttggaggtctgtttctcacctgtttaatgaatatttactgtatctttcctcaaaaagtagatacaattatccagtaatttgggcatggtaacccaaatggattattgagaagaaaaaacaagttttgggggcatatactttttagaatggttatctatttagtctgtgttccccaaaagagcatggacttttaccttggctcagggacacatttgttgaacataagctaaattcataaatgttatgtaaatttagtttctttataacaaaactttgggatttggtttttagcatattgggttcttattttgtcttccaaatctttacattcctcaggaaggtataattgtataaattactctagtttattgttgacatggttgttgataattttaaaaaatgtaatctatcagggtctatagatttatgggacctgaaggaattcaattttgtgtttaaatctctaatctcattagttgtttttcctttcccctgcctgtagtagggcagtagatatttatctttttaagcaaaagaatatttaaatattaatgatagcaaaatcatctctgggaaaatgatataataagtgttcttaaatgtgtggtagagtgaaaatagggttagaaggtggacatgacctctattcctccgcacatgtctggtagaatgtgaggaagaaagaggtaagctttcatttcattcccttttacaaaagtacaactgagcaatttccctacaccttatatgtaaaattattgctttataacttttacaaaactaaatgcacaactcacaaaattggtaaaaattgtatgttgaatttccaaaggtcatatgctcataagcaaatgtaagttaattgtcgagtggatttcttattgttcattttagattaatgaatgtaaaattaaatgaaatttagcacgtatgggtgataggtccctcaatataatactaactttcctttaaatgattcttatctcattttccaatcgtctttacttacataatgttgcagagtgaagggaagggtgttaaacatttcaacatacgttgatcgaaacatgattaatatgataggcagggagactacaaggatgaaatatggccacaaaataataatttaactctgacattcaaaaaatgtctactcaacactttggaaatgttagttcataaagagcatttaatgttattttttatagagttggtattcacaaaaactttttcaagtgattatttattaaactaagtggactgtaatctgagaataataatattattttgctcttactccttgccataacactactgaatatctttcacacattaattttattatttgctttcatttttaaaaggcacggaaatgactgtggagcagtgtagaacagagcttaaatgcagccttcaaatcctacttcctctttttactagttgtgtgatcttaggcatattatttaacttttctgtgtgtcagtgtttccatctgtaaaatgggtgactatctcatagggctaattgtcagaattaataaattaatacctgtaatttgcttagaagtgtgcttggaaaatagtaaaaccttcatacatatcaagatagtttttaggtgacttgcccagcatggcagaaagtaacatagttgggatttgaacatagatttgtctgaatctagaactcaggattttaactgcaacaacaaaaatagtttttatttcatagaatgtattttatctatataagtgaagcaataaaagtagtaaagatttaaaagtagtttgttagaattgtgtttctttgcattaaattcaacaatagcttgcaattggcaatggttcttagaatcatttcatatataattgcactttgtctctcagaaggcaagctgctgggcagattaaggaactagagttctaatgattattgtgtattattatttattggaatctaacacattgctcagaatagagtacatattcaatggagtcttctttctcatttgcctaaaacacctggttcagaaaatgattcaagacatttcctcgtcctcatcatttctgttaaggtatgatttcatttttaaaagtttaggaagttctcgacacttcctagaaaggtaaaagtaaaaaaaaaaaaaatctaaaaaaaagattttccttttttagaataaatttgccaatgttttagaaaattgttgctatccaaaattaactaacatgctctttcaatatgtctgtttgatgattttctaaaacaatataaaatttcatttagtatctgtagttaagaaccataatgtcacatatatatattttatagctttcaataattgtgggtagcattcacatggattcaagctaaggactatgatagatatcaaatagacacatatcaatcctttattatagagaaaacttccttttaaacatgctgaaacttttaaaataaggattctgttagcaaagaatatgccgtcgataaaacttccaaagaaattatcctgggagaaagtacatttttttcctaatcttcagctgtggttttgttaactcctcttctgaaataaattagactggcaaccacttttctttaattgcataaaggaaatgattcttaatcttggtttcacattagaacttcatgggatggacttaaattacccttgtctggaccccactaacatttaattcctcaggggtacaatgtgggcatcacctaccctacgtgattttcatgtgcaatcagagttgataaccacggctcatatcagggaaataaatcaatgggataagggaggccattttctcctcaacagtaccaagtgcctcttgaatttgtttcccttgtattacttcacagaccttaaaactacattgaaaattctctggcatacaattttcttccaataccttgtcatgagacttgaaaacgtcatgtaactttaagataaaaaattgaaagcggttcttcataggcagatcatgtctgatcagaataccaggtgaactggatcctaggaaaccttcaccttccaatgattgaaggtggagaaatcctatagcctttctggctttcagattccttaccagcacctttgcctagtctcaggccttttgtgtcatttttaacgttcttaaaatctttactattctgtcagggaccactcagtgtctcccagcttttaatcacctgatcaaggggatttggaattttttttttttttttttttttttttaagaattgccaatgatatcttttcccttgaaacataatgaccttttctgtgggccaaaattttccaggcttctggaagtgtacattcctactcttactttcatacaaactctctcccaacattcagaaatactcttccccatcgaatcctctaaaaagtgcttcctcctcttgttattgtcacaccatagaccaggcccacagctatccagacaggtctcatgatgtagacagaagcctccaacctgtgctccatgctatttggaattatttcaaattttttcatcatacttaaccaccatgaatttgcttcatacctcagctaactataacaagatcattaacagccttttttttgttttttttccggtgcagtctcactctgtcgtccaggctggagtgcagtggcatgatctcggctcaaagcaatctctgcctcccagcaatctccgcctcccaggttcaagcgattctcctgcctcagcctcccgagtagctgggattacaggcatgcaccgccacacctggctaatttttgtatttttagtagagaccgggtttcactatgttggccaggagggtctcgatctcttgacctcatggtctgccctcctcagcctcccaaagtgctgggattacaggcgtgagccaccgtgcccggccgccattttgtttatttatttattatttttttacgtaagactgccaacaccttcaattttcctctcaaaatatgatttctttaagattttctagatgtatagtcatcactaaatgcttaagaagtcatgaaataaaagggcaagtagcttgactgtcatgaattttcttccacaaatgttgacatagtatatacaaaattagcagtaagtcattgtctattacttatattatgcttcttggattagttttcaagagaaaaaacaggagcagacatttctcatgaggagtgcacacttgaaatgcacttggcagtaggcaaacgagaagatagtagctgatatcatatatgcattgcatctgttcacaaacactagtggcatcatttatgtcaaccttttacatattgaaaattgcaaagactcctgctgtgctgtttcttttgagaagccggctggtatatagtgtttaattaagtattttaaagccatcttttcgtaggcctgttccactttagcaaaagttatgacagcttgtctctgttagtttaaaaaaagaaggcatagtttattctctctctctctttctaactctctcacaaatatagaatattagtatttttaagtaaaatagcctattttagaaatatagaaatatgttattttaatgtgctctcaatgtaaataggcatataaaagaataatttgatggaaacaatcccttagtattgtaattattttaataattatagtgcactattgaaataaaaacacatttcctctttctctgccacttttttggtgtaatgggacattcagagcttgaaagaaaccaccacataagtagtcatttcatctgtatctgttaaatgaattgcttttcccagacatctaatttatccagagaacatctccttggtcagtattacaaattgtttttattttcttacacttgcttattaataattttccatgtcatgtctgtcatcagagaaggaaggtcacattcaatatttctccatttctcttttcttttttcccactcatactctagattgaaaacttagctaagtaaaaacaattggttcaaatcttatttgaattatggacacattattctcagtaaaataaatcttgagtttaaatcccattatcttgtgtaaatttttttaattcaatcttggcaaaacatgcatattttaaagatatgacctataattttttctcttgacttttgtgtttggcaggagttcacagactttgctaacaattttaacagatatgctttaatttaataactacaatttggtaattagctggagtcgcatttcaaaatgcaattgatatgatttggctggatttatctgtattctagaaaatacaggacagtcgtatagatactggtgttgttactctgttcatattcacacttttaccttgcatcattcctgagacacagaatttttgatattctgccacaatctattcccaaaacatcactgatgacaaaacgataataatctttggaaacatttcctctcaagttccaaagttttcagtcagtagaaaaaaaagaaagaagacaaaattttaaaggtgctgagaaaagcccagggctcacagctggtttcagcaacttcaacttgcgtaagaccccgtgtttgtgaaaacaacccaagaatctttgaacaggatgtaatcaacctccgaactgctgagaaatattgcaaaaatgacttcagctgccaaaaataatgtcgtttacaagcagctcttcctatgtctaaggaagaactagtcacacatgcgagtttttgctggcttgagaacaagcaaggaaaaagacaaatcccacctaccctagcctaaaatacacagtgagtctcagaaccccgcggaagctgtggctcatttctaaaggtgctggcaatatcgaggaagacttgtatccacaaaattccaaatggtaagtgacccaggacagagggattttatttggcagcaaatctgtgttgccactttccttccgttgcaaagcttccctgtcttgtggaggcagagctgttaaatacctcttagtcactagctccaacctatttttttgtttgtttgtttttcttttcaaaatattatctggcaccttcccttaaaggacatcaagggctctggaggaaatatttgcaaatgatcctttatagaagttccatcacaaaagcccggcacctacctctgtcaagctttggctgctcagtccgcatgggctggatgtgaaaaaagatcccagtatgatgccttctctaaatttaccagaaag

SEQ ID NO: 1984 - DNA, 318159 bp, Homo sapiens; identical to SEQ ID NO: 1981
  source 1..318159: mol_type = genomic DNA

SEQ ID NO: 1985 - DNA, 318159 bp, Homo sapiens; identical to SEQ ID NO: 1981
  source 1..318159: mol_type = genomic DNA

SEQ ID NO: 1986 - DNA, 98052 bp, Homo sapiens
  source 1..98052: mol_type = genomic DNA
taacatggtaaacaactcaaatggctttcttttaatgctaggaaaactgtccacctttcaacggtgacagggctgttaacacaggtaagagcaaacaaggtaaaaagtgaaagcacatacagatgatgcacacaaatatatataaaaattgaccagaaatcacaggacatgtaagcaatgttttcttaagcagaactttttttgtactttaaatagactaaaatatttggtgtaggtgggagaaagacatcagtattcaacaattttaacttgaaaaccagctgtaataaagcctcagctcattgtttaataaaaataaaaaaggaaccacatcgtacttttgacaatcatagaacgaaagctcacaaagaacacatttaatatctccatcacagtgcaccaaggatgcagccactaaggacttccagagggaaacaagaacagggtctgcatccatcatattgcattacaaagttaatgccatcagagaaaaaaaatctcacctcacgtgctcaatgttctagctggtaagcaccttatgagtatgaggctacaattgagagaaactgctcagtctgcatcaggacacccaattccttcacttgccattggctgatgcatttaatcattttaacacaacattcacggaaaaatgttaacaacacattctggcttctcgagcagaacagactgggaaatgcagtagacgccagagcatcaaaggccatgtatttcctcacaagaaaagaaatctgcaacaattggtttccttttactatgaaaaatgtaaatttcagattaagtttaaccccataaggacgcatgatttgtacttacatatacacataggttcagaagaacttagctatctagttggcctcttctctgttccattataacatcagttaccttagctggatcactaagtgtgagtctcaccaccatactggtaccttcagctattacctgtgttataaatctcatgttccattcaaagtactaaatgactggatggcacatatcccaataagtatcagaaatgttgacagccatagtgcagctgagtttagaagcaactatgacaacatagggaagtaaggataaatcacaagaacacctaaggtggtcagctccttctggtgtgcctgggacttgttttgagtttagcaaaaactttacaagattaaaaatcagagcaaatgaatttcttaagttcaagatatgtactctcaatggagaatcgcttttgggcagtggttaaggcctctgatgtgctacttatcagaaaaatccacatatatacaaaactctgctaaaagttttgtatccagggaaagtcccgcatccagggaaaccctcaatcccaggcactttagggcagctggtcaccctgagaacactacccactcgttccttaatatcactagagaaaaggtaagaactttcaagggcataacctttaagggcatcagtccccaaaatatttttacatcactagctaatggctagttcctctaagcttgctaaaaggctaggaagtccagaaataccttaaacgtgttaactttaagaagagttggtagtaatcaagcaaattagtgagcagtgtataaaagctcactcttgaaatctgttttcagacaaatcttctaaaggttcttctagctttgtccagttatatggtattttactgtattctctttttgcaattaatccagttttgtatgtcttttctttcttttttaggtgaaaatattctatgccaactgttttccacagtcctgcattatatattaaaacaaaggctgccagctggagacacagccctccgattacaaaggcccagaatgttacttttaactgtgctccaccaggaggtctggccttgggaaaagatggcgaaaggaatattctcagatatgaacattttttattctgcctacaatgctgtgatctagttcaacaactgcagaactgttctcatcttaatcgctgtagtttttctttctttactcttttgtataaaaggttagtgtcacagcttcactatcactaataaaaagatacaaatatgcctttcaagtcagggttggaaaagcaaaactgaggtgtgaggttacactggtctaagaaagtaccaatttgggttctatattttgtcaaacagttgggtttttaaaaaaattcaaaactcatgcatgttacctacttgtcatgtgtgaattatttctcacaattttaattaatctgtgtgtatattagttatataaagcaatggatttccacattcttaaagcaggaacctatattcaccagaaaaggatcctcctgtttctcatcaaattttttttcagctcgaacaatccaagattgggaatagtaagagtggcaaacaaatgttttcttagggacttactgagaaaagaaaaaacttactgggagaacagagacttagtaaaatttctattgctacagacaaatgctaaaaaccagctttataataacagcattataaaggatagaacttaatatagaaccagaaatatggcaagttacctagtgattaacattgtaaaatagtcaaaaactttaaagccacagagaaaggaaaacaattatgaaatggaaaatatataatatttaagtacttttataattctaaaacttcacttttgtccttaaatcaatatattacggatttcattgttcaataaattaccatctttaattaaaaataagtaaatcaaagagcatatttggagaaactaagagctgttaactgtttggagggtaaaagaatacttttctcgaaatttttttgaagaaaaatctaaaagccctctatgttgagttaatacaccttctgacccccatcatcagtggcattattcttccaagggactcttatatctaagcaatggtgaagttctggattcattatggatctcatggcaccaaaccaactggcactgaagttaagttaatatactccagcgagatcacctgtgggtcaaggatggcccagagaatcttggaaaatccatttatattgagcaaagatctgaatcaccttcaatcaggctgtaagatactagaaaatttgaccttgtagtagtatttcccagggtaacttaagcagcaaccttgcaccagaagaagaattaaagagggagcaatctagtattatcaacaacaacaaagttaaccctaagttagtacatcccagaatctgctggatgtataataatttagtaacggggtatatggcagagctttctttgatgttaacaaattttggctgtgattcttagttaccaagttgccaaaaaatggtatattaaatgaactgccaaatggcagattaagaaaattaatgtactccaatggtctgtccatgaaaggaaaatgtacacagacaaattaagaacattttaccaggatctgagatttaaacaatggaacaattgttttaactgttagaatgaccccaactgttaagtttgtctatgagtgtatatgtatatataaattcatacacatatattatttatttccttcttaaaaagactgaggcagttctgctatatatagttagctacaatattcaagataaaacagttcctactcaaaaaattacatgaacacacgagataagttcttatcgtaaatgctatcatgaggctatctagtatagctcatatttcctggttgtaaggctcaaaacacaggaattccactccaagagataatttgcccctcaatccctacaaagtgtagtctaaacaaacaaaatggtaataaaaaattgaaaaggaagatataaaaagaactcaatagcaggattctgactacctctggagaccacacactatcattattctgactgtcttaaatacaacaatccaatatgccccaagatggaaatctggtatcgtagggaaaacattggctgcaactgtcagaaaagttcataatcttaaacataatttatgccatttgccagtcacaaagacatttactgaacagaatttttgagccatttgtaaaattaaaatgattgatcaatttgaatagcaaccttcatgatgaagaaattaggactctaggtatgaaaagcatgttccttttttgttaataagttcaaaggagagaaacattctgatatatgcagataaaaatatggctaggctgggcgcggtggctcatgcctgtaatcccagcactttgggaagccgaggtggacagatcacgaggtcaggagatcgagaccatcctggccaacacggtgaaaccccgtctctactaaaaatacaaaaaattagccgagtgtggtggtgggcgcctgtagtcccagctacttgggaggctgaggcagaagcatggcgtgaacccgggaggcggagcttgcagtgaaccaagatcgcaccactgcactccaggttgggcaacagagcgagactccctctcaaaaaaaaaaaaaaaaaacaaaaaacaaggctaacaagaaagaggataaccagcaagtaccacctggatgtgtgttgtcaggtagaaaggaagaataaaattcaggcaatgaatataatagatttagcaaagtaaagcatatgaaaggaagaaatgtttgatatgtctaagtatcaatgccttcgatcagagtaagaaaaaagtattcattgttcatgtccacagactagatatctaaagagatacttggtgggcaggggcttgggagggaaggcgcaaattggaatgttcagcttttaaagtaaagactgtacatgaagacatattttatgtacagtgaagattgtcttgtgttactttatatcccaacataaacctacgccaccctcagacgaagagggtatctaacactgaataaatgctgaacctatttagtagttaaagaaaaaagagaaggatcttaaaggtatatatgggaagcttttaagaggtagagaaaccaactgggtatatattttcttttatttgatttcaactagcaagagactaagactgatgtttgtttgtttgttttaccttcaaagtcttagtcttaaattgacaagggcacaaaaaaagtgaaattaaaataattttaacaaaagggaaagcatttgacagtgtttaaaagacagacaaatcaagcaaaactcaatgtggcttaaggtaaaaaatacaactaggtattaaacaatttgtaaaaacttacaaagaaaatttagctttcaagaaaaattaggcagatttccttctgccaaagtgacaggtcctgaggaaaaaaaacacaacctctacaagaccaagcacagctcaagggtcagggccccgtcctagtcatctttttattattcaatatccatcacagtggctgggcaaacaacaggcatcaataaatgtttactaactgaatgtgtattataaggtataatcggtataactgatatagctcaaatctaatcatgaaagcttctttaaagtaggataaaaagagcacaatcagcggtattccagaaggtaggcctaaatccagttatatttttctaatcgttgaccagtggttataaagactttctgagcttctttttaaagcaatgaaactctttccaaaagaaaccccatgcagttcttcagtacagaataaatatgccactaagtcagtgagaactccaacagcctcccctaagccagcccccaaggtgtctctgtggaacctactggaaaaaatattactcatcttagaaatgtgatagaaagcatggccattcggttctcaggtcatcattcctagaaaattaacagtattgtgaagaataaatcctaagtaatgttgctaatttaaataaagacaaaaattcaacaaagaggggattctatcacttagaaaaatgaaaaccacacctataaatggggggaggggcagaaaacaaaaaaaaaatcaggccacagtagataaaatacaaaaaacatcatctcgttaaaaagcatcaaacacattcacacaaatgtaattacaaccaggaagtaaactgctcaacaggtataactgctcaataggtgttttcaaagagttgagtcccaatttcatactgtacagaaaaatcgcatcagaactgtagagatgcgctccactactgaaacagcatagtaggcactgcttgacctaacacagtaatgcaagagtaaccaccaagatcaggaccttctaccactttcagagttgttttctgcccctacaactgttccctaacaccattacaagttctcaagtaagaaaaagaagggcagaggctccactgagtatctcctacaggcctgatagtggtattacctaggacatttactctgctcacaagatgggtagtggaagacataattactggacagcacaaagtctggaagcaagcagcagggcactaaaacagtgagagcttacacaacaaaagcttgttaaattaagtagtactgatgtggtgcaaatgaaatttttacagcaaaggttgaggaaggagatatgttagtgagaatcacatgaagcagactatcacaaaataaggccaccttcaaaatgttatgaactgtagaaccattctgatcttcaagtttggatttgtatagaggtttctgtataaagcattaatacctaatcaggagtttcctttagtgtgaacctttttgcatttgatgctattctctttgccaggaatgcttatctcccctggctcctcacttggcttgcttctttaatgtcaggtgttagctcatgcatcctttccttagaggctttccttgatgtcctacctgaagcatcccatctgttattctccagtacagtaccctgtttatctccttcatagacaagtaagataattaagggttagtgtaactgctgtctcagcaaaggcaggaactgtagttgtcttgttcacctttacccaaagactaagaaaagttcctggtacaaacaggtgaacaataaatatttgttgaatgaataaaaaattactataccaaatttacatgaacacatacatatacacacaaatataggaaaatggggagtacccaatagaaaaccaccaaatgttgaaagtattgaaaatgatacctatagagacaggtggatatgatttcaaagaacaagtaccaaagacagcttcaaaaatatgaaaatttatgaaaagacgaccaggagtggttattttccatttctactaagatgcaaacaagaagaaatgtttaaactgcaatgagtcaacatcagacataataattatttgctgcagaatgaactagcaacagagtttcggaaatctcctctcactacagagcatgaaatattgtcaatcacaaaaccaggatcagttaagaacagctcagactgcaggtaacttataagctaaaaaacttgctaaataaatggcttttcccccaatttttaaaattctgaattcataattatgtgtagaataacaatcaatttataaactgaatacaacatactttaaaaacagatggcccatatctgctgatcctacctcagcatcacttttctaggtattttgcagaaacaattacatttacaaaaggcccatttcataatgcaatctggttactaaaccaaatcaaactactcgaagagcagaaggtctgctgttgaaatattgtaaaatacctttggaaaaacggtatttatagattagcttttttaaaaagggataaatatgtggaagtaattctagcatatccctgaaaataattatactgccacctatgcattttttatgaggtggaaggataaatcaacagactgctagattatacaagccaattattcctgttgaaatttgggcataagacaaagggactttctccatatgaattcttactgtatcccagaattaactggtgccagcagtatcaatgcaactattactggtgatgatgtcatgttatgctgttttgattatgaggacaaaaatgggaatggaaaaaagaggcttggaaaggttttcagtatggtttccttataataagatttagcagttaaaaaaaaaaacaaaaaaaaacaaaaaaccacaaaaagaatgactgtttaagccccactgaacacattaaggtcaaggatttcaaaagttaatccacttttcttcccccaagagtttatttttggtaaaaggcagaaaaattagtttttctacaggaaaatctgcttctaaataatttgaaaatcttgatatatattatatattaaaaaagacacacaaaaataacagagaagtgggaataacagattaggtactgcaactttataaaggtttgcctagatcaagaagcagcgcacacacacacctcatctatgcaaactaaaaatgtatataaacagcacaatactgtgatactggatcatgatacattacctgtacacataactactactgttattaataaacctttgggacactcagttttatgcccaataagacatcattaagtctttaaaatcttctcttcctctttaatgggagagtatttctagacactaattttcccatctaatattcaaatataggaaacagattccacaaggtgctttaattgatgagacctcaagtgctgttttctctcttgaacttttggatagtaaacagtccatagggaccacacacaatgctatgacagaagagttgttacattaagtcttttcatgggacttgattggtgaagctttatgacatgcttgagcaacgcactgaaggggatcccatctgagttaatactttgtccaaccactgtagaggtccattcagatgaagttcaatccagcaaggagtacttgttaccgtctgccttctgtttaaaagaatacaggaaaatgattatgaaattcaagtccacaggcagggaaaatggctatgtttaggtacactgcattaaaaatttacagaaattaaaaggttgtgtatataattttggacacgattattccgcaaaatggttgatcctcaaagtcaaagtacttctgatgaccttgttttagaagtgatttacaagaacatctttttctcatcgcactaaaattaataaggtgatcttattattcaccatcatccaaaatggaacacctgagagagaatgtagatactattaatatcaggccagggccaggcgtggtggctcacacctgtaagcccagcactttgggaggccgaggcaggcggatcacaaggtcaagagattgagaccatcctggccaacatggtgaaaccccgtctctactaaaaatataaaaattagctgggcgtggtggcgtgtgcctgtagtcccagctactcgggaggctgagacaggagagtcacttgaacccaagaggcagaggctgcagtgagccgagatcatgccactgcactctagcctggcgacagagtgagactctgtctcggggtggggggcagaaaaaaatcaggccaaaaggagacacgtgaatcaggattgtccaagcaaaccaagacataaagtaactgtacttaccaaatcaaccacagaatagtagatactcaaatatcaaacagaatctaagtaaaagtataccaaagcaaaaacaaaattttggcccaagctaaacccacaccacagagagtgttaaaagctggaattcaactttccctgccaaagccaatgaacatccctcttagcaacaccattcgggcttttaatagtgcttcaacaaaaggggcaactctaagagaattacaaattattcaatgacatcctgtcacttccatgcgctgattttagttccatcttatttgctatacagaataaagtcaataaatccacttgcttctacaaactaacagcccttcaaatatgagaaaagcccattatcaactcttcatctccaagcaacacatgttcaatgtaatttaaaactgtacttccaaggatgtcactttctgaggcagatggtatcagtgccccactgtaccctttggatttttcagtgtgctctagacaacttccaactgcaggtatctgcatttctgtgcccaggaacttctctgatatacccaaaaaggctagaggtgccaggaaagaagcatccccaggagcagccctcaaccaaggaaacagaaattgacatttacatgcccagcacttctgttcccctgggtaggataattctgtagactgtttactgtttcctagagtttccccaagggtgtcagttctagtgacccacccactctggtagatggcttaacaatggtcctggctgccctgttctcccctgtcccacttccctttctagaataatccataatccaggtcacccaaggggagtaggtttaagaaggctgccactcgattaaatacaaattcttcatacatctaaatttcctgtttactacatttcctcatttttgtgctaacaaccaagatgacattaaggaaatttaaaaaaaatagttttagaaacctaaacattaggtctatttcctcagctccagaatgattacagacagtaagttcctggtagctacccacatatccacagatagatggatatttgccattttgatttgtaaatgttacaggaaactacttgattttccaaagtcagatgtacctgactcccaatactcataaaaacatactgcatattactgcttctgtaattacagattttactttatctgtgagttaaagaacagcagagtccacagtgaatgaagaagggcagtatctttaccaagtaaaactgttcttagcagatctatagatacacatggaattctctctgtaattcactcttacttccactaaattcctaccatattttgcattattctaaccttctgaagaacaaaaaaaagtctgacctgaaatcttattagacaatataatttaaatctaattttgctatcaactcaggtcaagtctaattttaaaaaacggcattcagcattcttaacaggtaacaacatctcaaaagggtaataatcaaaacagaactacagcaaaatcacaaaatgaattattctaccaatataactcagaaaaaaatagtgacaagtcttcattctctgatacaaatatataccatatatttttaaatgtattcaacaagtagacctcacattgcacaatctcaaatcagatttctgacaaaacttaagatagacaagcaagtccaaaacaaataaatttggaagggactaaattgctggaagaagcaggaatacaatcactatattacatgaatatttcttaagcaggcatatggagtaagcaatacgaattgaagaaagactaagtattttacttaattcctactcttaaatatggtcaagaagtcttctctctctttgatgtgaaatccaatctattgtttaattcatcaataatctagactatcttatccactgatgacaaattagtttttgtaaaacttaaacataattgttactactatccttataaaagaggtaaagagtccaggagaactatcttccagtcccatctcaaccacttataatgtaaccttgggcaaattatcagctttctatgtctatttccaaatatgtattagtttgaaccatgtgttacctgcaacgatggcaatttcatatatttcaaccttacaaagaatgaattgacaacagaaataataatttttagatactacacttaaaacagcacagtgcctggcacattagcaagtattccttctacttctgaatgaagttcctcctcttaacctacatctagtttgtctcaatttaattgtccagccttatttttctattctccaaactgaattgctatgctattgtcaagattatcacttcccaactctgcccaccccatttatgactattgaaatccaatgcaccttttacaactagatcatgtgccatcaagttttccttgagcaccgtgtgcaaacatctctccttccataaactgacataacccttcatatacaccccttttatgatatttaacactctgaattacgttaaaatgcacgcctgtgcatgttttaatatcttccataatggcagctcagtaatttgcaacagttttgaatttggaggcctccaactttattttacataaagatcagctgactctataacctcattgaaaatagatacaaatgaactccagaatatgcaagaatgcaatgaaacataattacactgtggaaatttaagaaccaaatatgtatttcataccggtattctgctccccaccctttcacaaaactcattcttatggtgcacattctagttagctgatagacggcttcaaaaccctgattaacagactgagccagaagagcagcaaattcctggttgttgaagatcttcagattacagcctatgattaaaaaaggtaaaagaaattgtcaaaagagtatcattattaaaaagtaattttaaaagggttacaagttttagaatatgagcatgcaatcatctactgattcctaaaattagcaacaagaaaaactaagcaagttgacatgataggtttatgtacattattgaatccatacctggtggaattttacacactgttgcagggtgccagccatatctctgattacaattggggctctgcacaaagattgcactatcacttaggcactcagcaaaaacttccccacctatgtagtataagcgcactcctcttcctgaaacaaaatacaaatgagattagttttgtaacatttactatttcagtgtgactttggaagcattttcttggaaaaattctaaaatgatataaggtatttccaggatctttttcacagataatgtctttctgaagtctaactttaaatatactactgtatatttctcccaagtattttctaacaataattttattgattttaaaatacatgtgtactgactgaaagtatttaaacaatgtagaaaaagtacacatagtaaaatagtttcatacaaatgatatatattaagataagtaaaagattgagttaattttgaaggaattcactaatgtttggagaaatatatcttcattacaactgtagtttcttagagatcccacttaatgttaagaaaaaagatgtaaaaacatcaaaaagtcatttgccattttaaaaactatatattatggtggaaacccaacctctagatgtataagcatgattaggtgagaaaaaattctactgggagatttttaatatacttctttcagaatctgagagatcacagatgcaaaataatatgagatataagaattaaaaaaaaaattgtgagaagcagagttctaacatgacacctaagagtctcagccctgaggtgcacatacattctctgttaatcaaacactaggtgctgctgttaaggattttttcagatgtaattaaggcagcaaatcagttaaccttaatcaggcaatcctttaaaagggactagactgtcataggctaagtgattcaaagcatgaaaggtattcaacacaagagacattctccattgctgactttgaagatggatggcaccatgtgacaaggaattcaggaggcatctaggagctgaattctgccacaaccatgtgggtttagaagaggacctcaagctccagataagaacacaagccagctgatacctcaattttggccttgttaaaccctgaaaagaccgcctaacccatgtctggactcctgacccacagaaaccgtgaggtaaaaaactgatgttttaggccactgagtttgtggtaatttgttacacagcaaaagaaaactaatcaaacaactaacactccagatttaatacagaacctggtacggtggttctgttaagactatggaatatctgtaaaacagtcatgcacgtggtcattgggaaaacactaagtccaaaaagtagagatttttcaggctatattccctgatcaatatcacctataaaactagaaataaaaaatttaaaaaaatccaataacgacagcaatctaaaactttggagggagaagagaataaggcagagaaaacccattaaatttttttgcagaaccccaattaagtcacaaaaacaaaaaactattttagttaaagcacctacagcgacactgggtatcttaataagattatccaaatttatacatcaagcaagatttgagaacttccacttggaaccaagtaatagatcttctagtcactatcattttgcagtatcaaaatcacactttgataaccagcattacttctcacaggaggtaatggttaattagaaaaaaaacagaagcaaactactgttaaaagaagttactttaaggtgatgagaatgatgttcaattatgaatggttctcacactttttcacttcatcgttaaggaaatactgaggaccccaaagagcttttgtttatgtgaatattatggaaaatgaccatattagatataaaaactgagatttaaaaaattcatttaaaaatcaaatccattacatattaacaatgtttataaaaaacaactgtatttccaaagcaaaaaaaaaaaaaatagagtggcaacatttcaccatttttgtctatgaaaaacaactatatttccaaagcaaaaaaaaaaaaaaaaaaaaatagagtggcaacatttcaacattcatgtctagtgtaacagaattggagtctcattatcaaatctacatttcatctcttgcaaaatcatatgcatgtaggctctggaatactccactgtacagtcatgagagtatgagagtagaaatggcaaacagcatctcagtactactatgaaaatagctttgacctcacaaactagctgaaagggtttctgggactaccagaagtccccagaccacattttgagatgtccctgaattatattttgaactatattaaatgcagttcttgttttagatatctcatttcagatgaacagcaagcagatttcatttaatatataaactcaccaaagggggaaaaaacctgggagctatataaagaaactgaaaaaaaacaaaaacaaaacaaaacaaaaaaacatgatttataaaaaagtattaacccccaaatctgaacatggcaattttatgactggtagagactcagcaaattaaacttatcttaacacatatttattgaagaactttccagtaccaagggtgccaaataaaagttgaagagtttgcagctgaagcatcaccaggatctattagaagcagtgaagcctgtgcacttaaatgtgtcggcacttaaaccaccagagagaaagctggttttactgcacacaagctcttgatgtggcacaccatgcaatgcctacattatgagtatacagcatttatttttcacaacaaggaaaataaaacatacctatatgccttcttgtcatttctaccgtggcatttcggttaacattggagagtaaacctaagcagaacctctctgaatttgatgggtctgtaaagccatctacagtgagtgagggctgtgatgcatggaaggtttctccaaccctctgatttaattcataatatgctatcgaacaccaaaatgcaggttctgagtaagtaactggctgtaaatctgaaaaagaaaaaaataaaaaaataataaaaggaagaaatgcgtgaacaattcaagccaaaaatagatttaatataatcatctttacatgctctatgccagcctgcactggcaaaagctcaggaagtagacatagtatctgtatcggtttccacagatgataccagattttcagtatttttcacacaaaactccagtttcatagatcataccagattttttcaaatttctcccatgtcattaaatcactttatgttggattctttgttttaccagtagttttagtctagctcctgttcaaatacaaaacaatcataggcaaagtcagtcaacttgccatacttggtgcatttctaaagcacataaaaaagctaaagtggggtaagataaagccagagcaaagattaatgagtcaaaagccacacaaagaaaaacagtaataataaaaggatacaaaatatgacatatttttgacatttgtctattttaacatcaaactcttggtgagataccctagctacaaaaagagaaaacccactcatacataagaaccagaaagcagtaacacacaaagatcatgcaagtagaaacagaccatagagtcaaaagactacttatttcactggaaaactatatatttagcttctgcagtttgactaaaacatatcataaggaatactgcaaaagaaaaaaacctcacaattttgtagaataaattccaaacatgtaacaaccgaagagaaattgtgaaatagggtaaaatgagggcaaaaataataatagtaatacagaaatgtatgtatatatatatatatatatatagtcatcccttggcatttacaggggattggttctaggaccggctccccctaactaaaaacccttagatgttcaagtccctgacataaaagggtgtagtatttccatgtaacttaaattcacgtcatcctgtatactttaaataatctctagattacttataatacctaataatataaatgctatacaaatatttgttatactgtattttaaaatttgggcccagcacgatggctcacgcctgtaatcccagcactttaggaggtcaaggtgggtgattcgtttgaggccaggagtttgagaccagcctgggcaacatagtgaaaccccatctctactaaaaatacaaaaattagctgggtgtggtggcatgcacctgtagtcccagctactcaggaggctgaggcagagaattgcttgaacccaggaggcagaggttgcagtgagccgagattgcgccactgcactctagcctgggcgacagagcaagactctgtctcaaaaaataaataaaaataaatacaatttgtattagtttttactgtcgtattgttattttcattttttcccgattattttcaatctgcagttggttgaatctgcagatgctgaactcatggttatgaagggaccatacacatacacatttgtacatatatgtgcacactctcatatatatattatatatagtatatatatattattatatatatgtataatatatattatatattatatattatatatattatgtataatatatattatatattatatatattatgtataatatatattatgtatgttatatacatattatgtataatatatgttatatatattatacataatatgtataatatatattatatatattatataatatatattatatattatgtataatatatataatatattatatatattatgtataatatatattatatattatacataatatatattatatattatatattatgtataatatatgttatatatataatatatattatgtataatatatgttatatatataatatatattatgtataatatatattatatattatatatatattatatatattatgtataatatatattatatattatatatatattatatatattatgtataatatatattatatactatatatatattatatatataatgtataatatatattatatactatatatatattatatatattatgtataatatatattatatattatatatatattatatacattatgtataatatatattatatattatatatattatgtataatatattatatattatatatattatgtatattatatattatatatattatatatattatgtataatatatataaatccccatactacgtatacatgtatacatatttatgtcaatgtgtatatatgtaatacacataccttttattaattacatcataaaataaacataaccataaaaatctagccataacaggttatataattttctatgaggaatatgatttcaataataaatagattatacctatttcttatatgtgccagcagaaaagacttaataattttgagggatggtgtcaatattctttttaaaaagcactactttaaccacatacataattatttggctattcattaggatccctttctcggatatataaaaaataactcctagagatgatttttattattaagtaggtgatacagtataaaaatgatgaggggaacatatgtgcaacttacccaagctatgattaacaggggaaagagtagtaggagatagttctgctggagagcctaaaacaaaaggatttaaaaataaatgaagtatttccagaacttctgatcaagtaatcataaaactagctttatctggttataattatcaacaataatacaaagataatttaaataccaagaattcagaatatgtaagtgcttaaatttagtttaatttgtggggggtcgggggaagagaagggggggttccagtataaaaggtgcaacagttttggcttctagcccaacagttcatcttcccaaagatatctaatattgacggttccttgggtatctttccaaaatactctatgaaccacataagcaaatacatttttgttctgtgtcctttcttttcatatacaagtggtaaccgtttttcatcttctatattattctatcagattgttcacaatgtgtttccttatttgtctatctacatatcaattagtcacataacatcgcgatcccacattgatggatattcaagctattttcaatcttttgctataagaaccaatgctttgagattgcaataactaatcttgaccgttttgcacgcttccaatcacatctgaaagatacattcttcaagaaactgccaggtcgaaaggtttgtgtatttgcaattttgatagatttgggtaaaattatcattcatcaaggttgtaccagtttacattcccagtcacaacatagtaaagggatgcttgaggtgttattgcttctagatgaaaacatggtcacaagtacagttttaattttgagtagctttacacatgtttatattatatttccttcctgtgatagtctgttcttttcttttgcgatgttgatcattttcttactgattgtttgaaagctctttatgtgtattagggatgtaagtcttcttatggtatgagctacaaatatttaatcattggtcttttgactcttaatcctaattttgatcatgtagcactaaaataaaagcccttctacaagatttatcaatcatctttgggttagcgtcacactttgggataaaacagtgatgacggtggatatcttactcttgacttttagggtaatgtttctaccattttcccattaagcatggcattggctttcaggctaacagtaataaaatatttatttaggatttttgcatcaatagtctcaagcaatacaagcctgaagatttacatgagtgctatgtttgtaaggctctgtggtcaatgttatgacaatctagcagctttatcctctgcaaaggtttaaatagtattataacagcatattctttaaaagtttggtagaattcttctgtgaaattatagttagtaactttctagggtttactacgagacattattctatgaagggtgacttgttcagatagctctattttctggagtcagttctggtaaattacactttcttagaaaatgatctgtttcttcttttgggtaaacaggctaaatctaatcaagaaaataagggggcacaaacatacaaaataagaaccaccacagacaacatatgaaaaatcatggcgcaactagtctgctcagttccatgcaactcaattttaaaacacatttgctataaacattgttaaataatcttattaaaaatataaaatatattttcttttatgatcatcattctctacacgtttaggcacagttacctaaaagagcatgacccaagcttcaaatgtataccaagagcataattgtagaataagataggtcaggctgggcatggtggctcatgcctgtaatcccagcactttgggagactgaggtgggtggatcacgaggtcaggagttagagaccagcctggccaacatagtgaaaccccatctctactgaaaacacaaaacttagtcgggcatggtggcatacacctgtaatcccagctactcggaaggctaaggcagaagaatggccgtagtatacccctggtcgtgtagcagtgaaagtggtttggtttagacgtccgggaattgcatctgtttttaagcctaatgtggggacagctcatgagtgtaagacgtcttgtgatgtaattattatacgaatgggggcttcaaccgggagtactactcgattgtcaaagtcaaggagtcgcaggtcgcctcgcttgaatccaggaggcggaggttgcagtgagctgagggcatcccactgcactccagcctgggcgacagagcaagactctgtctcgagagggaaaaaaaaaaaagagtaagataggtcagaccatcttacacacctcctccctaccacacactattataaccatgacataaaataccaggcaataaaggtgaaatggtagcccctagataaataaatgaatcagagaagggatgcttagtttttagaagacagtacggtcttccacaacataattaagttatgttccttttttctcagtttgaaaaatctgctggcaagtcacaaatctgctggcaagtcacaaatctgctggcaagtcacaacaggtacaactaagataggtcaaaacatatttggaacaatgagctaaaattcactgctgtttcctgaaaccaacataaaataaacaaagccactattagaaatggaggaaactgcccaactattcatatcttttaactgtttactcctctattaaatacttagaaatgaccagtaggatcatttaaattaacaggcgttcagtcagatgtgacaggttagaattacagattacaaaaaagacaaattttaaaaacttaaaataagctaacaattaatagaagcctttaaaaaaaaaaaaaccagaggcaacgaactgatgattagcctatgaattattcatacataaatgctgctattggagtctcacctaccacaggtcttccacttagaatattataaatatcctatttgagatccagtgtgaattagcagtgtctacttacagctaaaccatctacagaaatccctgtgcatgtatcttcgcatacaaattcacatatatttgtaggatacattcgtcaaacctttgacaaattaacaaatgtcaaataaaatgtgttaaacttttataagtgccaaaataccctctcaaaaatgtttcatctcactaagaatttataagctagtgtttcttcacaccgtgtcactacatgttgacatctgccaatatgataggtttaaaaggagcaattttttaatttcttgtttttgttgtaaacagtgtatttctgttcttttagccaattctattaactatctttttcttcttgatttgtaagtttttaaacttaaaaatcagttcttagacttgtcatctatttgcaaatattcacccaggtttttttttaaaaaaaatctgttatatcttttaaggtgacattaaattgttttaatttaaaaaagactttttttttagagtagtttcaagatcacagcaaaactgaacagaaagtacaaaaagctcccatatgacccctgccctgcttccccaaattccctataacatccgcaaaccacaatggtccatttgttataataatgaacctacactgatacatcattatcactgaaagtccataatttacattagggctatgttatacattctctgggttttgacaaatgtataatgacgtgtatccatttacagtttcaaacagagtagtttcactgccctaaaaatgccctgtgctccacctagtcctctttacctcccacaaagcctcagtaaccacttatctttctactgcttccatagttctgccttctccagaatgtcatatatagtaagtcttcatttaacatcttccataggtttttggaaactgacttaagcaaaataattgtacaacaaaaccaacattccccaatcatcaacactgtaacgaaatgacattattacttgaggacctgttgtacattaattggatatatcagtttatttatctagtcacctattaaaacatcttggttgcttccaagttttggaaattataaataaagctgctatgaacatcaatctgcaggtttttgtgtagacctaagttttcaattcatttgggtaaataccaaggagaagcaagactgctaaaccatatggtaagaatatagttagttttgtgagaaatcaccaaactgtcttccaaagtggctataccatttttcattctgaccagtaataaatgagtgtgcctgttgctccccatcctcaccacaccagcactgatgaactccctcagcttttgtctgaaaaattttttatttctccttcatttctgaaggacagctttactggttatagtattcttggttggcaggggtacttttttctttttttcagatggggtctcactctgtcacccaggttggagggcagtgtcacaatcttggctcactacaacctccacctcctaggctcaagcaattttctcaccttggcctcctgagtagctgggaccacaggtgtgtaccaacacacccggctaatttcagttttgttttttaattctttcagcactttaaatacaccacccatctctcctggcctgcaaactttctgctgaaaaagctgattgtctaatgaagactcccttgttatgtggcacgttgcttttactcttgctgcttttattcacaatagcaaagatacagaagacaacccaagtgtcccatcaacagatgaataaataaagaaatggagggttatacacacaattgaatgttatcctgccttaaaaagggagatcctaccacttttggcatggatgaatctggaagacattatgccaaggaaattaggtggacatagaaagacacatggcataatctcatatgtggggttttttttttttaagccaaatacatagaaacataataaaatggtgattacaggttggggggaaaatagggagattataggtcaaagggtataaagttgcagatatgtaagatatgcccagagatctaatgtacaacctgaggactacagttacaatattgtgttgtatactggaaatttagtaagtcaattttaggtgctcttatcacacacataaaaaggtgactatgtgagatgatggatttagttgactacagcaaccatttcactacatacaccaaatatcatgttatataccttaaacatatacaataaaaatgtatgctttaaaaagtctaatttactgaatacagactaaagtgttcacaaaccttccagaaaactgggaatcatcctgggttgcttcttcaaccttaacccaaatatgatcactagtcatattctaagcctcagcaatatgtatcaaaagcacccacttctcccccatgtcacctaaaaccagccagacatatagtgtaataaacaagaacaggaactctagaatctgacatcctactgaatttctctgtcattttctagctattttttaatgaggttcattacagcattgttttttaatttctggtaaaagttgaaccttttaaaattttaattttttgctagatgcaattacatataatgcttaagttttcctattttgcctaactatgctaatttttttttttttttttttttgagacggagtctcgctctgtcgcccaggctggagtgcagtggcgggatctcggctcactgcaagctccgcctcccgggttcacaccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgactatgctaattttttataatgaacatccatttgttgtataatttgaaatgctgtatcataatcttatgtgtagaacactgtttaacttttatctgacacagaataatggtagaaataagagattaagcttccctgccaaagtgatacaacattataatcatcaaattcagcttatgaaatatataatgcatgaatgatcattttttcatttcttgttttaaaaaacttaatccccagtgcgatagcatcttaggttttacatatttccaatttttctatgagagcataattctgttcataatgagaaaaaaggctgcttttgtttttattagaaactcctacagagttccccttatagttagtatgtagaagattggggaaaacctttgcttctgaaatagcagtaagaaaacagtggataaacaaagaaaaattctatttttctttaaagttatcacacagatatagatccaaataagtccataggaactaatttacagagagggatgagctcctccccagttaacagagagtggtaatcactttcactactgacagcatctgccaagtcaggacacagacaaaggactgagcttgccaaaggagaagccaactaaaatttcaatggccatgcacagacgacaggaatcgaagaagctgcaagcacagagctcctcttcaccagtcagttttaatacatgtctttagctgagtacatgttagcataggaagtcctgggcaaggctggaaagaaataagaatatgcagtcttgccatatttgtatctgaaagttctgataaggtagggaactgaccctccctgaaacctgagtgatgtgacattaaagcaccaaattatcacctttccaactcaaatcctaagggcagggaaaggatcagctcctcaacttggcaaatagagaaaagagttggtctttccaaagaaagtgttatctattttaatctctaatattattatatatacaacacccactatccaattaaaaaacaagagatattcaaagatggagggggaaaaaaatgaccccataatcaagagataaaacagtcaacaaaagcaggccatgttacatattaactggacacaaattatcgaagactttaaaatggaaattatatagctaaaaaataaaggatctgaaatgaaaaattcatttaattggattaagagcagactcaaagtcagggtcacatacatattatcacttgattttcaacaaaggagccaatgtaaatcaatggagaaaggaatgtctctgcaaaatggtgctaaaacaactgaaagaaatgtctgtagtaaaggaataaaaagcagcaaaaaggagccaaactggtaaatatgtaggtgaatataaaatacttctttttatcccttctaatttcctttaaaaatcaacttgatatcaaaagcaaaaaataacactgaactttggggtttatatatttttattaagtaaaatacatgtcaataatagtacaaacaacagaagtagatgaatgaaactagagtggtgtaaagttcttaaattttacatgacgttgtaaaatattacaacttaaataaacttctaggtataacataagtacaatgtaatcacgagaatgccaactgagaaaataatactaagtgttactggtaaaaggccaagagagtaaacagaatgaaacaaaaattatttgattagtctaaaaggcaggaaaacaaacagataaaaaccagagagaacaaatagacaaacaattgcaaaatggtagcctaaagccagtatcaataatccctctaaatataagcggactaaattttccaactaaaagacaaaaattgttagattaaataaaaccaaaaatatgctgtccacaagaaacacaccataaatataaagattcggatagactgaaacaattaaaaatatatcatgtaaccagaggtaagaaagaagatatggtgatgttaatatgaaatgcattttataattagggcaaattaatttggaagatgtataattccaaatgtgtatcatctaataacagaggttaaagacacacgaagcaaaaactgacaggactaaaggcacaaacagatgactctaaaatcagagctgaaaattttaacacttatcataactgacaaaataaggagattttaaaaaatcataaagaattaagaagatgtaaacactatcaaccaccctgacctaaatgacatttggaacactatagtatatacattctttccaactatatatggaactcttatcaagataagttacaagttatagcataaaataattttcataaatttccaaggactaaagtcacacacactatatgctggactgttaacagaattaaattagaaattgatgaagtatctagaaaatcctcacactcctaagaaaaacccaaacttctaaataactcatgaatcaagaagaattagaaaataagtgataatttaaaaacaacataaaatttgtaatatagagctaacataaagcttagagggaaatttatagctttaaatgtgtacattataaacaaatcaatgatctaaatgtacaccacaggaggctagaaaagaccagattaaatgaaaagtaagcagacaaaaagatgaatacaaacaaaacagaaaagagacaaagacaacaaagactactgattaatccattacaagacattctaataaaaaattaaaaagtcaaattactaacattataaattttaaaatggatctcacatatatgaaaggaataacaaatatcagaaataactttatatcaatacattctccagccttggcaacctggtgaaatcctatctctaaataaaacacaaaaattagccaggtgcagtagcatgtacctgtggtcccagcttctcgagaggctaaagtggggaagattgcctgagcctgggaggttgaggctgccgtgagccaaccaggccactgcactccagcctgggcaacgaagtgagatcctgtctcaattaatcaatcctatgacttaaatgaaatgaacacatttctaacaaaatccaagtttatcaaacacatacacaaaattaaaaatgtaaataattctcaatttaaaaaaccttttcctacaagagatggtttctctggaaaaatcaaactttgttttgaatacaaggtctcgctgttgcccaggctggagtgcagcggcgcaaacatggctcaatgcaacctccacctcctgggctcaagtgaccctcccaccttagcctcttaagtagctgggaccacaggtgaatgccactacccctggctaatttaaaaaaaaaaaaatttttttttgtagagacggggtcttgctttgttgcctaggttggtcttgacctcctgtgctcaagcaattctccagcattggcctcctaaaatgctaggattacaggcaagaactaccatgcccagccctatcaaaaatttaagaaagaaataatgccaaccttaaagaaactcttcgagaaaacaggagaaagccctttccaacacattttatgatattaaaactaataaacacattacaagggaaaaaaccctacagaccaatctctcataaacatagatggaaaaattctcaaaaataaaacaattcaaatccatgaaactatatgatcctctttataaacgcagaaaaaaaatttgacaaaattcaacagccatttataaaacacaattagaacattaagaacaaaaaggaaaaagaacttcctcaatcagatacaatctccaaaatatccacaattaacatcatacttaaagggggaattgtgaaatgtgttcttcctataatcagaacaatgcaaaaatgtccattcttatagcttcaacagtttattgtaggtcttagttaggacagaaaaagaaaaaagcatgaagactggggaaaaaaagaaaaactgtcagccgggcacagtggctcacggctgtaatcccagcactttgggaggccgaggcgggtggatcacctgaggttgggagttcgagaccagcctgaccaacgtggagaaactccgtctctactaaaatacgaaaaataagctgggcgtggtagtgcatgcctgtaaacccagctactcaggaggttcaggttacagtgagctgagatcatgccattgcactctagcctgggcaacaagagtgaaactccttctcaaaaaacaatcaaacaaaaaaaaactgtccttatcaacagatgacatggctgtgtatgcagaaaacctcaagaatctacagaattctagaaccaaaaagtcaatttaacaagaatgcaggagaaaagaatatacaaaaatcaagtatttcccatatcctaggaacaactggaaaataaaatgtaaaaacaaaaacgtataacagcactaaaagtataaaatactaaaaaatttatctaatgaaagacatgctatacatctacatcaaaaactgtttaacacatggcagagaaaaggcattgttataagactattatcctgaagttgtcaaacctgacccctcatttttgacaaaaatcttactttcctattttatagagctgatcctaaaccacaaaaatcaagtgcttctgtgtctggatctcaattcttcactttccttcacatctttgtgcaatccactatcttcctttttcttaatggttaactcctcttaacattttaactaccttcatacagtgcttattacaggttagaacacatagatgccttataaatatcagtcctattaatactctatgagttaaatgctattattgtccctattttacagatttaaaaactaggttacctagctagcatatgtaagaggaacatttcaaactcagatagtctagctcagagtctcactatgctattttgattatatgcatttagttaagaggagtaagtcttgtaagtggagtgtatgggaaaactgtctaggagtacaaaaaactagtagtttacaagaagaaaaaattaaaatgtattttctatttatttaatctcatccttcaatttctaatttttgtatatatttttaaatgtacttgaagtacctgtatataacttacaaataattaagtgtacatattagtaggatactctcaaaatcttaatactcactgtattagcttcctagggcttgctctaacaaaataccacaaactgggtggcttaaaacaacagaaatttattttttcagagctttgaaggacctaagtcccaagacaaggtgtcagcaaagccatgctctctcaaaggctcaaggggagaatctgttccatgcctttctcttaagcttttgggtttcccaacaatcctaggaattgctcagcttgcaggtgctaactccagttacctgcctccatcttcatatagcacattcctccctatcttataaagacaccagtcatatagaattagggcccatcgtacttcagtatgacttcatcttaaacaactacatttacaaagatgctactcccaaacaaggccacattctgaggtattggaggttagcacctcattttatcttctgggacacaggcagattaaaaaaccctttaagtctctttgtgtatcttggaccaagcacagtgtatgtagaagatacaaaactgaattgtgagttatgaaatccacatcttatgatctattatattctatttctctatatacctgtttgaacaaatatgttcataaaaatcatgacttgaaaagggactgattatacaatactacaaaggttaatcgaacttataaatttcttacgatgtccagcctgatctctaatatccactataaaggaagaataaagtcttgaccagcaaaatctaaatcaaaaaaaaaaagaaaaaagtaacaagtgcttgttcgtacacttacttattatgcctaatttatcctctggttgcccttttaaaaaatttcaattcattatttttaacagcaggttatgaaagatgaatttaattatgtccttccttctggaaggtatgaaccagagttagagaggtggccaactttgttctaaattggagccctgcatcagtcagaattgtttcttgccatggccccaagagagaaactgatattgggtaagaggctggcagccaaactaactgttggcatctcatgaatcacatattcccattgccatacagtaatttttaaacctgtcattcagaaagccagtaacactgctccactgaaacagaaatattaggttgggttcaaagttagccccaacactgcaattattttagctggctgattcagcttattctccacttttgtactttgattcatttatcatacataacgaatacttgtattattgctcctcctgtgtttcagttatattgctgaataggtgtctgtgcactaaattagaatccctgcagccttttttttctggcttatttcacttaacatactgctttcaaggtccatccatgttgccacacgtcatgctatactgtcattcctttacatggttgaataattccattgcagaaacatacctcattttattcatccattcatcatttgatggacatctgagttgtttctaactttgaatattaagaataatgcctgcataaatggtcatgtacaagtttttgagtagacatgttttcagttcacttggatacatagctggccacaatatgttaactctgtatttaactttttgaggaacaggaaacttttccaaagtgttgaaccatttaacattcctactagcgatatatgaggactccaatttctccacatcctcaccaacatttgttattgtccttttttgattatagcatctagtaggtgtgaggtagtatctcactgtggtttatgacgttcagtatcttttcccatcattcacttttaaatgtcacagtaacagctgtccatcacaggcaaaaaagaatattattgcttcaagaagagtgtcatctaattttagtaaaacatatgtggaaagtcaaatattatttgcattaagatgtataacacgttatttccaacgttcattagattatctacctttcttagttatctggtactcctaaacacccaaatgtatgattagctacagcagaaacttctttacctgggagtccaaaaaaacggatttaaacaagagaattattgtaacccctccctcccccaccaatgttaatccacttaaaaataatttagattatcataaccaagaatgcattagtgttaagatgtggagaaagactgatggtataatttgtcaggttgtgatattaaggtgtccaacagttaagatacagacaggtaaaatgaatcaaactggacaattacaatgacatcaaagtgatttcactggtagtttattagttctgctgagttatacattttattacgtaagacgtgatttaaagctttaatttttttcttcatcactttttggagttgatagctaagcataagaaattaatctactataattcaaaactcactattaggttaaaaaagcagtgaaaagctgatccccatccttcacccccaaattcctctgaaaatctgttatttgagtaattatggttttttatcacagagagatacttagtcatagggttactaaaattttcaacagaagcaaatacttaaaaagaaataaaagtatgtgcatgttttcaaattttcatttactctaataaaaaataacaattattctgcagagtagcatacgttataatttttcagtgacaacatggacctctttggtagttcagatatgttaaatcaagatagaagatcatcttttttggtatgcgtctcaacttctctaaatttaagagtaacatcttttgtgaatttcaaacaatacaagaaatgtatatctaataactgaggaattttcaaagacattttttttacctgtgtccatactttgattcaactgttggtcacttgtttctccatcttcactgatatatccaggaggtggcgtttctacaaaagtttaaaacaaatcaagcacagctgcaacataatctcactaccttttctctcagctaccagagataaccaatgaatcactccaaataacaaataataatgttatataatattataaaaagtaatattgcatactgagggtgtataattcaggatcttgtccaaattttgcagtgaatccttaacatccacttttaataaaatcctactctctggacatacacattatgtacgtatcttgctcattcctatatgtacatattctggggcaagagccaaaaacgtaactttaaaaatgcctcagatctgaatcagtaggctgcaaaaccatcagtaactacaattttttgttgttgttgtttaatctaatgaacatcgttattttatgagtacttagaaaattaaaaaacacacaagattttggattataaaagtattaaataatacaggcttacaacttacactaagttctatagggtaaaatatggtagagtatggttccggattggtccaggctgaattctatctaaaaagtgtgtttctccaaggattcctaactggtaaagtctaagtgtttgaagcagaaaattcaattcaaatatagactactgtataaagaggtaaaatgctccctgaaaataaccattaggattctaatatattatttccaacatgttgtctgaataaaacacttatgttcagaaaggtatctgaatagctgaataaactgcatgtaaaataaaaacatgtatacaatttaatcaactgtaattccagggaggaaaaataagttcagaagactttcatcagttttacatttacactgaacagttttgagcgattcaagataacaaagacacatatccaaacaattttaaaattatcaaaagaacgaggccaggcgcggtggcttatgcctgtaatcccagcactttgggaggccgaggcaggcagatcacctgaggtggggagttcgagaccagcctgacaaacatggagaaaccccatctctactaaaaacacaaaattagccgggcatggtggtgcatccctataattccagttactagggaggctgaggcaggagaatcatttgaacccaggaggtggaggctgcggtgagccgagatcacaccattgtactccagcctgggcaacaagagcaaaacaccgtctcaaaaaaaaaaaaaaaaaaaaaaaaagaggaagagaagatacaggttaagggtctccttcaataaccttttacaatatctattcaataaactaaccacaaactttaagtatcaaacttttcatttaagtgtcagtacccccaaatttttaaaacaaaaattctaagaataaattatcttcatatactcaaagaacataaaaataagggtacatattatgcatattttaaaagttaaagctaataaagttaaacggcgctaagctttttgagtttaacctgtatttcaaagatctaatcagaaagaaatgctgaaccttaaaatacgttatcttactgtgtttattttttccattattgtaataaataataaagctattagcatttttgagaaaatgttaaaatttcttttaagtggaataaaatgtgaaccctttggttttgctgttgcttgaaaccggataaagccccactgtccagaaaagcaaatgggtataatccacttctgattttctactttataaaatactcaaatctcaataattaaaggaataaaaaagaaaggaaaaatgagcccaaacatcttcacaagtgaaagccactaaacattctggtgaatagccttccaaataattactggatatgcgtgttgtccctaagactgcatgtttatacctaaggttagtattgctggctgaataacagtaattcccacactaacgacttaaaatgcctccccttccccacaccaacgttcacacaactccactcccttttctacctagcaattgccctgtttcatagtcccgggttttccctcctcctagtgttatcatactacatcccaccctctccctctcttaacttcagtaagtttgtatttcctagcaacccataaagcagctttaaatcctcttctggaataaaacagtaatcaaagaaatatacattaaaacaatcaaaaaccacttcccatttgtaaaaccagctatttaaaaaaaaaacttatctttcttagttatcttttcttttttttcttccttacatttaaaaaattatcttcaatgaataagcattatttccatgatggatacatgaaagaaataattgtttaaatgtactaaaactgtattttaagaattttgtaaatgctcttaagttccttacatatttttagtgtataaaataagagtggaataaaagaatattacaaaaggaagaaagaaatcgagacactacagcttaatcctcatcctaacatcatgctgtttctgctagggagaaaaatcaaccaaacaaaaaggaaaacatacaagaaaagtaacaaagtattagttgttctccaaaaaaaaaaaaaagaaaccataaaaaacgaaaaggccagatatcatatcgtggagtattactggatcacataatacatcagaacaaaatttgagaaccatgtagctgaattcaattttcatcagaaattactgagatgcagacgaaacataattaaaggaggttttctgacgttcgtgttataatatgtaagtgttgctatgtctatagaactaagtattatatttcttatagaaatgttatatttctgttaaatattaccaagttatctaagaaaaagtgatcattgggtggatattcagttacatgtgtttggggggtacttttctcctacaccatttgttttgcttacattctgcatctcgcttagcttcaacaactaagacaaacttactaagatcttttcttttctgcttctcacagtactttgattaaagtcactgcaaaagaaaatgaaatataaagtaaaactcttctccaaacaaaactgtttaatgtactaggcttatacatttcacaaaataatcacccaacgaatccaatttttctattaaaaactcaaaagcatttttaaaaaagtgaaaccacaatttactaaaacttgaatgcttatgaacaaaatttgtatctatccaagttttaggagattcagaaggcaaaaatacctggaatataattactctgtggctcaattcctgctgggaagttagtgttttctggaatggagtgagtatagtcatccagaggcggaagttctgttaggatctcggtgtgtcggggcactaatactggaggcaaaactgaaaaagttcaagaaatccaagttaatggcaaagagcaaaggggagtgggggaaccttttttaaagttttcaacaagaagagaagttgtagcttaatttttaaagctagggtccacctactcgatatatactagttactgagaaaatgacaaatctgattatggctctaacttaggtagtctattatccaaatttccaagttctaatttatctcaaacttttgggaacaatgtgatcctggtaatattatattaccataaaagttcataaatccccattggaaaacttaacattgtctttatctgtaaaatcagatataggaaattttccaaaaacgcagctactgctatattttttaatagtttcaggtagacagctaactaaatgaaaagtcttgttacaagctttactaaacggtgtacatacaaatgatgtcattaaagtacttctaaaagcactccaagtgcaaaatgcttgaaaatgttactgcagcagggacatgtagaagcacatcagcatagcgctgagcagactgccaatctacaggatttcctggatatgcactttcatgccaaatcatatgctattccaagaaacagatatgttttctcattaaaaatttttaaaaataaaaaaattttaattaccaccaaataatatgcacaatttaaggtaatttattagaatttacactaaaattttcctgggtcacaagagtacttaaatatactgaagttcaggcatttaattcaaaaccaagaaaaaaacttgcaatattcctacctggtgtctcaactctctgatagtggtaagggtttacacatacttcatcctttttaagattaaaagcatattcgcagttttcaattgccttgagttcatgatgactgtgaagatcaggccagcgccataatcggcaatatataacatgtggcaatccttttcgatgggatacctggagacgaccatcaagagacctgttgggaagcaaggggaaaagaaaggagggaactttaaaaaaaaaaaaaaaaaagtgcagtcaaatgggctaaattagtacaataaaagcataaagaaaagaatgacagccatttagttagttttagtgagaatcaagaacaaaaatgtactatttaatggatctgataaaagtatgcagcagcactagcagatgtttcttataaatatgtcacataaatgactcaaatgccaatgaaaggctaacaacttgggaaaaactgattttttaaaaaagagagtttatgcagttatacttgaaaaactttgtcaacttctatgtttagtaaatcaaactcattttagagatgcttctaaggatattaattctggaggtgactgaagagtcagaaaaggaactagtgtgaagaatgataaataccaacaatgatgtgatagtaacttcctcagactactgcaactctttacccagttgtgactgttttgagaactgaggtatatttatgtagttcacaaataaatgtggatggtgatgaatatgatgagatgaaatgaacaaataccatatacgcaaaaaagaaaatgaagtgattaaaaaaagtaacataaaaatgagttaacctactgttaattgtgatataaggggttcattaagtatgtatttattagtataaagatgagattctgataacaagaaatttagcaaaactcatcatgtatctacttaaaaattaggccaacaacagattataatctgatctcaagctaaaataaatatatagttatcaaaattattattctttaggggatacagtaatttaaagaagattcaaactagaattgcattgattaaaacatcagctgaaacatttaatatattttttatactggcaagcagatattttaaatgctatgccttattttacattaaggaaacatcctaggcaaaattatactaagcaaccccatataggtctttcaaaatatacccccctcccacaagatctctaagattcgacagagggcagaatattcacctggtttgttcagagaagctgtaaaggcctgttgtatcccactgatctatcgtatttggtgtactcagtccccaaatttcagagcaagtgctgtgcataaattgaaaaacaaaaaattgatgtgaacatggaagcatggttattcaaaataccatgatgtaaaacatggagaatgtacagaatacttccttcacccagaaaatatacaattgcttcactttttcacaggcatgtagtgctggttactatattttctatatgaaggaagccaataaaatggaacatgtgactccagataagtcatgattatgtttttaaaatgtgaacaccaacgccctctagctcaatgaatcatacctataatgcccttaccactttcctgtattcaaaagatctaaaacctctgccatcagctttactaagtgcttcattttataatccagttttttaaaaaattatctaaaaacagatgtcaactgatttttaatatagaaaaaaatcccaataaaaatagacatgcatccacagttaagattttcaggttatctggtcatgatatttttaagttttactgaaaattattttgttctcatctctagaataaataaagaaatagactttgaagtcattctaatttagtataccaccttaaaaattttctcccacatttctctccagaatatgggcagctcagagataattctccctttttccctacctttatttcatttcatagtaacttctggtcagtgagagaagggaaagagagcttaaaaggaagttttggaatggaactttgacagccaatgtctcaagtactaagttgtacttttctgaaaagtccatttcttacatattacaaaatcatcaaaacttcaatgcggataaaggagtatttcaaaacatcttttgaaaatgaatcaagcaattgattaaatttcatatttacacattgttagtgagcttaactggatcaacagttcaaagggcaatggtgagaagcgctggcttcctgtggccaggcaacagaaccacctggcatccttggctttagtactacaggtgctgtcacatagctatcaggctgcaggaacacatcatgccctgctttgggggctacagtgacccgacagttcaaaacaaaacctgttctgaaattttccagcatctcattcaagtattttatagattctcttgctttttcaggctgcaaaatttaccagactataaaagccagaaaaagccaggtaaattaaggcttagacctttcccttttttccaaagatatactgatttaaaaaccatgacattaatggtttatttaaaagatattttcaaatatctattggaaacatatagcatgatgtagtttaaatcacaacagaatcacctcaattctacagacttctgagtctattaaagaaatggtatacaggagactattctttgaaaataattaacaaaagtgtagcacaagaggctattctgctctgtatcagaacatttcactcaagttattctgggactcacatgagaaccagaatctaaaatagagcatgaagtttacattgtactttatttaatccttgaaaggaatcagagaagaataaacagtaattgttaagaacttgcaatcaatctagaggcagacagatctagaccccaaccctaattcggccactttccaactgctgccatagggtatatttaagcctcagttccatcattatcatgcctaacaaaattggaaggtttattttaaaacattaaatttgcttctagctagtaaaatcattgcctgtttacataataaaaaatattttttaaaataagccaatttataataaaacatagagccctctgtatccaagggttccacatccttggattcaaccaaccgtggatcaaaaagtagaaaaaataagtaaatttttaaaactaaaaaatacaacaattgaaaaatacaaaatttaaaaacaatatggtataacaactatttacacagcatttacaatgtattacatattatgcataatatagagatgacttaaagcaggagtctcagaggccacagactgataccggtccacggcctgttaggaaccaggacacacagcagaaggtgagcagcaggggagagaccattaccacctgagctctgcctcctggaagatcagcagtggcattagattctcataggagcaagaaccctattgtgaactgcacatgcgagggctttaggctgggcactccttaagagaatctaactaatgcctgatgactgaggtggaacgtctttatcccaaaaccattgccgcaccaccacggtcagtggaaaacttgcctttcatgactctgtctcctggtgccaaaacggttgggaacagccgatttaaagtatgagaaaatgtgcataggttatatgcaaatacaatgccattttatttttaaaataaggcttactgcggccttgacctcccagcctcaagtagttctccagcctcagcctcctgagtagctgggactataggcgtgtgtcaccacgattggctaattttaacactttttgtagagacaaagtctcttgagtcctggactcaagtgatcctctcacctcagcctcccaaaatgctgggattacagaagtaagtcaacgtgcccaggcttacaatgccattttttatcagaacttgagcatccactaattctggtatgagtgggaaatcctagaaccaatcccccttagatagtgagagttgtataagcagcatctagataaatgtaattaaaactgtgtcaaactatacaaagaaacattttaaacataactaaagaacacaaaagtgcactgagcaaaaaagaaaaacatacgtccctacacaggaagataccatcatagaggtattaactctaccaaatttatatatttgatgcaatctcaataaaaataaatgttttaaaaatccaggtattagtccaaatactgtaataagccaaaacaaataagtatgaccagaaaattctaacaaatagtaaagacctgtcctaccagattctgaagcacataataaattctcaataattaaaacagtatgcaattagtaaaagaatacacaaaacagaatggaggttctaattccagtaatggcagagcagcctcaattaggctaactttccttcatataacaatgataaactctgaacaaaataatcaactatttgaaaatagcagacacagatcaaaaacagacaaaagctgaagggaggtccaactgtcaaagctgcaaactgtactggatgagagctgcatttctgtggctgtgtacccaagggcactccccagccacagctaggcagggcaactagaattcaaacagaacactgcaggggggttgtttttagaaaactgcagttttactgacctagaatcagaggacacatttggggctgccagagagtttgaaaaaagaaggaagataccctgtaaagaaagaggcacaagggaaaaacatcaacaatgtgactgtgaactctgcccaaactcaactttgctcaaagatattttttaaaagctaagtatatagagatacagcatattcacagatgagtcaatattaagatgtccatctgacctaattccctaatgattgttgcctatttgttttatatctattacagtgaccatttcagcaaaaatatttttgtagcaactgacaagctgatataaaatgtatatggaaatactaaggatcttgaatagcaaaacaatcttgaaaaagaattactgacccatggatgaatcttgggaatattctgatcaagagaagctgaacactaaagtatctacactgaatgactccacttatacgaagctctagaagtggcagaacaaattcaaagtgaaaaacaacagtaattgtttccagaagaaccgctaggaaagagtatgaaagaactttctggatgattgaaatttctttatcttaaaacactggtatatgcatttgttgaatctaactaaactgaatatatgatttgtgcacttcacctataaaaaatttacctgaaaaaaggaaaaacacaaaagaatgcaaagaaaagtaaaaaccaaaacagaaaaagtcccaacaaaaaattcatagaacaatttagcatatgatgaaggcaccctatgaactgatatggaaaggtctaaaatatgctactccctgtattaaaaaaggacaggtaaaaagatctgtaattactcactaatatatgcataaagacacacatacatcatggacagtagttacttgaggtgcagagtgggaagggagaggttccaatgtatgtgtatatgcatgcttgtatgtgtatacatacataaacatacgtatttttgagccatgtgaatgtatattgcctttcaccaaaattgtaaaaataaaacagaagaaaatattgccagagaataaaatgcaagtcaatgtcatcttgacacttctataaaaagatatggttctaaaacattagaggcacattacttcctatactgcatcatttaaagcgcagtttgggcattactataagagacaaataataacatgccagcctgagccctgatcattcttttctcacacaatgtcctttctgtctcacatgaacctttggtaccaattttcttccatgtgcaatttatgttaactgccccttcctagccaccttttaactttactactaattctttaataagtctaacaaacgaggtcaatttttaagatgcctttggtaggttttaatgaggcagttttaatcacccactcttccttaaagattctgtctaaccacaatgtatttcccaacaacaccctgagctcccaaagccctttgtgtaccacccagcaaacaacatatttggtgacccaactggtattttcatagtacaaaagtggattataatattccttatcacattaaatcataacatcctaaataacactggggaaaaactgtatctcccaggttttcattttgttaataaaaagtgtaagttataacttctaggtatggccagtttctaaaaaatattaaaagaaacaaatgcaggaaaaattttagagaagtagcactgattataacaactatataaaaagctttttacacattcaataaatttcactaatctaagattatctactttaaaatgcaacattatttgtgtaacacttgaaaatcctctttcaattttatttataaggggcatctcaaagtgaaaaaaatgtgcatcttacaaacaaatatttaatgacaattgtcttcataagctagctactttatatcaagcactgtgtaagactaaatggattagggacctcaaagtaacctgcaagttatgtaaaaatagtatccatcacctattaaattgatgttaattggaattttgtgggttatataactgagtataaatttgtcttttggttagcgttaagtttgcacttaagtatgtttctatacatttaaataatattaaaggaagtccacaagaaatgtctgtacattactcaaatgtgaaaaacagaaacctgtacaacatcaagctgtttacaaagtactaaggatagaaaataggtctgaaaatgttaaactaagactacttgctatgtaaaatcaacatatcctaaagagattattaagttattataacaatgatagcaatatcccaaacacattggctcaacatttcctaaatttatttgaccatctaacttcaggatattcttaaaactctcatgtattgaaaaatatcagcaaaaattggtctcataaattctgcctgaacaaatttgatactgtttactaacaaattaatgtgaaatattacaatatgttgaaataagatgtagcagaccattaactaactacaatgatgtccctgcatcaatatacagatgaacaagcatacgtatgttatctcacgcaaagtcccaaagttctttgcatggaacagtttcttaaagacagattatcccccatcaactgtgtaatgttcttgcttatatatctagcttaaattaaaaagaggtggggaggagaggcaaaacagctattaaagtcataaacatactaatatagcaactacctttgttggcatacagtatattaatcactaaactaacaggatgacttggtaataaacctaatagaaatccttatcaaatttccctagtaataacttttacaataagtatttcagtaaaacacatcaaagattttcttcatctaagaataagctgacttttgaaaactgaaattaaaatttaatatctagtgtacaatttacaaagtatacactcgcctacatatatacacatctaaattaacattttgcactttgttccaattatccagatattatgtttggtcaatttactactttttttgcgttaaggatatagatatttattcacatctttgttatggagaaagaaaagagaagcagtgaaaattaagttgaagaaaacactaccaactttgggcaaaaggtggctcgcatcacagaatctggtaaccctttaaaccagttttactgttcctaccatatctgcaagatttactgctgcagttagacaaccaataacaaaagtaataaaccccattgttttactaatttattatttttcatgatcttcttgcctaaacagtgtatttttttttttttttaacaaatcaaaagggataacaacctaagttgccaccttggtaagattaaaagcatgctgaacactcagtaaaattagtcaattagcagaatattatcaacaaaaggaactttcctaaggctccagctcttgattactgatctactcatttaatacagacttctaggggagtaatctgtaactatgcatccataattatttctacttaaaataatcctttcatttttatatgtgacttaagactaaaagtttagatttaaacagctcaggaatgaagagttaatcactgtaataatttttttaagtctccataattacaagtactatgtgtggctgtatattttatcttgactacaaatataattgaaagacacaaaatagattgtagtattcaattacaaatgtttaaatgtcatttatcacatcactgaaaacaatgtgactactttgattaaacttaaatttttaatcaatgattaagaatgatagccttttatttgcctcagaatccagtctcttccccatattttatttgcaaaatgtagacaatcctgattgagaaataagtaggtgcaaatgattttttaagttgctgcattacagatgcaaaaaactgtatctcttgaaaatttgagatattcctgaataaaaattgaaaatataaaagaaatatattaagaaatttatttcaaaaaggttgaatcatcaacaatagctaataagtgctcacattccttcataattaaggcataattgggcagtaattaaatctggagacagtttaacagggtccttaactggcttaaaccttcactctgtgtagaaaatgtttttcgattttatcttgtagcaatgaaatagtaaccattcaaaaacaaacagtcaccaaatgtgcattccggtatgtcagggtttcattctaagtttcaaatcagaacagagcatgtctacattccagatacccaagctgtacagagctctaagtagagctcaccacacaatggtgtggtactgttatttgtataattttataagaacacacatgaaacagaattttaaaaaataaactaataccaagtcttcctaatcggtaacatagtaagtccaaataatgtccagatatgtgaggaatagctttattccaaggtctttgatgctcatgtaataagtacaattttaacaactaattctattacaaaagactgcagaaagctctgtacagctggatccctatacgttcttaagaatcaagcaaacagcctgtgcaacaaagtgagaccccatctctacaaaataattaaaaaattagccaggcatggtggcatgtgcctgcagtcccagctatttgggaggctgaggcaggaggatagtttgagttcaggagtttcaggccacagtgagctatgacgcactactgcactccagcctgggtaaccgtgagatcccatcttaaaaaacaaaacaaaacgaaagaatcaagcaaacttttggagaggaatatctcagaaaagaaaaactcaacagtttctaagtatttattccaacttctcagatacttccatgaacaagctttccatcttctcctgagttctgtatgataaaaaatttcaaacatccattaaagttacgagtaagcaccctacacattgatcagctaaattctgtaatttggatttgttttcttttgctctctcatgtatctacttaacctctctatccatcccttactttttggaacattaaaaataagggtgtatgtgggcagcctgggcaacatggtgaaaccccgtctctatcaaaaatacaaaatattagctgggtgtgctggtgcacacctatgctcctagtattcaggaggccgagacttgagcccagtaggtggaggctgcagtgagactgcaccactgcactcactccatcttgaatgacagagctagaccctgtctcagagagaaaaataaaagctgcagataacacaaatctagacacttaagaatgcacataactagagttcgctgttctttttttctttaggttaaatttacacagcatgaaacacacatcttaatggtaccatttgagttttctcagatgcatacattgtacacttctcaaccctgtcaagatcatcacccatgtccatttctcaatgtctggcatccatgcgctcatccccagaggcaaccactaatctgatcttttcaccataggtgtcgtgtcttctggaaagtctatgtatgaatggaatatggtacatattcttttgggtcttttttgactcagcatgattttgagattcatccatgttaatgtatatgacgtgtgtgtgtgtgtgtgtgtgtgtgtgtgtgtggagtcgttttccattacttgaacaagcatgatttatttagtcattcttatactgatagacacctgacctgttgccaggttttaattattgtgaataaagttgtcatgaacattcaagaaagtacatatcattatatagaaatatgatttctttttttctcgggtaaacacctagaagtgaaaatcttgagtcagtggatagatgcatgtttagcttttcaataaattgccagatcattttccagagtacgattttacagtcctccctctttcaatgtatgagagagagctcctggttattccaaagcctcatcaacatttggtgtggtcagtctttaaattataggtagtctgatgattgtgcagtggtatttcattgtggtttcaattgtcattttcctgaagcctaccgatattacacatttttccatttctttactggacctttatcttcagtgaagtagccaactactgtccattttaaaattaggctatctttacattactgagttatagaaatctttataaattctagattcaatcctttcagaaatgttttgcaaatattttctcccactctgacttattttttaacaatgtattttaataatatgttttgtataccaatggagtctaacttagcagctttcatggtcactgctttctatatactttgaacaattctctgtttacccccaagtcataaatattctcctatattttcttataaaagctttatagttttagctttaattagactacaatttatccagaaatattttgttttcactggtgtaaggtggagtcatgttcattcttccacatggatattcagctgttccagcaccatttgttgaaagactttcctttccctactgggttgctttggcaactttgttgaaaatcatataggcacacagtgtttatctatgtggggctatcttatctgtttttatgtcagtatcacactatacagattactatggcttcaaggtgagtcttgaagtcagggtaatttaagtactctaacttattactgagttttccaattcacaagtgtatccatcagtttactgcatggtaattccaacatgtaggtcttctagggttggtctcctcattataaagggtcacattttctttgttctttgtatgttaggtaatttaggattgtatgctagacattgtgaattttatctgatggtagttagaggttctgttacaatcttccaaaagtcttcatttttgtttcaccagacaactaacctggttgcattcaaaccacaaactctgtcctggagcaattcaaatcaggctgattatctggctgtactgtctaccgtacacatgtgggatcagcaggtgattttggcaaagtttgtaggcagaatccagggctctctttctgaaactctccttgctgatattcactcctcactctccaatagttgtgattctcccaagtcttacctatggtgcttcaaggccagaaagacttggttttgtgttggaattttacctaccctgcacactttgcatggacaaaagctgtaaaacagaaaattcgcctacgccatttccttcttccgagtgtcaatcccctctaaaacatgcctatttttgtttattctccagtacttcatgttatttttagaattttgtgcagtttgttattgagggagtgtcagtctggtaagagcatacctggccatatgagaatcacaactccctcttcatttgtttaacttctctcagcaaggtttcagcattttaagcagaggtcattgtgtgtgtgtgtttaatgtattcctaagtatttagtactgatgctactattcatgaattttcttaacacccctatttgtctgctgctagtatttacaaaaatacaattgatttttagacactgaatctataaagtgcagccttgctaaatttactcatttgttttagtggctatatttatagattctttaggatttcctacataaataagcatgtcatctacaaacagaattttgaaacattccttcagatctttaaaccttttatattttgttttcctgactcattgcgcttgctaggtcttctattaaaataataaggacacaagagtagacatccctgtcttgttcttgagggaaaacacagtatttcatgattaagtaaatccttagctgttagtgtttcttaaataccttttatcagactgagaaagtctctttgtttctcatttgctgggaatgcttatcatgaatggatgatgaattttgtcaaatgcttttgaccaagtgaggtgatcttatagtttccctccttggttaatgcagtaaattacatagtttttttgtttgtttgtttgttttgcccgacagggtcttgctctgtcacccaaactggagtgtggtggcgtgatcactgctcactgcaggttcaacttcctgggtccaagtaaccctcccacctcagccttccaaataactgaaaccacaggaatgtactaccacgcttggcttttttttttttttttttttttttttgtggagacagagtcttatgttgcctaggctggtttcaaactccttaactctcaagcaatcctactgcgttggcctcccaaagtgctgggattagaggcataagccatcgcatctgacctgattaatttttcttttttcgggggtgggggacaaggtcccaatgtctcatgcaggctggagtgcactggtgcaatcatagctcacttcagccttgaacccctgggctcgagtgatcctcctgcctcagcctctgagtagctgaaaccacaggggcatgccaccatgcctgggtgggtaattttatctgtctatagaaatggggtcttgctttgttgaccaggctggtcttgaactcctaggcttaagcaatcctcctgccttggcctcccaaagtgctgggattacaggtatgagccgctgcggctggcttacactgattactttttgaaagttataaactaaccttgttggaatagaactcaattatgatgtattcttttctcatgtatgttagtgatatattaatctttaacttttcttttagttgcatctttgtcaggttttggtttcagggttatgtgagcctcataaaacaacatttttctgagtttattgtctataagattggtgatatttgttgcacaaatgcttaaatttaccagtaaaaccatgtgggcctgaagtttcctttgcaggaaagcttttgattatgaagtcaaattctttcattgttatagggctacccagatcttgtatttcttcatgcatcagctgggggtaacctaaatttcatcattacagttagtcatcaaatttaatggcataaaattgtttataatatttgcttataatctttttactgtctgtaggacctaccatgacaatccctctttcagtaccaatataggtcatttgtgattgtgggctctctgtctttttcttgatcagtctaacaagcgtttatctctccaaagaactcgcttttggctttctgatttctactcttaattttattatttcttctttctacttactttctattttatctttttaggtaactttctttcctagcagattatttaaaactataaaattttccattaggcactctttcagctacatcccacatatgtgatatgctgtattttcattataatttggtttgaaatatattttacctcatttttcccctgaataacccataagtcagaattttaaggtttaatttccaattcttaacagatgtcttattggtattaatttcttattctattggtggcagagaacatactttggatttcaatcttttaaaattgattgagacttgtgccctgtaaacagtctttcctggtgaagttaccatgaacacttgaaacgcttgtatttctactcatgttgggtttagtattctataaatatcacgtaggtagttaataatgtaacttaataatgtaacttaaaacttctatgtctttactgatttttttgttctaattgaactctccaattgtggatttgtgattctgtcccattaattctacccagttttgctgcatgtatttttaagttcctttattaagcagatacaatttattgttatgactccctgatgttggtgatttagatatatcactttacaatcttctctgttgctgatcacctgtcatttgtatgctgcgtgccatttttcaccagctgctttaagattccctctttcatgagtttgaccatgatatatctaagtgtggttttctttttatttatcctgtttgtgttgaataagaaatccaactccatttctgatacttgactgctgataggtttcaagccccaccatttcctcttccccttctgcctcgaatctgggcaagctggtaagaaagcccaggtgctccacctgttgatattagagaaatttcaaaccaggcaagtctcagcatatgtacagtgtaaaaaccagcccacagccccattccctaatcaccataaaaccccaagccagtctcctatcactgctctctcaagtcatttttggaccaacttggaagcctgccatgctctactcagacagcatcattatgtgagtaataaaccttttcatgccctcttggtgcatgtaatataggtgacatcatcagtttcacttcaaaatcaaattttatatataaaatcccatcccacatatagttcacacttattaagcaccaactatgtaccaagctcttacacatattaaaccgcttaatccttcaacagtgccatgaatcaggcactgttgtccccatttgacaaatgaggtaatggaaacacaaagtaacacgtctaaggtcctacagccagcaagtggaagagacagaggccacatttttaattattaacattattccgccccatatatagttactaaaaagaaacaagtaatataaacatagcaaatcaaagctaaaacaataaaactggtataatatcccaggtatgtaaaacatttacacaacatgtttaattataaaaactgaagatttcactgtaagagacattttctcaggaaagaaaatttctttggacaagtaaattgagaaagccccttccaaattaaaataagcagcttaggtttccaaatattaataactaaataaaaaataggcggagacaacagaacttccataatcacactcctgtaagtcacacagtcctataagaataaaattgacacttctactcatctttgatatagtatagcctttcttagaagaaggaccaggtgatgattgaaaaaaactttctcaatattttccacctccacctccaaatgctgttattaaaaactctactctgagataccgtttgatatttctgctgcccctgaaaaaacaaagtatctcccacacacaaaatagtctctactactgaaaagatttaaatatcaattctaaaaatggttgaagtatttcaagcccttccaaatacaaactttttacttaaagaaaacaaaagctaacactgaaagggttcaggtacatttactttaataacatagcttatcgattttctagatttagtcatatacacacacacacacacacacacacacacacacacacacacacacacacacatataccctccccccccaagacagtctctgtcacccaggctggagtgcagtggcacaatcttggctcactgcaacctccgcctcctgggttcaagcaattctcatgcctcagcctctcagatagctggaattatgacacttggcccagctaatttttatatgtttaatagacacaggatttcactatgttggccaggctggtctcgaactcatgacctcaagtgacccacctgcctcagcctcccaaagtgctgggattaaaggcatgagccaccgtgtctggccaatatatactgtttttaacaattaaaaagaaaaatagtaacataaatgacaaaataaatataaaatataagtacatgttattctaatcttaaaataagtgcataaaatctggaatacatggttggtctctgtatatgtgggctccacatccatggacagaaaatactagaggaaaaactagataaaataacaatacaacaatgaagaatacaggctgggcatggtgactcacgcttgtaatcccagcactttgggaggctgaggcaggcagatcgcttgagcccaggagttcgagatcagactaggcaacatgatgaaaccctgtctctaccaaaaatacaaaaattagcctagcatggtggcacacaattgtaatcccaggtattcaagaggctgaggtgggaggatcaccggagcccaggaagcagaggttgcagtaagccaacactgcactactgcactccagcctggacgacagagccagacgctgtctccccactgcctccaaaacaaagtatatggtgggggatgtacataggttatatgcgaatactatgccattttatataagagacttgagcgtctccaaattttggagatatggggtatcccaaggataccaagggatgactttacatcaaccataaaacaatgattacaatacagaatgtgattccatgaaattcaactttttaagttatacagttttataatgcttgactttgattgtaaaagtttttataatctgacaatttttgacaattagcatcccacaaaataaaaatcaactcaaatctgtatagcactctgaatgtgataaactgcttttatgcatagaggttatgtttagataacatgttaaaatgtttaggcaaatgtttaagcacatagattaatgttttatacctgtggatgcaaattatataaggcatcatataaaaattacaggaaaacccttttaaattacttaacttcattataaatttgtgttcagtatctctcaatgtccctatcatcctaaacataaatataaaaccttctttcattgcccccaaaccccgttgtcctagcaaatttcagagaaactatatctatatctatccatctatctatctatctatctatctatctatctatctatctatctaaccataaagataagcaaagttctaaaagacaaaaggctggggtgaaggagttagtgagaagtctccttatatatttcagttctaatttaagtattattagtgatcacagtttcataagagcaccaagaccatttcatagcgcttcccatcataacccaaagtcagagttaaaagttggattttgagagtaaagactaacctaccgcttcaaggaaaacgatgatgataatagaagaaaactgtagttgtaacatttctttgaaaataaagcatcactggctaatttaaccagtatcatgattatatgcaaaaaaaaaaaaaaagaaaaggcttttgttaaaatggcatgtatttcacgtagacacacgtaacatccctcttttctccccacatattcttcctgtccccagcaaccactaaatttggaattctcaattttcaaaaagaggatacagacagctcatgaaacaaactagacttagtgagctcccttccaccaccactctagtcattgctctccaacaagctcttcccaagctgcttttatcctgtctgcacaaaatcccaaaaagatttcaacacttcctagtcatatccagatatttgtattaacaataaatgtcttcagaaattaaaatccagccacagcaaagccaaaatcttactatctcattaattcttttcacgctacctcttccagtactctccagctattatttttaaggcccctcccggttctgaaatagcaggaagagggagtctgagagaaaaggggcacgatcttaagtggctggctggactgtaatctgatgtgacagtaatgtgtgatggagtcctgtggaggttggaagtccaaatgcagactctcacctatagttagttcctgatgcaggaacttctcaggcttgtctgcttggatcactgtgacccttcaaccaagtatggcctcttgatcctttcaaggtaagccaacttcaactattatgtcttactaacgtctactttgtccatgggggtaattcttccacctttgacccatcaaactctgacaaagtgctggcccactcccattgtgccctttcttcattctaccgatacaggggcagctccagcctttatctcactttttaggctttttcagatagaagtcaagtaccagtctatttatctctcaaacctcagcagacacatgtcaaactgagaagttctcgtcaagtccttcaaattggattaacaaaagggagaaataccttaacatatactactctcgccaaaaatcttttcactatggggtccttctcttgaactcacgatctttatacagcctacaggtgagtaacaggttttaactgtagcaatgcttgactcagggtgtcttttctgcatgttctgcatgaacactatagcacctcaattttgaatgcaggttactggcaatctactgttctcagatttggggtaaataccagatttggtaaataccagaacatttcctattataacattctgctatagttccaactccaggtaaaatataagcaggtcacagcagtccaatgttcttactagaggggaaaaaagggaaaaaaaaaaaacttgctcaaaagacaatggagagctatcaaactaatgagatccagatgaactaaaactgcagcaaagcagctttctaggtgaactgacaaatgcctatcacttcctcccctggagtcacgtgtagattctaggtgcaggctaaaggcttggtctgagaaaagaagctctgaggaataaaacagtagaacttttgacagtcacatgagtattccccctcaagacgcttatcagatcttaaagctgaggctaaagagctcatactttcaaagtcacctcatacttcgaaaaagtagaagtgaatctcccagtgtttcaggggttaggtgacagtctaacaagctttcaatcaaaatccctggagcgctgtttgcaggaaaggtataatccagtggcagactaaaccaaattaaaatggcagtctagccccacccagctcaatcgctaattagattaaggggagcttctctctatctacctggtaaaggtaggaaaggtcaaatactctggggagagcattatttgcaagatctttatgagtgaattttacataatgtacaaaacatatggcatacaataaaagctgtatgacatgaaaatgcaggaaaatttgagaaagaaaagaatggacaataacagaagcagaccaacagatgatccagacattagaactgccacacagaagactttaaagtaactattataaatatattaaggaaatagacaaaatggagaatttcaacagatttggggtctataatatcaaaggaacatactataactgaaggatatatttgaaattaagaacttacgtaggcttaacagactgaatacagcacaaaaacaggatcagtaaactcaaaagtagatcaacagaaaatatctaaattgaaaaagagaaaaagaaaaaaaaggaaatgaaaacaacagaactgtaagagacgttctgattttagcccaagtacaacagaagatttaaagcaagatatcctaaactgctgttttactattatctcacctctctccatagtccatgtgtgggtattgtctatctcaggcactttggatagtgatacatttacttatattgccagtgaggaccacacaggcctggaaggactctactacaagacaggaaggggaaggagtaaacagtatggtttttcccagaatgtagtcacataagaatgtcctgggtatgacattttgggctggatggtaaatactttaaaaaaaaaaaggcctgggtagcctagaatggttccaggtaagactggaaacagtcgggcgcggtggctcacacctgtaatcccagcactttgggaggccgaggtgggcggatcacgaggtcaggagatcgagaccatcctggctaacacggtgaaactccgtctctactaaaaatacaaaaaattagccaggcatggtggcaggcgcctgtagtcccagctactcaggaggctgaggcaggagaatggcgtgaatccgggaggcagagcttgcagtgagccgacatcacgccactgcactccagcctgggtgacagagcgagactccatctcaaaaaaaaaaaaaaggactggaaacagaccaaggatgttgggaaaacaaaagattactgtaattttttaaatgcctattttagctaggttgactctttcctgaagctaatatgttaaacaggacaagaaaagagggtatattgttcattgcatcaggtgttacatgataaaattacagaaattgattaatttaggtataatttcagtaatttttataaagggacaaaggtcctagggcaggtaggtattttccctgataaggtaagtgataaaaatgccccatgcaagaatataccatatacacaagggactttgaataccaggtcctggagcaggagccccctcaaaatacctaactgtaaatgtaggcaccagataaggtccagggcttagcaaagtgccttccaaagtgtgtttcacgtgatacttgacctcatcacaagtgctttcacatttataaactgtatatgacaaactggatgataaggctgataaaaggtccctattccccataacctcaaagttctaattcatatttataaagttttattgctctgactttatcaacaaattttatacatttaataaactaaattatacatcatgcaatgttgcctggcaaaaactttttctaagcagagacaatacattttaatgtctacaatttaatgtgagttctcctgaaaaacaaaaatagagaacgaagacctagaatatctgaatatttccaataaatcatattcctagctataatgttttatagcttatgaagctcatttacattatttcaatggacccaaaagtcatactgtgaaagtactcagatagcactactgcctttcacagctgtgaacagtaaaaaaagtacagtcatattccctaggatctacattcatcaatactaaagaagctgacacaaaaacaggttatcaaacttgaaattcagagttccctccaccatagtgtttcatacatattacgatacagacagacacacgcacatgcctatgtatgaatgagaagaaagaattatcctattatgaaaaagcagttgcttaagaatggaagaatactacagtttgggttcaaaaagacttctctttagctattcctggttacctagagaagcaaaagggtatgaacatgaggttagaaataaaagatgacagtttttttaatgacaactgctctattccaagacagtctgcataaagttactaattactctgatgtttaaaagtctgtaagaggtggccgggcatggtggctcatgcctgtaatcccagcactttgggaggccgaggcgggcgggtcacctgaggtcaggagttcgaaaccagcctgaccaacatggagaaaccctgtctctactaaaaaatacaaaattagacaggcatggtggcgcatgcctataatcccagctacttgggaggctgaggcaggtgaatcgcttgaacctgggaggcggaagttgcagtgagccgagatcccgccactgcaccgcagcctgggcagtaagagcaaaactctgtctcgtttctaagaggcaaaacaaaatccaaatgttaatggcagcattaaaaagaaacatcctggaaggacacatgaggaactagtaatacaacgttcactacagaggaaaactgggtgatgaaaaaacaggggtgggagggagactgatttttccaccgtataatcatggttgatttttcagttatgtacatgctactttatgtttttaagtaactttttttttttttaaagggacagactctcactatgttgcccggtatggagtgcagtggctgttcacagatgtgatcactgcacactagcctggaatttctgggctcaagtgaccctcctgcctcaacctcccaagcagctgggactacaggtgaatgctgccacgtctggctagaaatacactttttgaaggcaaaaacagtcataaacatacaaatatcagaatgctaaaaaaaatagaattgccttttaacagaaaaaactgacttcaaagaaaaaagacaagaatagtcttgtcataaatagacacgaattaaattgcccaaaagtcctatttaaacatttaattgtgctgactataaaagtgatatacttttatatataaatactagaaaaaaaaatacaggacttttctgggtcacccatactcattactaaaaatttggtcaattaatctctaaaagttcataattaagtgttaacatttttagaagtatgctttatcaagctaagaaaactcttatttctaatttgttaatatgaatagcaaattttatagaaagccctttctggatccatgatgatcataaagtgcttcttaaatatgattatgtggtatcttatactaatagatttcctgtagttgagtcatccttgaatgacaataaacattacctagacattttttttttttttttttttgagacggaattttgctcatcgcccaagctgcagtgcagtggctcaatctgggctcaccgcaacctgtgcctcctgggttcaagcaattctcctgcctcagcctcccgagtagctgggattacaggcacatgccaccacacccagctagtttttgtattttcagtagagaccgggtttcactatgttggccaggctagtctgaaactcctgacctcaggtgatctgcctgcctcggcctcccaaagtgctaggattacaggcgtgagccaccatgcctagttatgtttttgtggttttgtttttaataaaccactgaattctagtttctgatattttatttatgacttttgcatctatgtttataaagagtggcataaacttttctttcgctattcttgtttaattgtggtataaaataagcttaagtgttctttattaaagaaactaaaggttaggactgggttttttctaattcatattaaaaacaatacagattccaatggactggtggaaaaaatgatactgaaacaaacatcaggaatctttgacaatattctgattatttccttgggatgaaagatcaaaaatgtgattacatggtcagagtaccaccttaggaaagtccttttaatttatgcttatgaaaataaattttgcattcctatacatttatgtataatcaatattataaaatagccattttagaccccatagtccttacttttaactttacagacctccatccccactgcaatttcaattttgctttactgtggataataatatattgaaagctttttccttatgtctgattctttatctaaatatcaattgccattctgatttcacgaccaagttgtctcccatccctcggactcaaaaatgtttgagatgaaaaagcttcctgaaattttttattatttagctcactgcagcttttattgaggttaagctctacctataaattactctgtgtcaccacagaaaatggtgggaagggagcgacagtgacgtatctataactacagcttttaaactgccagaggcaacaagagtaatgagatgaggggagtgggagggacacaaagccaggactatgtttctgccctaactttaaccccactctaatattaaggggctgaaagtagagaggaggaactgttcagtaaacatttcaacagaaaacatttgccatttcttaaaattaagcaatttgtttcccgttcttcatcagctgaacttagttgtattttttggcttataaaaccataaaggcactttactaacattttacttgaaattctgagtaaacgtgcttacaaatccattgtgtatcacattttgaataattctgtttaagctaaggtttggatttagccataacaaatcttttccatcccacttcccatcttttacactctacatataaatgagttccctgaattccaactaaatttcttacatttaagaatatttagttgttaagaaatgactaataacctgacacaatttaattgttctactactaaaaacaagctttataaaatatatggcactaagctacagtgtgtaaaaagttaaaatttttttgatagaccatgatcaataataacaaatctccatttttgcaacatctaaaaaaaccaccaaattaggcaaatttctacgcttcaaggaaacttcaatagtgaaaaacaagataatggacaattatcacttcaacttcattaatcaggtgagagggcagaaaaaaatgtttttaatgatgaagcagctccagaatatgagctctcagagatctctatctccaaaagaggctgtaaaaagaatgggaaataaggaaaagagctatgactaaggtgacctcctccacaggttaaataccagcaatggccaattttagtactgctgtacctccctaaaagattagactctctcaggctctgctctggataacctcactgcaatggcaacttgagccttgttgaagttgtgcaaaaacatggctctatctctgctgtatcacacagctcccttcaatcaagtgataccagtctcccggcctccattcttgacagcctcaaggagttttctcgctgcaacccacgttgcacttgaaattaatctgacttctgagccttcagaccctacggcacttaaacggccccaacctcacccgtcaccctcaggttaagtgtgaacactggcacagcatgaagtgactccttactacctatacacactatggccatttgccaccccttactttatactctaaggatacccaacttgtttggaacgcttcaccaatcctcccccacctcccaatctccacaccaccgcactacatgtgatgaaacaggcttctcctaattcctcctttaccccgctcaactcaaaatcaccagtattcctccagaaggaaactttccacaagcctcctctggatatagccccaagcatacttcttttataacatctaccaagcctcatgaaaccatctttttctaagtttatctcccttactaggaagtaagtagtttaaaagcaaacactgtatcttaactccagtgaggaagagcacaccaggcacatagtgggcatatgataaatggttacctaattgaaatcccaagcactacacaatgaagaatgaaatatagcttgacttctcagcccattcaccaggaagtcctcagttccacttctaaaacccatgccaaatctgtttacttcgtgtgctagcacagccaccacgccagtccagcctctatcgtcttgcatttagattcctcacagcctcctaattttcctgcttccatctaccctactacacacataccactctcccgcagccagaaaaatctttgtaaaaatatgtaagatcctctttaaaatccatcagaataaacttacttgcatcctgttatattcagactaacattcaaactctcaccacactctaggatgccctgtataagctttgggcaagtcttgtcctccatctacactgggctccttttaaatattctaatacaagaagctcacctcagtgtcttcactctggctcttccctctgcctagaagactcttccctcagttggctgctgcttctccaagctccacgcaagcatcacaatccgacccaaagcagctttttaattcttcattctatcatatcactgcatttggttgtcttctttgcactcattaccatatcaaattataattaatttgtttacttgtttatcgtgtatttctatcccttaggaaggcaggagttttgtgttttgttaatcactgttatcctcatatgtctagaaacagtgccttctacatagcaaacactcaataagcatttgtaaaacaaatcaacaaaccaaaaaagcaacctttaagatatacataaaacaagtaagggaaagaaatggatggtctaccaaacaaggcaagaaacattctactgttagtatttgcaactagacaggctgcactggtgttattgggatctgttatctataagcatcaaaagtgtacttctcaaagttcaaagtcaagtagaatggtttcacatgctatatgctagcccacggtatgacactgcaaactatcattttagagaattcttacatttaacaatctccccaaaatctgtaatgtacacaagtagtaaaacacactttaaaacacctgtcacttaattaaaaaacaatacttatgacagtggtacttatctgtaaatgattaaatttatcctcagaaaacttcagacttttaaagtaacaggtcctcctaacctaagaggcaggtctttaagacaggttctgactaatgcctacaacaattaagaagccacctaacacactattctttcttggaagcaatgctgcaacgcaaagaaaaaccatataaaattcattaaaaagtgagcagcctcttttcacccctgatgaaagttttgactaaaggaggagaaaactgtaggttgctactatgttagtgatagaaaaagcttcaattctttattcaagtatcattcaatcacggaaatgaggataacatacaaatgtaggcaatgaagataataaatctaagtatcttatttagcttgattaaacctcactattcaagaaaataatttataaaacaagtcagctagcaaaaacaatttatacaaggttaaaaacagtcatatttcaatcatcactttttacaggcaacttgaaaggaacacaaattcagtaactttccttcagattccttgacataatttgatcaaacctgggatctaacaaaacttaccttggtatggtaacacatttagtattacagttttgagtggtgatggctttctcaagctcatctaatcgtcctgttttctttagcttcttcaccagacttttcactgctttctcacaccacttttcttcctgcccattctgctctcctccgcctgctcctccagacccaccagctgacttcttccatcccagcagtctcttcacaactggcggcgtgaatggcaagatggacgacatgttcttaccaaaggcagcaagccacgctaggaaaacagcctcttgtatcgaacctagcagaaatattgaaaggatgatgtagagactaccttgaacatcaagtaataatttcaacttatcatagaaagcaaactgcaaagcaagatagaaattcgaattatgactttcccaatagacttctccacccatgaaaacgttatctttatgaatttaaatgaatgatggaaacaaacccttctaaaaacaagaatgttgtaaggactcctcttgtgggaaaatacagtaattttgcaagtaaaatcagatacttttaacgatttttcaccaccaatactattttaaactcttagtagtgtcaattaaaatattttcacaaaaggttctcttactttttagaacttcactctaatctcaaaagactatacaaaaatacattgaaaatttgtaagcccactctcccccgggttttaaactttcataactaataggaggcaaaatctacagttacaagaagggaaaatgcgtaaagtgtgaagtaatcaagaataaagaaataaacatggcaaacagagtccgtggagaaaagctgtagtccggtttcacctgctcttgagagaaattttttaacacatgtttttttcattttcatctaaataacaatttgcatagtgagtaaagtcagatagtttctcttcccaatttaaggaattgtaccttgtcttttctcttccataggaatcatttttattaagctgttttgtctattcagcgtcattttacaaatataaacatgtatacatacaactaaccacattcccaccttattgctgtacaaaagtagcataatattccttattttgtatatcttgaaattatttttttatttttatttttttgcttaattccctgtaggtcattccttatcagttcacacagaatttagaaagcactgtcccctcaattttctagactccactactgatactggtaagtcccacataacttttattcctgatcctttaattggggtttaaaaattgtttcgctccagaagctcttaatatcttagctcttacgcttttctttcctttgccttcaattttagtgagatataggaaaaaggaaaatgaatgtgttcaatttgccatatttaataaagttcccaaaaggcatcctttttagaaagtaaagaggtctgtagtctttacatcacacaccccaaatactgaaattgtagttttcaaagtgtatctttaagaaaacaatgatgcttacattttcattagtttgttccttaattatcataatgatcagacaatagtttttaaacgtagaggaggaagtacaagttaaaataataataaggcatcatttcatgcccaatctagctggcaaaaattgaattaattaaaatacctactgctggagaagatgtgaagaaattgttatcattccacattgctggtgaaaaggtcaaatgtgacagctttattctaagtaatctggcaatgtgccacgtgttacaactagtaactggattatacgtgtataaacaaaaatctaggatattaatatgggttgcagatataccaatatgcagaaaagggggtgaaaagatgaaaaaggctgaatgatatggccattgtgtatgtttttgtgtatgtgtgtacaaaaaactggataaaacatttttaaaggaaaaaaacagtttttaagcacactttgcacatattcttaacgttaaagaagatcctaacacaagatgcaaatttatttcccatcaaagaacatggctaattttcatagattatatgctaagattcatttccaatgtacacaaactgcattcctgctctaacctctccataattccattattttggtttgcaccacatggaagaataatttttttttttaaatattccctcttctcaggatggtcaatgactagtgaagaagactgccatgattaaaatacacatgacaattaagagaaattgcaagggggattacaggtacacaaagaaacaccatctgattttgctttaggcgtcaggaaagattttcctgaggaaatatttgcacttccttggcagcttgccatttattcattcctttttgcattcaacaattttttttttttgcctgtctattgtgcctgtatttacctgtttattctcaaatccagtctgtgttattcatctgcaaactacactgttgagctgggacgggtaggacaaaagaaatcctttgtagcaaggtattggcagtggggaatggagaaggggtaagtttttaagggcagagagatcaaccagcagagaattgcaatacacaaaaggaagaatagctattagggacatagaaggaacagagttgattaagaaaaagttacaaattacaggttcttgcttgaaaaaccagttgaatgaaaatacaattcgccaaaatacgaagtatttggggaacataagtgttgtgttagtcaaactaaatttgctgtgactatgaaattccagaaggaggtgcccgataagcagctagaaacaaaggtttggagcttagcagagagatcaaactgtcatgtggtaatgaaacgcaatgctggtatatgggagagctcagaaagcgccaagttcagtgaaaaaaaaattctaagaaatacatataaaggagttatcaaatgtggaaaaaaagtggatgattagggagaaaggtgtcatgaatacaaaggacaatttatagcaacacaacatggtaacacaacttttaagtgccaacactaggatttatatcaagcagcatgatgccagagaacaagtacttaattgtgtcaatgcattgtgttgcacataacaatctgaagctaatctggagacctaaaaagagccattaaaggctgagctctttatacaatcaacagagctatctgtgcctgacaaattagtccattagataggattagaatgacacatttagctccaactcctttctcaatctacaaatcatttaactagtctttcagtcaccaccttctaccttctttgatgcaaacagctttctaaaatgcatactgcatgtcaccctactactaaaaatccttcaatatttgcaaaaagtaacagtaaaatgacttaatatcctttaagaacccataaacagtgtaatgcttcagagaacagattctgaagccaattggccaggttcaaatcccaaggatgccacttactagctgcatggcaacctctatacaccccagttttctcagctgtaaaataaggataacagtacctatcttaaagccaatataacaacctctataaaaatgtaatatgagctacatatgtactttaagttctctaatgacattttaaaaagggaaagaaaataggcaacattttaatgatgtatttaacccaatatatccaaaatgccatcatttcaacctgcaatcaatataaaaaaaattttcatactaagtctacaaaatctgttgagtactttacacttacaggacaactcaactaggactagccacatttcaagtactcaatagctacacaaaggtgctgcctacccatattgaatgatccagccctaactactcaaaatttctgcctactctgcctatcccatattctccataaactgttcataaatgcctctatttaacggctgtaggatccgtagtgatgtgacatttttcaattcctattatttaaatttatgttctctctccccctccccatcctccttttatcagttttgctaagtggtcaattacattaatcttttcaaagaaccaactttttcttagctttgtcaattttctctatgtaagattactttctattcactaatttctgctcttgtcttcattatttctttacttctactgtctttaggtttgatttcctattccttttctacctccttaaaaaagctttcttttccaatgcatagacttaaggctataaatttcatcttagcatttcagcagcagcaatctagatcattgtagttcaccttcattttcaatcagtttaaaatattttctaatagccatcataaattcttattttaagtcatatgttattcaaaagcatagtgttttatttctaggcagctaggaattttctagttatttttatttactataatacaaacaacatattcaattattaaaatcaatgatatttgctgaggctttgttcatggccctagcttatggtcaattctagtacaatttccatgtgcaagggaaaagatggttaataccaccattaatagtttcaatgttctacatatgacaattagatcaagcctgctaattgtgatgtatgtatgtcctatatatgtgcatccattgtgatggcatatttgtctgtttcttttagttcaaaataaaatttttggtttatagatgtttgggctattttactgggtacacataaaggattgtggtaactctggtggatcaatccccttacactataaaatgtagttctctttttctactactgtttattgtattaaagtctcctttgcctgattggtatagccacacttatttccttcagttagcatttggatggtataccttttcgcatcattttctctcaatctttctaggtacttatatttaggtaattattatttgtccagtctgatgatttttgccatttacttgaaatatttagcccatttccatgtaacataattactaatttagttgcctgcttgttttatattttctttcttgtcttcttctgaatttatcacatattctatatccaatttttttctgtattcatttgttacattcttttcttttagtggttaccctagatattttcttattcatccttcacttaacacaattttcatacatatacttttactacttcctctataatgccagaatcatagaacactgctgagtagcagttttgctatgaaggagactacctctggtttgtccctgttcctaggatgagactctgcagagccttcatttcaaaagctagcagatcgttatcttctaggtacctagatactataagaattgctttgtttttaagagacttctggtttagctctctagcctaagcagcttcagaatttggcaaatgtctacgggggaagaaactgggtgtgttgaaaatcatcagtgtgtattcaccacttcctcaaacgctttcaactctcacctattgttctcaagtcgcttcccctagagaatctttatctcaacaccataggactagaaaatatcccaatctccttttctgagattttggtttatctcttccgcccagctgaactacagaatttaggaatatactgagggcgttctctgtgtttaaaggcccctcatatttccaatctgccactcaggctgcagcccaaaggcctcctctactctgtacccaggaaaaacaatgatcagctgcagacctctcagctcacttgtgaaaggtattcccccagggtgcaaaattttgctttctttaatcatttttacacccattgttctctatcgctaaatatataaattttgtaaattacctggcttttctagttgttttattaagagtcttggactaccaagaactactgcatcctatcccccaaaacgttctaattccatttgaatagtaagtcttccacaactataaatctatgagttgaaataatttgttgatgactttaatttcaaaataagacacaagatcacttaccacttgaggacagagatggagagttaagatttgagaacaggaaaaaatagagaaacgtagccctgagaaaatcaaccattatgaaacaacagaaaacgtgtcagttatgtattatcagactatatacttaaaaagtattccatagaaggaattccacttctgattaggacgtagaaagttacaacagagcatcactttcattctaataatcaaaactagccagataagctacaaaatcatggtctctctgaaccagagttgaggatacaaagcagcctaagaagaactaaattccaagtgttgagccttgagagaagagaggctgcatggatggtctctttcctggtggagcggctagtgaggaataatcctgccataaatgaaagaaagaagaaaccagcctacatgcacaccgacatgacatattaaattgcaaggatcccacagagcaagtgtgcatccaccccaaccactcatccccataggtttccactaagtacttgcaaaaagtatgtcaaagcttggggaacaggactggaaagctgagggagatcccctaaggagcttaagatctcccataaatgcaaaaaatctaccctcatcaatgggggatggggggagggacaggcaagaaaggtgagaaaaagatgatcccaagagagtctagacattgagctgccaagggctgcggtaggacaggaaagatgagaaaactttcacccagatactcaggacattgatctaccgaggctgaaatgagtagcgaacttgaagacagggtaggattgctaaaagaaacctctggaaggtattaatagcagaaagatgtctcactgggcacaaaagcttggaggcaggactagagaaagagggggtggggggaaagaaaataagaatgaccaaggaattgacagctgagctatagagaaatttctcatggttcagaaagctgacggctcagctataaaccaaaaagagatccaaaatcacacttggacaaaacaagaaatgatggaccattttctaaaagtaaatattatttacttcaatctccattgtttttatacaaatgttcagcattcaatcaaaaattacaagatacagggagtagcaaacagtcaaaacatgaataaaatcagataactataataaaaatgctaaagaaactgatggaagagatagcaacatgaataatgaaaaaacttcatcacagatatcaaagttacaaaagaggatcacaggaaaacgttagaaatgaaaactatagtattagaaattaaggataccattagatgggcttaacagaaatgagcagtgaacttgaagacaggccaaattaaagtatgcaaattgaaacacaaagagggaaaaaacagtgtgggggggggggggactcagaatatccaaaaccaaatgtcagttgggtttaattggggtgccagagaaagatgaaagacaatggggaacaaaaaaatgtatgaagagataatggccataaacttttcaagagatgacagatattaatccacatatggaaagaaaacacattcatggtcaacctgctgaatattaaagataaaagtaaggatgaaaggccgagctaggataacagttaaaatccctgggagtcctcgatagaaagagaatctgcactcattcacaagctcttttccaagggcctcaactgagtgctcttgaaaaaaggcagaaaacggaagagagctccttcctcccatttggtggcatctcgtatgaagcaaatgccttcaactatgacgggagaggcaggaaagtctaccaaacccaagggcaagcaaagatcccctgcctcaaagggaagggtagagcaaaagacatgtgctgctgagttgggggatttgtggagcaaaacttacttgcccatctcccacacacaaacatgcctttcactctgtaacaataaccaccatattctactgccacgggaagggaggaaacattgctaccaccagtcccagacaaaggcacacagatgctgaggaatgagaagcaacagctgtctgatactgaaaaagggacaacaagccggcttgggcccaagatcccgtactaatacacagcaaaggtctgttactactagatgcaaaaatcctaaacaaaatattagcaaatcacatccagcaacataatagaaaaggtcatcatcactaagtaggatttatcccaaggagcaaaattggtttaacattcaaaaatcaagcacctcatttatagtacaaaggagaaaacgcacctatgattctctcaaatgagcgagaaaaaaggtatctgaaaatgttaattcaacactcatctataatttaaaactcccagcaacactagaaaagaatgttcttcaatctgaaaaggacatctatgaaaaacctagagctagcatatgtcataaagaaacattaaatctctcccttacaactgggaataagacaaagatgtccacggttaccctttctattcagtaatgcattggatattgtagacaggacaactatgcaacaaagaaaagatagactggaaagaaataaataaaactgactttatattctacagtgatatgactgtctccatggaaaagtgcatggaatctacaagtaatctacttactggaactagtaagtaaatttagcaaggtttcaagataaagggtcaagatttggaaaatgaaatttcaagaaatacgcttgaaacaacagatattttctacatatctaaagaaagatactcaagatctcaacactaagaattacaaaatattgctaagaaaaatgaaaaacactgaacaaagagagatcatgttcatagacttgaagattcatattgcttaaatgtccattctttccaatttgatatatggattcaatgtaatccctaccaaacttccagcagagttaagcaattcatatgatataaaattcatatggaaacaaaaaaaaaaactagaataaccaaaccattcttgaaaaagaaaactggaggccttacaccaccttatttcaaggcttactaaaaagacttagtaatcaagagtatagagtaggcataagaaaaaaagatcagtggaacagaacaagtctagaaatagacccacacatatacagtcaactcattttccagtaaggcccaaggtcaatctagttttcaacaacttttcaacaacatggaaaataacaagcctcaaccacaagtgcataccatcttcaatgggaaagcagaatcttaagctcttagaggaaaacacagaatacattcatgaccttaaaacataaaaagcattaaccacaagagaaatacagttgagccacgcatggtggctcacacctgtaatcccagcactttgggaggccaaaataggaggactgcttgagctctagtgttcaagaccagcctggacagcatggcaagaccccatctctactaaaaaacaaaaaatacaaaaaaaatagctgggcgtggtgcctcctgtgctcccagttaggaggctgaggtgggaggatcatttgagcacaggggtgcggaggctgcagtgagccaagatcactccattgcactccaggctgagtggcagaacaagaccatgtctcaaaaagaaaaaaaaagaaatagaaaaagaaaaaaaaaatacaggctgagcatcacaaatccgaaaactgaaatctaaaatgctccaaaatctgaaacttcttgagtaccaacatgacacccccaaaaaaacggtcattgtactatacagctataatgcaaatattctaaaaattggaaaaaatctgaaccacttcgggtcccaagcattttggataagggatactcaaatctgtgtatgtaacataaaccaacaaaatttaaaaatcacacaaaaaggtaagctcagcttttttgttaaacaggaaaagaataatagacatgtcataaaagacacaggagcacatgaagaggtatttagtatcaccaatcatcaggaaaacgcaaactaaaaccataatgcaataccatttcacaccatctagaatggtttaaaatttttctgacactactaaatgttgatgaagatgtggagtgtattagtatactactgctgctgtaacaaataatcgcaatcacagcacaaatttagcaaaatcagtttcaatgaactacagtcacagtgttggcaggactgattcctcctggagtgtctgaggggaagttcgtccttgcctttttcagcttctagtggttacctgtagtctttagcttgtgctcccttcccttagcttgtgctctctcccccaccttcagagcacatcattccaatctctgcttccatcgtcacactgccttctcttctgtattcaaatctccctctatggccttctagtaagagctcttggcattacatttaaagcccacccagataatccaggatcatctctccatctcaagatccttaatttaatcacatctgtaaagtctctcttgccatataaaacaacattcacaggttcttgggattagaacctgaatatctttggagaccatgattcagtctaccacatcaagcaactagaacattcataaactgctgaaatgaaagtataaaatggtatatagcacaattggaaaaccggcaagttccaaaaagttaaacatagatctaccctgtatcacacattcaggaaaaataaatacgtatgtccacaaaaagaaacctgtataagaatgttcatagtagccatgttaataatcgccaaaaactaaaaacagccaaaatatcaaaagaaaacaaataattatagtgtgctcataaaaaggaatactgctcaggaacaaatatgaatgagcttatacactccacaacacggatcagtctcaaaaacatgctgggcaaaagacaaagaaatatagactgatttcattcatggcttcccacaacaggcaaaactaatctaatgacaagtcaagatgaccatctcagaggcactaaggaagagaagtggaaatgtttggacagaagcacaaagtacctttctacggtgacaaaagtgttctctatctttgttttattccctcgctcctgtaaatccactgttgaattcctgaatgttttctatcttgagaggtaatcacacatgagtacaagttaccaaaactcacagaactggccgagcccagtggctcacacctataatcccagcactttgggaggctgaggcagacagattgcttgatttctggagttcaagaccagtatgagcaacatggcgaaaccctgtctctacaaaaaatacagaaaaaagttagccatgtgcatgtctatactcctagctacttgaaaggatcactagagcccaggaggcagaggctgcagtgagccgagatcgtgccactgcactccagcaccctgggcgagagagtgagactctatctcaaaaacactcacagaactgaacatttgaagtctgtgcattttagcaatgtaaattacaattcaaaaaaatttaaaaggtgcctggacaaacacattaagaagttcctaaattaagttaaatagacttctttactgaagaacttctcaaaagcttcaacatgccaatgcacattacaaatttcagaagggaggaggttgcaagtgaccaaagatgtaagcttggaagtttccgtccacaacatgcagatagcctctgcaagtacatgtaggcaaatgttcgtggatggagggtggaaggggtattgttttgaggacaaaaattgagagcccaaatgacagccatcacaaacatacatgaggcactgacaaaatggttgttgtaacagagctatataattgacccgtggacaacatgggtttaaactgtataggtccatttatacacagattttattcaagaaacattgcaaaatgtcttggagatttgagacaatctgaaaaaaactcataaaccaggtagcctagaaacactgaaaaaaactaagaaaaaggtatgttataaagcataaaagatatgtagatactactctatcatttaccatcatgaaatacaaaaatctactataaaaagttaaaatttatcaaaacttacacaaacacagaccatacatggagccatttacagttgagaaatgtaaacattcagatgaagtattaaatcattaactacataaaattaacggtagtacatactgtactactgtaataatttcatcgccacctcctgttgctatcacggtgagcggaagtgttgcgagtatccactgtgtgaggctaatcatctctgcatgagcagttcttctctccagtaaattatcacagtaaaaagtgatctctcacatttctcatgtaattttcaccatgtgtagtgcaataccataagccttgactaataccatgagatccatacgatgtgccactagtgatgctgacagtgctcccaagaagcagagaaaaatcatgacattacaagaaaaactccaattgcttggtatgtaccacagactgaggtctgcagctgcagttgcccaccatttcaagataaatgaatccagtgtaagaactacagctaaaaaaaaaaaaaaaagaaaatttgtgaagctgccactgcagctaggccaacaggtgtgaagatcttgcaccttttgtgaaacaacttttgatctcatattgaaaatgcaggttttatgtaggtacaggattgctataaagaaaggcgtacctatagactattacatggtttgagaaaaagcggagtcattatatgacaacttaaagcaaaattaaggtgaaggatctaaagctggaaaatttaatgaaatcaaaagatggttgagaatttagaaacaggctggcttaaaaaatgtcaagataacaggaaaggagcttctgtcaaccaaagtagatgagttagttcctaggcaccattaagaaaatcactgaggagaaagggtatctgcctgaacgggtttttaatgcaggcgcaagtgctgtattctaggggaaaaaactgccacaaaggacatttattagcaaaaagagaaacaagcaccagatctgaggtaggaaaggacaggctaactctactgttttgtgcaaatatgtccaggtttatgatcagcactgcccttctctataaagctgctgacctccaatccttgaagggaaaagataaacaccggctgccacaacaaaaaggccagggcaaccagaacgcttttctctggattcgttccatcaatgctttgtccctgaagtcaagtaccctgccagtaaaagactgccttttaaagttcttttgacattggacaatgtcgctggtaacccacaatcccatgattccaacaccaaatatgtcaaagtgatctacttgtccctgaacacattaataacatctctaaatcagggagtcataaggacctttaaggctcattacacacagtactccatggaaaagaccgtcaatgttacaaaaaagaactctgatagagtgtcatcaaagtatggaaggattacgccatggaagatgccattgctgttatagaaaaaaccatgaaagccatcaagtccaaaatgatacattcctactagagaaaacagtatccagatgtgcccgacttcacagcatttacaccagagcctatcgaggaaatcataagagattgtggatatggaaaaaaaaaaaaaaaagtggggagtgaagggcttcaagagatggatctttttagagaaattcaagggctaacagactccacacatcagaggaattaacagaagacgacgtaacagagatcagtgcttctaaactagctccagatgatgaggaagaagatgcagaagaagcagtgccagaaaacaaattgacataggacaatctagctatatataatatagggttctaattattgaaggctgcttttgacttcttttataacacagatccttccattacatgggcactgaaactaaagcaaaaggtgtaaggaggactggtaccacacagaaacatttttggagaaatgaaaatgcaaaaagtcaggcaaaaattgcttattttcataaagttacactgaatgtgcctgactcccagtctgcctcttctacctgtgagacagcatgaccaaccactcctcagcctactcagagtgaagacaatgaggatgaagaccttcatgatgatccacttccacttagtgaatagtatatgtattttctcttccttatgattttcttagtaggtttcttttctctagcttaaagaatacagtttatcatgcatgtgacatgcaaaatatgggttaatcaactgtttatgtattggtaaggcttccagtcaacagtaggtcgtaagttttaggagagtcaaaagttatacacagattcttcactgtgcaggacagcaccccaaccaccccattgttcaagggtcaactgtatatttactaaaaaagaaacattaaataaaagctcaaaaaaggactttaaattatcaaaagaatgttctcaaaaaaggtcctcaaactgaggatattcagcccttggtataatttgctagaaaataatggccataactgccaggcgtggtggctcacgcctgtaatcccagcactttgagaggcagaggcggttggatcacgaggtcaggcattcgagaactagcctgaccaacatggtgaaaccccatgtctactaaaaatacaaaaattagctgggcgtggtggcgagtgcctgtagtcccaactactcgtgaggctgaggcaggagaatcgcttgaacctgggaggcagaggttgcagtgagccaaaaccacgccactgcactctagtctgggcaacagagcgagactccatctggaaaaaaaaaaaaaaagaaaataatggccataacctaatataatcatactcacgcccctcgaaacagaaaaaaaatcaatgcatcctcaagctcaattcaggagactggccccaaggcctccctccaggaagaggcaacacagcatgccaaatttcataaatttcataaatttggccatgtcaaccctttttagggatgtatggaatgccacataacaatactgcattggcaaccttgggagtccaactagggttcaaacactaaaaatttgaaaggagtcaataataggattatgtaactttctttagcaatatagtagaaatggtgggaaagtgaggtttgcatagaattagggaactgtaatgcaaataaaagagcaacagtgaacttaacagcccggttaaactgtctatagtggtagacctataatacgacacataaataagcactgtagtatgtaacttgataaaataaagcaaatacacaaaactccatcaaacgcatgtaatcatctaccaactaataacctgggactatcaggcagcaaaaagtgtacttggctacctttggcccctgttggattcctactctgtgccacaaagtatgctctagaggagccaactacagacaccgtagtatcatgtgacacagtcttatcctagcacagagaacaggattcaacctttggaagggaaaggtgacactaaagttgacaccagagcacaagtattgagagagatagtacagcaggcagaaagttcagcatgttttctaaagacaggaaacgttttaggagagacgaaaaatttaggttatcactaaaatacggtgcacaggaagcactgtggcagaagatgaggggaaaataaggccagtgcagattaaagagctgaagacagaaattactgctaatgataggagtattacttcatttattccagtgacaatttgcattttgaatgacctactggacgtgcagtttagggaaaaggattgaaacacaactaatgtgaccgactacctaatgtaactgagtggcatgtaatggtacattcatcactattaggaatgaggaaagagaagcaaccctgaaggctaaagggtcagttttatacatgcctttatgtaagtaactatgttcatcacatggccaggaggcagcataaaatatagtagactcaggggagctagcagtcagtgtacaagtaagagtgtgtgccagagctaggcagagacaactggtgtcttgaagaaaagcagagcagccaatctctaggcttggtttctgaggactgtccaggcctgttccagctccacaattatatcctcagaacaaaacctctttttgagttagcatgagtaatctctctgttccttgtgaaaaactgatagaaaaagcaaaataaaagaatctccctacaagtatctgtatctttggttcaattattccattcataagaatttagcctaaaaaaagaataaaaaatgaaacttctgtataaacagcaaaaaaaaaaaaaaaaaaaaaagggatttccagcattaggaggaatgagagtaaacagtttctgtaacactttttttttttgaggagtttcactcttgttgcccaggttggagtgcaatggcgtgacctcagctcactgcaacctccacctcccaggttcaagcagttctcctgcctcagcctccggagtagctgggattacaggcacgcgtcaacacgctcggctaattttttgtgtttttagtagagatggggtttcaccatattggccaggctggtctcaaactcctgacctcagatgatccatccgcctcggcctcccaaagcacagggattacaggcatgagccacagcgcccagcctgttacactttcgttaggagaaatgtttcttatgagttaagctgtattcctggggatctaaaagttttctataaaacctttacaatattgtttcttcactgaaatgaaactaacttaagtttaggcctattctgggtcatctgaatggccacatgacctggtattgccacatgatttcagtgtcccatgtcttacaagaggagttaaaaccattttggaactaagtgaacacttaaagttgccagccttacctttgcatgtctcagtaaccatggttggctgacatctgtctaatatctccggagaatttttaaattatgtaataaaataacatttgttgtaagtaatgctgataatacatcttcaattagttaagcttttattttaaaaactgaagcatttttagccaatatttttgaagtgtaaatagactgaatgtaggctgacaaggaacagataacaatgtgttccaggttaaaaacaaatgaaatacaaaaaagaaaactagatttataatcaagttgctatcaaaacgtgaatgagtcatttacagaatatacagatttccttcaatggtgtggcagcaagttctctactgaaataaattttcaacatctgcaagaattgaaatctaagttcagacactatttctaattccagcaataagtgatacttacataatgcagatttcaaaagaacacaaagactatctttacagctgaataagtcagcttaccaaatgataccttagtaaaattaggattctacgattactcaccggaaagtttcaataaggtaagaggtctaattatcctgaacttgtagtaaagccttcaagttattaactctatattatagtttgacaaatagcattctctgcacatttaattaaacaacagtgcatactctttccagagtcctcaactatgtggtccttttcttactgtttttattctgacataaaccctatcactgagtatgtattacaaaaaaatctccaaatccttagaatgacttttcattttatgttgtcttttggaacacacaaagctgtattttaattaaaaatcttttatgccacaaccttgcttttcaaagaaatcttgctgtgcctctaaatatagtaggaaacatttattgagtgcttaagcctaagagtccagtaagcaagaattccgaatcctaagaaccaactggggttaggtactattatttacaaatgaagaatgtgaggcacaaataaataccctgacgtaatacagagaatcccctctagatattcttatggatgctttagtttacttttcatattaagtttctaaaagaaagatcagaaatttggttttaagaggtgagacagtgatctaaccatctctcataaggacagcctgtgtattaaagcttaccttttgctaagtcataatgccacttctgtcgcataacaaattcctactaaaggtctgatcacacgcattctgttatttgttcacacttaacatcaatgtaagaaaatattaattactactgctttctagttagtcttgatatttgtcagggtgaccccccttccttatttttcagatgtgtagtattgctggttactttaagtttagcatgttctacaaaaatcctataggattttgattggaagtgcaatgaatttatattagtttatggagaacatatttatgatatcaagtactccgactatgcaaatgagtatttccatttatttattatctattgataagttgcatattttctccataaaaaatcttacatcttgtcaaatttacttatttctccaggtatcttggtttttattgtaaatggggactttaattacacaaaaatattacactcaacactcatgtactttccatctagctgtcatatcttagcattttgcagtacttgatcagacataagaaataagatacgaatacagctaaagccccctatgtattcctctttgataacatttccctccctcttgcttctcagagattatcactatcctgatgttcccccatggtcatttaacagttttgctacatattgtatccatacaatacagttctgtacattttataaatttatatgaaagtgtgatactgttcagtccatgctgatacatacataatcctaaatcctagttcattcattttagctgtcacatggcattccattttatgactagcacagttcactgtccattcactctggatgactagttaggtttccaattttcctctctcacaacctgctatgaataggctggtatatatcattttataccatgtaaaagctcttctagggcagaaaatttcaaactttcaaactttttaaccaaaaaaagtcccacagtgaaaagtacattttacatgcaacctagtatatacacacacactttgctaaaaaagacatttcaccatatgctgcactctacaatttctctaaactgagggtcgcgaaccgtgagtgggcatgaaatcaataattctaacaaatgtttacactaatgtaaccacaatccccaaaaaaacaacatttccagcacctcagatgtctcccttacgttccttttcagtcaatccaccttcccccgtcaggcaactactgacttctattactattaattttacctgttccagaaattcatatagatggaattataccgtatgtactcttctgtgttttttaacacccttttgaaagttctcttgtattcatttcctaagaatttttgtcatgaacaagtactaaatgttatcatatgctttcccgttgtccatcaaaattatcatatggcctttctcctttaatgtgttaacatgatgaatttcatttacgagttttctaatgcttaatcatccctacattcctgagacaaaccctaattagtcatggtatttttgttttgagtaaatactaacattttacaaactacaatttttattgccatgttctttggtgagaatgcagcctatatccccttctcacactatctggttggggtatcaagattatagtagccttgcaaaataatttttctgtaacattttgtataagattagagttaatccctcacgtttggttgcacttgcccatacggggtcttcatttgtagtctggtgttttgcttgaggacttaaaattttacattggtacaggtatatttatttatttattttgttttgttttgttttgttttgagacagagtctcactctgtcgcccaggctggagtgcagtggcacgatcttgtctcactgcaacctctgtctcctgggctctgcctcagccacctgattagctgggattacaggcgactgcaaccatgcttggctaatttttgtatttttgatagagatagggcttcaccatgttggccaggctggtctcaaactgctgacttcaagtgatcgcccaccttggcctcccaaagtggtagccaccatgccccgcctggtataggtatatttctaaacatgactaagtttttaaatcataatctagtgaagtttctaattcttattaagccaacttggtaatttgttttgctagaaattgtccactttacctgtttccaaatttaaagaaataaaactgttcacagtattcttgcagttttaaaatctcagtttgtctgcagttataccatcccttcatttccaatacatttgtacattctttttctcctctatcagtcttggcactcttttcaacttagttacatgcactaaatcaaagacactatttttgttgttgtcgttgttgagacagagtctcgctgacactatttttgttgtcgttgttgagacggagtctcgctctgtcgcccagcctggagtgcagtggtatgatctcggctcactgcaacctctgcctcctgggttcaagcgattccccttacagaatgtatcttctgtaattgttgggtgcttgctaattgtactcttccaatccttcataaccttgtagttttttaaatctaccctttcataaattactgagaggtatattaaaattttctactacgattatagatttgatttatacctgtaattcttccaattttaccttataaattacacctagtatatcttttccattcctttgcttttaaactatgtcatcatacttttaggagtatctccacttgtaaaatacagttggttggattttttaaatttttgttctcctttagccagcaagtttaatctgagattacatattgggtttatggagatatttcagcttattttctaccatcttattttgtgttttctaatacctatgcatttttcttttcttttttcttcttccctgccttatactggagtgatcaatttctctttatttccacccctcatccccactgacttggagttatacgttattctatttcaattcttttggagagttattggtaaaaaaatttttaatggaaaactttaactcatcattgcattgtagatgaaaacagcctattgaaaaccataaagaattttttttttaagatatgggttctccctatgttgtctaggcttgaactcctggactcaaccaatcctcctgcctcagcctcccaaagtgctaggattacaggcatgagccaccacgcctaaccaagggaatttttaaaaaccagaaacctcatgaggatagggagaagaggtaaggagaaaacagaagcaaaattttaatggctggaaaatgggtgagcagtaattgaacagatcagaaactactaactctaggctagctgtaggaaaagctgaaaaccattgattaacacagaaacctcaaaaagttaaggaaccaacagcaagtcacggcaggaactgagggccaggcaggggaaggaataataggtagcacttgttaagagctttgtagaaaggaattcagttcttagatttccgcccctactgtctctggataactaatcctctgcctcaacgtttactttctgcaaaggggaaaacaaaatccctggactaggagatggcctgggtataagtaggaagaaaagagggtgtgaatgaacatgagcacgctgtgttaaatgtcgactcccaaaccccttcctccactgggttttggctcccaaatactagcagccagacctccgcccagttattcagatcaaaagacttcactagggtacctgaccgacccaggaggaaaggcatatagatgctaatattgggagtttaccaacaaacagcctgcctgctcagatccctctccagtgaaactgaaaggagacaagtttcacccacatgttgagtttttgatcagctttttagatccccacttcttaagaattactttatctgaggaaaaacgtcaaacaaaaccagaaaaattcagcttcaggaaaagactatacagagaaagaaaacatttttaaaacatcaacatggccagagaaataagactgagcaaccctgaagaaagagcagcatgctctcaaaggcagcattcagagaacttaacagctcttgcatagcttgacagcagaaacgggggaaaaaaatcaatagaagtgctagaagataaagtagaagaaatcttccagaaagtagaaaagaaagatgggaaacagtagagaaaatgaaaaaaattggaagactggttccagaggtccaatgtcccaacaacagttccaaacagagatgcagagtaggggagtcaaatagataaattaagaaaaagcccctgaactgaaagatgggagtttctagatggaaagggcccatcaagaccccagtaaaacagatgaaaacaaacctacatgaaggcccatggtagcaaaaccagaatgccaaagacaaagaaagggcttaaagtttccaaggaggaaaaaaaataggttatatagaaaacaatcaaaatggctttggttttgtcaacagtatactgtaaacaaagtcaagagagcaatggcttcgtaattctgggcttcataatttttcaaaaaaaaatttccaacctagacttatgttagccagaacaaaggcattttcagacatgcaacatctccaagtatttaccgccccacccccaacacactctccaggaaggtcctgaagaatatgtctcatcaaaaggagatactagtaaaacaaaaaggaatacgatctacactcgaacccaggagtgcaaggctgcagtgagccatgatcaccctactacactccaactagacaacagagtgtgaccttgtctcaaaaaaaaaaatacacacacacacacacacacacacacacacacacacacacacacacacacaaagaataggagatctaacaaagaagaaaaaatgaaggcaatccctaatatgctagtgagggggaaatctcagaatgactgcggcgtactaggtgtagaggcaaccagtgcaaatcggagcaagctaaaaaagacgaagccaaaacaacggcagccttctctccaaagtgaacactgtagaagtcaatggaagcataaccttcactgattagagccaaatgataaatggatgggggtgactgatggggccataaagaacagctttgtaccactctttaccaatatctcagcagatttctgattccaaagattacaacgcaaaagaaaaaaattttgcctaagtggaattcttatgttagtacatgtttatatatgtatggatttctttagaccagtgctatccaacagaaacaggatgcaaaccacatattgttaaattttctatcagccacattaaaaaagtaaaaattggtgtgctttagtcagttcaggacggtataacaaagtactacagactaggtggcttataaacaacagaaatttatttctcacagttccggaggctgcaagtccgagatcagggtaccagcatggttaggttccaagtaaggccctcttctgggttgcagactgccgcttttttcaggtatctacacatggaggacagaatgctaacaacggtctcttttataaaggcactaatcccattcatgagggctctaccctcctgacctcaatatctcccaaagatcccatttcctgatgccatcacagcgggaattacaagatgaaatcataatttaataattttattaatctaacccaatatatccaaaatactatttcaattcgcaatccgtattaaaaaccattgaaatatttaacattctgtttttgtactgttagaaaattggtgtgtattttatgcttgtggtccatctcaatttcaagagctcaatagccacatggtggctagtggctatcatactggacagagcaactctagaaggataaacgaaaagctagtaacagtggttacatttctggaaagcacaactgggcagcaggaggtaggagatgtaaaggaggcttacttttttcagtatttgctattttgttctccttgacttttataccatgtgcatgtgttattcgaaaaaatgaataaagtacattctctaaaataaattacaaatgtagatattctttgaactactcctagaaatctatcttacagacatacctgcaaaggagcaaaatgctatataaacgaagttatttgttgtagcattgtttttaataccacaagactggaaacattcaacagaggactgatgatatattcagacacccggccaggcacagtggcttacgcctgtaatcccaaaactttgaggggccgtggcaggcaaatcgcttgagcccaggagttcaagacaaatctaggcaacatggcgaaaccccacctctacaaaaaattttaaaaattagctggatatggtaggcatgcgcctgcagtcccaactactcaggtagctgaggtgggagattaacttgacccctggcagtcaaggttgcagtgagctgtgatcacaccactgcactccagcctgggtgacagagtgagacactgtctcaaaaaaaaatttacagacacccatacaaaagaatattatacaacccactactccaaaaaagaagaaaggcattcattacatactgacacaaaataagatgtactattaagtgacatatgtgaccacttgtactaaaaggtaatatacacacaaaattgttcatagatgcataaaatctctggaacaccacacaaaaacctagtaaagctacttgcctttgaaaaggcaactgtatggcaaagaacagaccagtaaagagactcttcactgggtatccctgaattttggattgcagtcatggattatgtatacaaaaattcactattccacatgcagctgtagatgttttcatgtaccctgccttgccttgctgtgatattaaagtccatctaaagcctactgtttttccagttcctccatagagaggtctgaggcttctttctccaagaagccccagatgtttcaatgataccagaacacttttcattttttaatttttttaagcacacagttcccacagttctgtctcctttcattgaatggcattataacctcagccccaactactgaatcttatctctagtaaatcccccaaggccacacttcccttaaagttgactgatttttctaagtttctagtacctgggcactttctctctcaagatcaactgtatacataagagaaaacttttatattttatccaacattttcatctgtttacagtaagaagaatgggcctaacttgtgtctgtgtcattttaagaaatttagataaagacagtataaacaataacagcaaacactgaagaaagtatgatcactgagaaaagactgctaaacttgacagttcatccggaaggccagtaggaagggaaatgtgaaaaagaatggttaaaaaatatgtttgcaaagttgaagtcaagaacagatagtgattaaatgtagaaagcaaaagtagattgcacttttaaaaggtatggagggaagagaaatttcaaatcttcaaactgcaggaaaatacaaaatattccccaaatacctatgtgaatttttatttagaaagaaaaccaaagttaattatttcaacaaaaatactttaaatatgatggtgctgcctcatctagaacatctaaggtcccactagaaataatataaaatcactgtgcagtcaatcctccttatctgtgggttccaaatacatggattaaaccaaccatggataaaaaatattcaggaaaaaactgtgactgtactgaacatgtacagacttttttctcatcatttctaaaacaatatagaataacaactatttacattgtattagatattaagtaatctagagaggatttaaagaataacaataaaatgtgcataaaacaaattctacaccattttatacaagggacttcagcgttctcatattctggtgcttgcaggagagtcccggaaccaatcctctgtggagaccgagatttttagcaatctatgttcaaacatactacaaggcagagaaaaaaacagcagcatcaatgacctggaattgtataactgttttagtcaaataaataattcattagtaaccaggataatagaaaacctcaaaaaaattaaaatacataaaacccaattttttaaaaacagatttttcaattctcactacaactatgttctctccaaagcgtaagctagtaaggaaagacactgccaactggaaacctaggtcggcccccatggagaatgatgggtcatgtcttttaaacaaaagcaaacagaaaacattcatgtgttcaactttatggactgtcaaacctaatgcaagcttgaatttaattcaagaaaattattattttagcaaaagtccacattaaatagggactgctgtgtaaagagactacttatttttttttttttaactaagagttatattcctatcacctataatgagttttgtggaatccacaactctataatcaacttgtaaacacgtaacttacatattggtttatcattcccagattattaaaaaaaaaaaaaaagcacctatgacaacactacacaggcccagactcaaatcagcacaaatataaagtacaagtactctaattgctcttcaaattcccaaagtctatcctgaccctcttctgaagcagcaactaataccacgtcaattcacgtgagtggggtcctcaggccataaaagctcaattaaagcaaagtctagagtagtgccacccaacacaactttatacaatgatgtaaatgtccttgggtatctgtgctgtctaatacagtagccatcagctgcatatggctatctaaatttagattaagtaaaatttaacattcagtttctcagtcacagcagccacatttcaagtgctaaatagccacatgtggctggcagctacctgttaagatagagcaggtctacagcaaaaatttctccaagacctactgttcttcagctgtgcttcaaaggcttcctggtggtgaggatgagaggaaaactgatcaggcaggacttcaacaactgcctattcttccttccacaaaacagctttactccttttatctgttttacatttcgaaattctgcatatttctctctaaaggctttctagttgctgctgtgtgtgcaggtgtgcacatgttttaagtctgactactactggtttcgagcagaaatggccaatgcacaacctcaggccaaagctggaccctcctgataactaaaacattttttaaaaaaaagtttaattgatcagctaacatgaactacaacctaactacctgtctattaagaattttaggccgggcgcagtggctcacgcatgtaatcccaacactttgggaggccaaggtgggcgaatcacctgaggtcaggagttcgagaccagcctgaccaacatggtgaaaccccgtttctattaaaaatacaaaattagccggacatggtggcgcatgcctgtaatcctagctactcaggaggctgaggcaggagaactgcttgaacctaggaggcggaggttgcagtgagccaagatcgcaccactgcactccagcctgggcaacaggagcaaaactccgtctcaaaaaaaaaaaaaaaaagaattttaaaagtggatctcaataaggaaaatttacatttactaccacagataaagtatctctagtcaacaaaagagtttcaatagttcactcaagtcaaggcagaaggctcacgggcccagcttccactgcatcatttatgaggattttatataggaggctctgcaaaaaagatttgccaccccacattttcttttttttcttttttttttttgagacggagtcttgctctgtctcccaggctggagagcagtcgcgggatctcggctaactgcaacctcggcctccccggttcaagcaagtctcctacctcagcctcttgagcagctgggactacaggtacccgccaccacacccagctaatttttgcatttttagtagagacaaggtttcaccatgttggccaggctggtctcaaactcctgacctcaaagtgatccgcccgcctcagcctcccaaagtgctgggattacaggcgtgagccactgcctccggcctcaccacctcacattctgaaatgaaagacgtgatgaggatggaacgtttccttgatatttacaagaccttaaccattatgtctctacagaatttctggaagtagctgaagcagcatatgaaaatgtagtttacttttaaacataggcaaactataagatcacagattcactatgctacttcctcagatcaagagtcttttttgacttaagagactcaaactaatgaacagatggaataccagtggttcacccaagattattcctactgaatacattaaatgtgaaactacatcccccttccccacaaaatgagggaaggtatgacactgtagattattcaaggaaatgcaaatttttacattaaggtagacacgtgtactaaacagaagcaactaaagtctatcctcgctttccactactctacagccttgaggccaatgtaaaaccagattttgaaaaatgacagggctacctaggataattagtgacaatttcacagtaaattcacaaactttgataagaattaatcacgtcagaatttctattttcttaagactacaaacctaaagatacatcaagcacctgtcctatcaatgtgcctcagttacaaataagaggaacccactgagccaaggagaaccactcacactgtacaatgtgaggcaagcacagaagacacagaattgccctaatatttctggctatctgaccaaactaaaggcagtgtctaaatccacctggcttggaaaaattatattctccctacatgaaattgctgaactgaagctgcgagctatctttgagatgtaaatctagaatcaacattgaattatgtcctaactgaatacatcacaattacaccaacctgaaaaaatgatcaaaattgatcaatgacaagcaataagcctctaactatgcatttttaaaccaaaaaggctagtacttttgtactactgctaaaaaaaaacctgattcttaaaaacagccaaggctacatattacaaggtcaccaataattatctgatggtgtagatggtttaagaagtaaccctgaggtaaggttacaagaaaggggatcaaaaaaattatcagtgctaatactgggcagaagtcacatgacaagagtcaagaaaccctcaacagagagactggccaactatccactcttgctttatcctagaaatctcgagcatactctatctcaaaacacagtgaaaagcatacactactgtcaaagcacaagtgaaaatttatatgatactcctgcagactgacaaaaaaattacttacaccaaagaaaggggtgacatagggtgctaccacactgaaacagcctttctttactgctggctaccctttcagcttggaatctgaatggctgtctgaatggcaaaacaaatgaaaaacatcttggtcataacagctactgtgatctttcatgaaataagccataagctatagcacaatcttcaacccctttaagaacatttcttaatcatcctgagtgacaatctaaagtatattacgtagattattgcactcttaaaaagattttcccaaacatgatttaggctaattgatgaacattcattactatgctttcaggtctggtcctgcactcaatggccccagacatgctagtcaggctttgactatttttgtgtcttgtagattatctctattatcctcaccgagctgttatctgttttttctgacaagagacactaggctaacatcctactccccagcccccaccacaccccctctaagcctcccacagtacccataatctacttgtttctaatctagtgcaggtttagaagccagataactttgcttgttagaaacactttaaataaatgccaacacattcttattaagggtctccaaggctctcctaagctttaagctatggactgggacaatttggctatcccaggcctttgttgttcattgtctgcttctcaaatacattttacaataggtccataataacagtgtaggcaaatcatttggattagaaagagcccaagtaacaaacccacaactacaagagaggaagaaatcatttgggaggacccttatatctcaggcaatgttctaggtacttgaattgtgatcactgaataagaggaaggggttagtacttccattttgtgtcagaaaaccaagggcctggggttggtagtaaattgcccagtattgtaactgagaaacaaaatattaggctagggctctctgattccaaaacccaaggcctttccactacatgagactgctgtccaatcctgggtctcggtttaactaactttttacactattcccgatcctttcactgagttattcaactctgctttctttccttaaccagcttctgtaattaaagggcaataagtgatcaaattaaggtcagatgaagcttagctctacaagtgtacatctgttcagcaataaacatgtttctgaaagactggccgtatcttcagtttgtatagactgtgcaaaactggtgccaaggtccccccaaaatacacagattgttcccagtgacactgagtaacacttcacatcttccctagtgctatctgctacatgttacaggaagcaaggcaagctcactttaggaatggctcagtaatgcatgtgcccttgatttgtacactaacaactgtcttactctaaacactggagaatagggcaagggacatgagtttccacttttctaactccattaaggaacaggggtgtacttgtttgctgttaagagactttattgcctagtccagagcctgacacacagaaaaagctgtttgttgaataaatgaataaatgtatttgttgaaaataaatgcatcggccaggcgcggtgactcacgcctgtaatcccagcactttgggaggccgaggtgggcggatcacctgaggtcgggagttcgagaccagcctgaccaacatggtgaaaccccgtctctactaaaaatacaaaatcagccaggcatggtggcgcatgcctgtaatcccagctactcaggaggctgaggcaggagaagcgcttgaacccaggaggcggaggttgcggtgagccgagatcgtgccattgcactccagcctgggcaacaagagtgaactccgtctcaaaataaaataaaataaaatatataaatgcataatctctcataacctctcttaactggttgtgaattccttacgtttcacattttctgacatacctttggaatacttaggggaaaacatcttacctctcacagaaactaagggcctaaaaatggctcttctacacccatcaaaagactaagaatctaaaagacatgcccccctctaccctctaaaaatgactctttgtcctaagaatatgaataaatctccatctgccagactgcactaaatacagcttttatatgcattacaaaaacacctgtataaaaaagctgctacaaaacgaggtttttggagccctaaagcacaaaaccaacagaatcaaaaccaaacaagaacaaggaaagacttttaaaactgacagtatttgcaaaatgtaaaaattcaataggtctttggccagcggtttacacagctaaaccgagtttttccattgacatatattcccccaaatgtgaagtaaagattatagcaacatgattctaatatttacaatgtgaaaatgaaaaggggacaacaacctctggccatcttgaagtagaatagaaacaacctttgttcctactaaagttctgttgaaataccaaaaccatccccaatattcctacacaagagttaaaacacataccaagcctgataagacacaaacaacaggaaattaccctgcacagtttcttaaaagactattatttcatgaaacttacagactgtgtagagacatgaccacttatgactaagtaaacgtaggttacaaccttgaaaacccaaacttttgttgaacacctacaatgcttgtggccgcactttagaaggtgtggctaagtataaaaaccaagctctaagagcaatttcttactaaaaccccaaaatgaacgtttccaatcacattacattaattaaacctggccagtgaacagccttgaactcaattaaatccagcagagtttaatatttatagtaaaagtgggcacactctttagaaatgccgaaagatgtgaactatttatatttactacgacagctaagtttacggcaacggctaaggaactttaaaaataaaagtattacttttgaatttaatataaacgtttgctaaatgaccttctggcagaggaaattctttaaatatcttgtatgggttttccgaaggcaaattttttaaataccctcaaactatggtacatttatgaagcccattttaaattacttctcccatctctgcttcatctgcttcactaattcatgtattaaaactgttgaaactccatttaactatttgactaacttctctgtaagatggaaactttttaaagggtgttaaagtagaatagcaaattttcagcataataagagcaaatttattactaggctcaaggaaaacatcctatcagcgattcattcatacgaaactatcaggttcaattcatatgaagtcagaagagagaaaaagaattttggaaattaaatcacatttcaaagaccatttctaaaaagatgtaattattccaagttatttatttattaacaattattttacacatgtcgttttaaaagtttcacaaacccaaatttaagatagtccaaattgcaacaaacaagacatgactttgatggaaaatgctgcttgcaaattcgttttacctggaaatttcttttttaaaggtatggttgacaacacactggtggtattttgcttttaaagggtcaagagaaaggaataacaaaaccaacccaggcattctttttctgtttaggatcaaaaggacattttaaggataagtaaaagacaaaagtacctgacccaaagacaatatccccctccaagagaacaaagtaagttgcaattttaaaaaccaagtttgaaatacgagaaatcacttcgagggctttccaaaggcgtgtgataaaaactaataggctccacccgcagaacaactttcacaagtgagtgaaggatgatcacagagttatcagctgtgtgcgtgtttgtgagtacacacaagccatggaaaacccgagactaccactgttaacaaaggttacgagaccaaaaaaaaaaagtggaggcaaagtattacgcgtccctaacaaggcttccccacaactcctgaaacaagagctctggcccttcggctttaaaaatcagaaccacaaactatggagtgtgagagcagcgaggggaagggacgcaggcagcccccgcccccgtcagcctgggcggcagcgcagtgcaaccgagccccgtcccttcccggctctccggccccgaacccgcacgcccgggccggcgcacccacagcccccgaactcaccacaccccagcccccacccgcagcggccatgtgacacggcccatcgccccggccgcggacgcacgcaaacacttccctagctggaggcccgcgggcgcccaggctttacctgcaaggtggcgccaggtcccgccccgtcagatccggggggtccgggaccttttgttccttcctcttccgatgggatggagggggctgggaggggaagaggggaatgggcgattggaggcggaactgaaaacactcccggccgccgtcttcccgccccgcccccaggcccgggcccggccggcggcccgggcgcgcgggagggtaggggaagagaggggaggggaggggaggagagggaaggggaggggagggagcctggccgccgcccgcggggaaggagggggtgaggacgcgcgcgcccgcgctgcccctcctcccctcaggcgcgcgcccgcagccctaccggccgcccgcacggccgcgccctcccccgccagcccacctccgcttccgccctccgccctcggccgccggccgccgcggcgccacgcacccacctcccggcggctggcgggctgctggctggcgagctgcttctccgccgccgcggccgcgcgggtagacccgcctgccaccctgggccgcgggccccgccgattcgccggcgcagccccggggctggcaccctgccgcccgctgattggcgcctccagccgcccgttagggcgcgaggcacgccggccgaaagccgcgcggggcgggtatggaagacggagggagcggaggaggaaaggaacgaggccgagcaccgcgggaagggccggggggcgagcggggcgcggggagtcgccggccaccgcctccccacctccctttgcctacggcccgccccgcctcccggccg

SEQ ID NO: 1987 - DNA, 98052 bp, Homo sapiens; identical to SEQ ID NO: 1986
  source 1..98052: mol_type = genomic DNA

SEQ ID NO: 1988 - DNA, 97505 bp, Homo sapiens
  source 1..97505: mol_type = genomic DNA
taacatggtaaacaactcaaatggctttcttttaatgctaggaaaactgtccacctttcaacggtgacagggctgttaacacaggtaagagcaaacaaggtaaaaagtgaaagcacatacagatgatgcacacaaatatatataaaaattgaccagaaatcacaggacatgtaagcaatgttttcttaagcagaactttttttgtactttaaatagactaaaatatttggtgtaggtgggagaaagacatcagtattcaacaattttaacttgaaaaccagctgtaataaagcctcagctcattgtttaataaaaataaaaaaggaaccacatcgtacttttgacaatcatagaacgaaagctcacaaagaacacatttaatatctccatcacagtgcaccaaggatgcagccactaaggacttccagagggaaacaagaacagggtctgcatccatcatattgcattacaaagttaatgccatcagagaaaaaaaatctcacctcacgtgctcaatgttctagctggtaagcaccttatgagtatgaggctacaattgagagaaactgctcagtctgcatcaggacacccaattccttcacttgccattggctgatgcatttaatcattttaacacaacattcacggaaaaatgttaacaacacattctggcttctcgagcagaacagactgggaaatgcagtagacgccagagcatcaaaggccatgtatttcctcacaagaaaagaaatctgcaacaattggtttccttttactatgaaaaatgtaaatttcagattaagtttaaccccataaggacgcatgatttgtacttacatatacacataggttcagaagaacttagctatctagttggcctcttctctgttccattataacatcagttaccttagctggatcactaagtgtgagtctcaccaccatactggtaccttcagctattacctgtgttataaatctcatgttccattcaaagtactaaatgactggatggcacatatcccaataagtatcagaaatgttgacagccatagtgcagctgagtttagaagcaactatgacaacatagggaagtaaggataaatcacaagaacacctaaggtggtcagctccttctggtgtgcctgggacttgttttgagtttagcaaaaactttacaagattaaaaatcagagcaaatgaatttcttaagttcaagatatgtactctcaatggagaatcgcttttgggcagtggttaaggcctctgatgtgctacttatcagaaaaatccacatatatacaaaactctgctaaaagttttgtatccagggaaagtcccgcatccagggaaaccctcaatcccaggcactttagggcagctggtcaccctgagaacactacccactcgttccttaatatcactagagaaaaggtaagaactttcaagggcataacctttaagggcatcagtccccaaaatatttttacatcactagctaatggctagttcctctaagcttgctaaaaggctaggaagtccagaaataccttaaacgtgttaactttaagaagagttggtagtaatcaagcaaattagtgagcagtgtataaaagctcactcttgaaatctgttttcagacaaatcttctaaaggttcttctagctttgtccagttatatggtattttactgtattctctttttgcaattaatccagttttgtatgtcttttctttcttttttaggtgaaaatattctatgccaactgttttccacagtcctgcattatatattaaaacaaaggctgccagctggagacacagccctccgattacaaaggcccagaatgttacttttaactgtgctccaccaggaggtctggccttgggaaaagatggcgaaaggaatattctcagatatgaacattttttattctgcctacaatgctgtgatctagttcaacaactgcagaactgttctcatcttaatcgctgtagtttttctttctttactcttttgtataaaaggttagtgtcacagcttcactatcactaataaaaagatacaaatatgcctttcaagtcagggttggaaaagcaaaactgaggtgtgaggttacactggtctaagaaagtaccaatttgggttctatattttgtcaaacagttgggtttttaaaaaaattcaaaactcatgcatgttacctacttgtcatgtgtgaattatttctcacaattttaattaatctgtgtgtatattagttatataaagcaatggatttccacattcttaaagcaggaacctatattcaccagaaaaggatcctcctgtttctcatcaaattttttttcagctcgaacaatccaagattgggaatagtaagagtggcaaacaaatgttttcttagggacttactgagaaaagaaaaaacttactgggagaacagagacttagtaaaatttctattgctacagacaaatgctaaaaaccagctttataataacagcattataaaggatagaacttaatatagaaccagaaatatggcaagttacctagtgattaacattgtaaaatagtcaaaaactttaaagccacagagaaaggaaaacaattatgaaatggaaaatatataatatttaagtacttttataattctaaaacttcacttttgtccttaaatcaatatattacggatttcattgttcaataaattaccatctttaattaaaaataagtaaatcaaagagcatatttggagaaactaagagctgttaactgtttggagggtaaaagaatacttttctcgaaatttttttgaagaaaaatctaaaagccctctatgttgagttaatacaccttctgacccccatcatcagtggcattattcttccaagggactcttatatctaagcaatggtgaagttctggattcattatggatctcatggcaccaaaccaactggcactgaagttaagttaatatactccagcgagatcacctgtgggtcaaggatggcccagagaatcttggaaaatccatttatattgagcaaagatctgaatcaccttcaatcaggctgtaagatactagaaaatttgaccttgtagtagtatttcccagggtaacttaagcagcaaccttgcaccagaagaagaattaaagagggagcaatctagtattatcaacaacaacaaagttaaccctaagttagtacatcccagaatctgctggatgtataataatttagtaacggggtatatggcagagctttctttgatgttaacaaattttggctgtgattcttagttaccaagttgccaaaaaatggtatattaaatgaactgccaaatggcagattaagaaaattaatgtactccaatggtctgtccatgaaaggaaaatgtacacagacaaattaagaacattttaccaggatctgagatttaaacaatggaacaattgttttaactgttagaatgaccccaactgttaagtttgtctatgagtgtatatgtatatataaattcatacacatatattatttatttccttcttaaaaagactgaggcagttctgctatatatagttagctacaatattcaagataaaacagttcctactcaaaaaattacatgaacacacgagataagttcttatcgtaaatgctatcatgaggctatctagtatagctcatatttcctggttgtaaggctcaaaacacaggaattccactccaagagataatttgcccctcaatccctacaaagtgtagtctaaacaaacaaaatggtaataaaaaattgaaaaggaagatataaaaagaactcaatagcaggattctgactacctctggagaccacacactatcattattctgactgtcttaaatacaacaatccaatatgccccaagatggaaatctggtatcgtagggaaaacattggctgcaactgtcagaaaagttcataatcttaaacataatttatgccatttgccagtcacaaagacatttactgaacagaatttttgagccatttgtaaaattaaaatgattgatcaatttgaatagcaaccttcatgatgaagaaattaggactctaggtatgaaaagcatgttccttttttgttaataagttcaaaggagagaaacattctgatatatgcagataaaaatatggctaggctgggcgcggtggctcatgcctgtaatcccagcactttgggaagccgaggtggacagatcacgaggtcaggagatcgagaccatcctggccaacacggtgaaaccccgtctctactaaaaatacaaaaaattagccgagtgtggtggtgggcgcctgtagtcccagctacttgggaggctgaggcagaagcatggcgtgaacccgggaggcggagcttgcagtgaaccaagatcgcaccactgcactccaggttgggcaacagagcgagactccctctcaaaaaaaaaaaaaaaaaacaaaaaacaaggctaacaagaaagaggataaccagcaagtaccacctggatgtgtgttgtcaggtagaaaggaagaataaaattcaggcaatgaatataatagatttagcaaagtaaagcatatgaaaggaagaaatgtttgatatgtctaagtatcaatgccttcgatcagagtaagaaaaaagtattcattgttcatgtccacagactagatatctaaagagatacttggtgggcaggggcttgggagggaaggcgcaaattggaatgttcagcttttaaagtaaagactgtacatgaagacatattttatgtacagtgaagattgtcttgtgttactttatatcccaacataaacctacgccaccctcagacgaagagggtatctaacactgaataaatgctgaacctatttagtagttaaagaaaaaagagaaggatcttaaaggtatatatgggaagcttttaagaggtagagaaaccaactgggtatatattttcttttatttgatttcaactagcaagagactaagactgatgtttgtttgtttgttttaccttcaaagtcttagtcttaaattgacaagggcacaaaaaaagtgaaattaaaataattttaacaaaagggaaagcatttgacagtgtttaaaagacagacaaatcaagcaaaactcaatgtggcttaaggtaaaaaatacaactaggtattaaacaatttgtaaaaacttacaaagaaaatttagctttcaagaaaaattaggcagatttccttctgccaaagtgacaggtcctgaggaaaaaaaacacaacctctacaagaccaagcacagctcaagggtcagggccccgtcctagtcatctttttattattcaatatccatcacagtggctgggcaaacaacaggcatcaataaatgtttactaactgaatgtgtattataaggtataatcggtataactgatatagctcaaatctaatcatgaaagcttctttaaagtaggataaaaagagcacaatcagcggtattccagaaggtaggcctaaatccagttatatttttctaatcgttgaccagtggttataaagactttctgagcttctttttaaagcaatgaaactctttccaaaagaaaccccatgcagttcttcagtacagaataaatatgccactaagtcagtgagaactccaacagcctcccctaagccagcccccaaggtgtctctgtggaacctactggaaaaaatattactcatcttagaaatgtgatagaaagcatggccattcggttctcaggtcatcattcctagaaaattaacagtattgtgaagaataaatcctaagtaatgttgctaatttaaataaagacaaaaattcaacaaagaggggattctatcacttagaaaaatgaaaaccacacctataaatggggggaggggcagaaaacaaaaaaaaaatcaggccacagtagataaaatacaaaaaacatcatctcgttaaaaagcatcaaacacattcacacaaatgtaattacaaccaggaagtaaactgctcaacaggtataactgctcaataggtgttttcaaagagttgagtcccaatttcatactgtacagaaaaatcgcatcagaactgtagagatgcgctccactactgaaacagcatagtaggcactgcttgacctaacacagtaatgcaagagtaaccaccaagatcaggaccttctaccactttcagagttgttttctgcccctacaactgttccctaacaccattacaagttctcaagtaagaaaaagaagggcagaggctccactgagtatctcctacaggcctgatagtggtattacctaggacatttactctgctcacaagatgggtagtggaagacataattactggacagcacaaagtctggaagcaagcagcagggcactaaaacagtgagagcttacacaacaaaagcttgttaaattaagtagtactgatgtggtgcaaatgaaatttttacagcaaaggttgaggaaggagatatgttagtgagaatcacatgaagcagactatcacaaaataaggccaccttcaaaatgttatgaactgtagaaccattctgatcttcaagtttggatttgtatagaggtttctgtataaagcattaatacctaatcaggagtttcctttagtgtgaacctttttgcatttgatgctattctctttgccaggaatgcttatctcccctggctcctcacttggcttgcttctttaatgtcaggtgttagctcatgcatcctttccttagaggctttccttgatgtcctacctgaagcatcccatctgttattctccagtacagtaccctgtttatctccttcatagacaagtaagataattaagggttagtgtaactgctgtctcagcaaaggcaggaactgtagttgtcttgttcacctttacccaaagactaagaaaagttcctggtacaaacaggtgaacaataaatatttgttgaatgaataaaaaattactataccaaatttacatgaacacatacatatacacacaaatataggaaaatggggagtacccaatagaaaaccaccaaatgttgaaagtattgaaaatgatacctatagagacaggtggatatgatttcaaagaacaagtaccaaagacagcttcaaaaatatgaaaatttatgaaaagacgaccaggagtggttattttccatttctactaagatgcaaacaagaagaaatgtttaaactgcaatgagtcaacatcagacataataattatttgctgcagaatgaactagcaacagagtttcggaaatctcctctcactacagagcatgaaatattgtcaatcacaaaaccaggatcagttaagaacagctcagactgcaggtaacttataagctaaaaaacttgctaaataaatggcttttcccccaatttttaaaattctgaattcataattatgtgtagaataacaatcaatttataaactgaatacaacatactttaaaaacagatggcccatatctgctgatcctacctcagcatcacttttctaggtattttgcagaaacaattacatttacaaaaggcccatttcataatgcaatctggttactaaaccaaatcaaactactcgaagagcagaaggtctgctgttgaaatattgtaaaatacctttggaaaaacggtatttatagattagcttttttaaaaagggataaatatgtggaagtaattctagcatatccctgaaaataattatactgccacctatgcattttttatgaggtggaaggataaatcaacagactgctagattatacaagccaattattcctgttgaaatttgggcataagacaaagggactttctccatatgaattcttactgtatcccagaattaactggtgccagcagtatcaatgcaactattactggtgatgatgtcatgttatgctgttttgattatgaggacaaaaatgggaatggaaaaaagaggcttggaaaggttttcagtatggtttccttataataagatttagcagttaaaaaaaaaaacaaaaaaaaacaaaaaaccacaaaaagaatgactgtttaagccccactgaacacattaaggtcaaggatttcaaaagttaatccacttttcttcccccaagagtttatttttggtaaaaggcagaaaaattagtttttctacaggaaaatctgcttctaaataatttgaaaatcttgatatatattatatattaaaaaagacacacaaaaataacagagaagtgggaataacagattaggtactgcaactttataaaggtttgcctagatcaagaagcagcgcacacacacacctcatctatgcaaactaaaaatgtatataaacagcacaatactgtgatactggatcatgatacattacctgtacacataactactactgttattaataaacctttgggacactcagttttatgcccaataagacatcattaagtctttaaaatcttctcttcctctttaatgggagagtatttctagacactaattttcccatctaatattcaaatataggaaacagattccacaaggtgctttaattgatgagacctcaagtgctgttttctctcttgaacttttggatagtaaacagtccatagggaccacacacaatgctatgacagaagagttgttacattaagtcttttcatgggacttgattggtgaagctttatgacatgcttgagcaacgcactgaaggggatcccatctgagttaatactttgtccaaccactgtagaggtccattcagatgaagttcaatccagcaaggagtacttgttaccgtctgccttctgtttaaaagaatacaggaaaatgattatgaaattcaagtccacaggcagggaaaatggctatgtttaggtacactgcattaaaaatttacagaaattaaaaggttgtgtatataattttggacacgattattccgcaaaatggttgatcctcaaagtcaaagtacttctgatgaccttgttttagaagtgatttacaagaacatctttttctcatcgcactaaaattaataaggtgatcttattattcaccatcatccaaaatggaacacctgagagagaatgtagatactattaatatcaggccagggccaggcgtggtggctcacacctgtaagcccagcactttgggaggccgaggcaggcggatcacaaggtcaagagattgagaccatcctggccaacatggtgaaaccccgtctctactaaaaatataaaaattagctgggcgtggtggcgtgtgcctgtagtcccagctactcgggaggctgagacaggagagtcacttgaacccaagaggcagaggctgcagtgagccgagatcatgccactgcactctagcctggcgacagagtgagactctgtctcggggtggggggcagaaaaaaatcaggccaaaaggagacacgtgaatcaggattgtccaagcaaaccaagacataaagtaactgtacttaccaaatcaaccacagaatagtagatactcaaatatcaaacagaatctaagtaaaagtataccaaagcaaaaacaaaattttggcccaagctaaacccacaccacagagagtgttaaaagctggaattcaactttccctgccaaagccaatgaacatccctcttagcaacaccattcgggcttttaatagtgcttcaacaaaaggggcaactctaagagaattacaaattattcaatgacatcctgtcacttccatgcgctgattttagttccatcttatttgctatacagaataaagtcaataaatccacttgcttctacaaactaacagcccttcaaatatgagaaaagcccattatcaactcttcatctccaagcaacacatgttcaatgtaatttaaaactgtacttccaaggatgtcactttctgaggcagatggtatcagtgccccactgtaccctttggatttttcagtgtgctctagacaacttccaactgcaggtatctgcatttctgtgcccaggaacttctctgatatacccaaaaaggctagaggtgccaggaaagaagcatccccaggagcagccctcaaccaaggaaacagaaattgacatttacatgcccagcacttctgttcccctgggtaggataattctgtagactgtttactgtttcctagagtttccccaagggtgtcagttctagtgacccacccactctggtagatggcttaacaatggtcctggctgccctgttctcccctgtcccacttccctttctagaataatccataatccaggtcacccaaggggagtaggtttaagaaggctgccactcgattaaatacaaattcttcatacatctaaatttcctgtttactacatttcctcatttttgtgctaacaaccaagatgacattaaggaaatttaaaaaaaatagttttagaaacctaaacattaggtctatttcctcagctccagaatgattacagacagtaagttcctggtagctacccacatatccacagatagatggatatttgccattttgatttgtaaatgttacaggaaactacttgattttccaaagtcagatgtacctgactcccaatactcataaaaacatactgcatattactgcttctgtaattacagattttactttatctgtgagttaaagaacagcagagtccacagtgaatgaagaagggcagtatctttaccaagtaaaactgttcttagcagatctatagatacacatggaattctctctgtaattcactcttacttccactaaattcctaccatattttgcattattctaaccttctgaagaacaaaaaaaagtctgacctgaaatcttattagacaatataatttaaatctaattttgctatcaactcaggtcaagtctaattttaaaaaacggcattcagcattcttaacaggtaacaacatctcaaaagggtaataatcaaaacagaactacagcaaaatcacaaaatgaattattctaccaatataactcagaaaaaaatagtgacaagtcttcattctctgatacaaatatataccatatatttttaaatgtattcaacaagtagacctcacattgcacaatctcaaatcagatttctgacaaaacttaagatagacaagcaagtccaaaacaaataaatttggaagggactaaattgctggaagaagcaggaatacaatcactatattacatgaatatttcttaagcaggcatatggagtaagcaatacgaattgaagaaagactaagtattttacttaattcctactcttaaatatggtcaagaagtcttctctctctttgatgtgaaatccaatctattgtttaattcatcaataatctagactatcttatccactgatgacaaattagtttttgtaaaacttaaacataattgttactactatccttataaaagaggtaaagagtccaggagaactatcttccagtcccatctcaaccacttataatgtaaccttgggcaaattatcagctttctatgtctatttccaaatatgtattagtttgaaccatgtgttacctgcaacgatggcaatttcatatatttcaaccttacaaagaatgaattgacaacagaaataataatttttagatactacacttaaaacagcacagtgcctggcacattagcaagtattccttctacttctgaatgaagttcctcctcttaacctacatctagtttgtctcaatttaattgtccagccttatttttctattctccaaactgaattgctatgctattgtcaagattatcacttcccaactctgcccaccccatttatgactattgaaatccaatgcaccttttacaactagatcatgtgccatcaagttttccttgagcaccgtgtgcaaacatctctccttccataaactgacataacccttcatatacaccccttttatgatatttaacactctgaattacgttaaaatgcacgcctgtgcatgttttaatatcttccataatggcagctcagtaatttgcaacagttttgaatttggaggcctccaactttattttacataaagatcagctgactctataacctcattgaaaatagatacaaatgaactccagaatatgcaagaatgcaatgaaacataattacactgtggaaatttaagaaccaaatatgtatttcataccggtattctgctccccaccctttcacaaaactcattcttatggtgcacattctagttagctgatagacggcttcaaaaccctgattaacagactgagccagaagagcagcaaattcctggttgttgaagatcttcagattacagcctatgattaaaaaaggtaaaagaaattgtcaaaagagtatcattattaaaaagtaattttaaaagggttacaagttttagaatatgagcatgcaatcatctactgattcctaaaattagcaacaagaaaaactaagcaagttgacatgataggtttatgtacattattgaatccatacctggtggaattttacacactgttgcagggtgccagccatatctctgattacaattggggctctgcacaaagattgcactatcacttaggcactcagcaaaaacttccccacctatgtagtataagcgcactcctcttcctgaaacaaaatacaaatgagattagttttgtaacatttactatttcagtgtgactttggaagcattttcttggaaaaattctaaaatgatataaggtatttccaggatctttttcacagataatgtctttctgaagtctaactttaaatatactactgtatatttctcccaagtattttctaacaataattttattgattttaaaatacatgtgtactgactgaaagtatttaaacaatgtagaaaaagtacacatagtaaaatagtttcatacaaatgatatatattaagataagtaaaagattgagttaattttgaaggaattcactaatgtttggagaaatatatcttcattacaactgtagtttcttagagatcccacttaatgttaagaaaaaagatgtaaaaacatcaaaaagtcatttgccattttaaaaactatatattatggtggaaacccaacctctagatgtataagcatgattaggtgagaaaaaattctactgggagatttttaatatacttctttcagaatctgagagatcacagatgcaaaataatatgagatataagaattaaaaaaaaaattgtgagaagcagagttctaacatgacacctaagagtctcagccctgaggtgcacatacattctctgttaatcaaacactaggtgctgctgttaaggattttttcagatgtaattaaggcagcaaatcagttaaccttaatcaggcaatcctttaaaagggactagactgtcataggctaagtgattcaaagcatgaaaggtattcaacacaagagacattctccattgctgactttgaagatggatggcaccatgtgacaaggaattcaggaggcatctaggagctgaattctgccacaaccatgtgggtttagaagaggacctcaagctccagataagaacacaagccagctgatacctcaattttggccttgttaaaccctgaaaagaccgcctaacccatgtctggactcctgacccacagaaaccgtgaggtaaaaaactgatgttttaggccactgagtttgtggtaatttgttacacagcaaaagaaaactaatcaaacaactaacactccagatttaatacagaacctggtacggtggttctgttaagactatggaatatctgtaaaacagtcatgcacgtggtcattgggaaaacactaagtccaaaaagtagagatttttcaggctatattccctgatcaatatcacctataaaactagaaataaaaaatttaaaaaaatccaataacgacagcaatctaaaactttggagggagaagagaataaggcagagaaaacccattaaatttttttgcagaaccccaattaagtcacaaaaacaaaaaactattttagttaaagcacctacagcgacactgggtatcttaataagattatccaaatttatacatcaagcaagatttgagaacttccacttggaaccaagtaatagatcttctagtcactatcattttgcagtatcaaaatcacactttgataaccagcattacttctcacaggaggtaatggttaattagaaaaaaaacagaagcaaactactgttaaaagaagttactttaaggtgatgagaatgatgttcaattatgaatggttctcacactttttcacttcatcgttaaggaaatactgaggaccccaaagagcttttgtttatgtgaatattatggaaaatgaccatattagatataaaaactgagatttaaaaaattcatttaaaaatcaaatccattacatattaacaatgtttataaaaaacaactgtatttccaaagcaaaaaaaaaaaaaatagagtggcaacatttcaccatttttgtctatgaaaaacaactatatttccaaagcaaaaaaaaaaaaaaaaaaaaatagagtggcaacatttcaacattcatgtctagtgtaacagaattggagtctcattatcaaatctacatttcatctcttgcaaaatcatatgcatgtaggctctggaatactccactgtacagtcatgagagtatgagagtagaaatggcaaacagcatctcagtactactatgaaaatagctttgacctcacaaactagctgaaagggtttctgggactaccagaagtccccagaccacattttgagatgtccctgaattatattttgaactatattaaatgcagttcttgttttagatatctcatttcagatgaacagcaagcagatttcatttaatatataaactcaccaaagggggaaaaaacctgggagctatataaagaaactgaaaaaaaacaaaaacaaaacaaaacaaaaaaacatgatttataaaaaagtattaacccccaaatctgaacatggcaattttatgactggtagagactcagcaaattaaacttatcttaacacatatttattgaagaactttccagtaccaagggtgccaaataaaagttgaagagtttgcagctgaagcatcaccaggatctattagaagcagtgaagcctgtgcacttaaatgtgtcggcacttaaaccaccagagagaaagctggttttactgcacacaagctcttgatgtggcacaccatgcaatgcctacattatgagtatacagcatttatttttcacaacaaggaaaataaaacatacctatatgccttcttgtcatttctaccgtggcatttcggttaacattggagagtaaacctaagcagaacctctctgaatttgatgggtctgtaaagccatctacagtgagtgagggctgtgatgcatggaaggtttctccaaccctctgatttaattcataatatgctatcgaacaccaaaatgcaggttctgagtaagtaactggctgtaaatctgaaaaagaaaaaaataaaaaaataataaaaggaagaaatgcgtgaacaattcaagccaaaaatagatttaatataatcatctttacatgctctatgccagcctgcactggcaaaagctcaggaagtagacatagtatctgtatcggtttccacagatgataccagattttcagtatttttcacacaaaactccagtttcatagatcataccagattttttcaaatttctcccatgtcattaaatcactttatgttggattctttgttttaccagtagttttagtctagctcctgttcaaatacaaaacaatcataggcaaagtcagtcaacttgccatacttggtgcatttctaaagcacataaaaaagctaaagtggggtaagataaagccagagcaaagattaatgagtcaaaagccacacaaagaaaaacagtaataataaaaggatacaaaatatgacatatttttgacatttgtctattttaacatcaaactcttggtgagataccctagctacaaaaagagaaaacccactcatacataagaaccagaaagcagtaacacacaaagatcatgcaagtagaaacagaccatagagtcaaaagactacttatttcactggaaaactatatatttagcttctgcagtttgactaaaacatatcataaggaatactgcaaaagaaaaaaacctcacaattttgtagaataaattccaaacatgtaacaaccgaagagaaattgtgaaatagggtaaaatgagggcaaaaataataatagtaatacagaaatgtatgtatatatatatatatatatatagtcatcccttggcatttacaggggattggttctaggaccggctccccctaactaaaaacccttagatgttcaagtccctgacataaaagggtgtagtatttccatgtaacttaaattcacgtcatcctgtatactttaaataatctctagattacttataatacctaataatataaatgctatacaaatatttgttatactgtattttaaaatttgggcccagcacgatggctcacgcctgtaatcccagcactttaggaggtcaaggtgggtgattcgtttgaggccaggagtttgagaccagcctgggcaacatagtgaaaccccatctctactaaaaatacaaaaattagctgggtgtggtggcatgcacctgtagtcccagctactcaggaggctgaggcagagaattgcttgaacccaggaggcagaggttgcagtgagccgagattgcgccactgcactctagcctgggcgacagagcaagactctgtctcaaaaaataaataaaaataaatacaatttgtattagtttttactgtcgtattgttattttcattttttcccgattattttcaatctgcagttggttgaatctgcagatgctgaactcatggttatgaagggaccatacacatacacatttgtacatatatgtgcacactctcatatatatattatatatagtatatatatattattatatatatgtataatatatattatatattatatattatatatattatgtataatatatattatatattatatatattatgtataatatatattatgtatgttatatacatattatgtataatatatgttatatatattatacataatatgtataatatatattatatatattatataatatatattatatattatgtataatatatataatatattatatatattatgtataatatatattatatattatacataatatatattatatattatatattatgtataatatatgttatatatataatatatattatgtataatatatgttatatatataatatatattatgtataatatatattatatattatatatatattatatatattatgtataatatatattatatattatatatatattatatatattatgtataatatatattatatactatatatatattatatatataatgtataatatatattatatactatatatatattatatatattatgtataatatatattatatattatatatatattatatacattatgtataatatatattatatattatatatattatgtataatatattatatattatatatattatgtatattatatattatatatattatatatattatgtataatatatataaatccccatactacgtatacatgtatacatatttatgtcaatgtgtatatatgtaatacacataccttttattaattacatcataaaataaacataaccataaaaatctagccataacaggttatataattttctatgaggaatatgatttcaataataaatagattatacctatttcttatatgtgccagcagaaaagacttaataattttgagggatggtgtcaatattctttttaaaaagcactactttaaccacatacataattatttggctattcattaggatccctttctcggatatataaaaaataactcctagagatgatttttattattaagtaggtgatacagtataaaaatgatgaggggaacatatgtgcaacttacccaagctatgattaacaggggaaagagtagtaggagatagttctgctggagagcctaaaacaaaaggatttaaaaataaatgaagtatttccagaacttctgatcaagtaatcataaaactagctttatctggttataattatcaacaataatacaaagataatttaaataccaagaattcagaatatgtaagtgcttaaatttagtttaatttgtggggggtcgggggaagagaagggggggttccagtataaaaggtgcaacagttttggcttctagcccaacagttcatcttcccaaagatatctaatattgacggttccttgggtatctttccaaaatactctatgaaccacataagcaaatacatttttgttctgtgtcctttcttttcatatacaagtggtaaccgtttttcatcttctatattattctatcagattgttcacaatgtgtttccttatttgtctatctacatatcaattagtcacataacatcgcgatcccacattgatggatattcaagctattttcaatcttttgctataagaaccaatgctttgagattgcaataactaatcttgaccgttttgcacgcttccaatcacatctgaaagatacattcttcaagaaactgccaggtcgaaaggtttgtgtatttgcaattttgatagatttgggtaaaattatcattcatcaaggttgtaccagtttacattcccagtcacaacatagtaaagggatgcttgaggtgttattgcttctagatgaaaacatggtcacaagtacagttttaattttgagtagctttacacatgtttatattatatttccttcctgtgatagtctgttcttttcttttgcgatgttgatcattttcttactgattgtttgaaagctctttatgtgtattagggatgtaagtcttcttatggtatgagctacaaatatttaatcattggtcttttgactcttaatcctaattttgatcatgtagcactaaaataaaagcccttctacaagatttatcaatcatctttgggttagcgtcacactttgggataaaacagtgatgacggtggatatcttactcttgacttttagggtaatgtttctaccattttcccattaagcatggcattggctttcaggctaacagtaataaaatatttatttaggatttttgcatcaatagtctcaagcaatacaagcctgaagatttacatgagtgctatgtttgtaaggctctgtggtcaatgttatgacaatctagcagctttatcctctgcaaaggtttaaatagtattataacagcatattctttaaaagtttggtagaattcttctgtgaaattatagttagtaactttctagggtttactacgagacattattctatgaagggtgacttgttcagatagctctattttctggagtcagttctggtaaattacactttcttagaaaatgatctgtttcttcttttgggtaaacaggctaaatctaatcaagaaaataagggggcacaaacatacaaaataagaaccaccacagacaacatatgaaaaatcatggcgcaactagtctgctcagttccatgcaactcaattttaaaacacatttgctataaacattgttaaataatcttattaaaaatataaaatatattttcttttatgatcatcattctctacacgtttaggcacagttacctaaaagagcatgacccaagcttcaaatgtataccaagagcataattgtagaataagataggtcaggctgggcatggtggctcatgcctgtaatcccagcactttgggagactgaggtgggtggatcacgaggtcaggagttagagaccagcctggccaacatagtgaaaccccatctctactgaaaacacaaaacttagtcgggcatggtggcatacacctgtaatcccagctactcggaaggctaaggcagaagaatggccgtagtatacccctggtcgtgtagcagtgaaagtggtttggtttagacgtccgggaattgcatctgtttttaagcctaatgtggggacagctcatgagtgtaagacgtcttgtgatgtaattattatacgaatgggggcttcaaccgggagtactactcgattgtcaaagtcaaggagtcgcaggtcgcctcgcttgaatccaggaggcggaggttgcagtgagctgagggcatcccactgcactccagcctgggcgacagagcaagactctgtctcgagagggaaaaaaaaaaaagagtaagataggtcagaccatcttacacacctcctccctaccacacactattataaccatgacataaaataccaggcaataaaggtgaaatggtagcccctagataaataaatgaatcagagaagggatgcttagtttttagaagacagtacggtcttccacaacataattaagttatgttccttttttctcagtttgaaaaatctgctggcaagtcacaaatctgctggcaagtcacaaatctgctggcaagtcacaacaggtacaactaagataggtcaaaacatatttggaacaatgagctaaaattcactgctgtttcctgaaaccaacataaaataaacaaagccactattagaaatggaggaaactgcccaactattcatatcttttaactgtttactcctctattaaatacttagaaatgaccagtaggatcatttaaattaacaggcgttcagtcagatgtgacaggttagaattacagattacaaaaaagacaaattttaaaaacttaaaataagctaacaattaatagaagcctttaaaaaaaaaaaaaccagaggcaacgaactgatgattagcctatgaattattcatacataaatgctgctattggagtctcacctaccacaggtcttccacttagaatattataaatatcctatttgagatccagtgtgaattagcagtgtctacttacagctaaaccatctacagaaatccctgtgcatgtatcttcgcatacaaattcacatatatttgtaggatacattcgtcaaacctttgacaaattaacaaatgtcaaataaaatgtgttaaacttttataagtgccaaaataccctctcaaaaatgtttcatctcactaagaatttataagctagtgtttcttcacaccgtgtcactacatgttgacatctgccaatatgataggtttaaaaggagcaattttttaatttcttgtttttgttgtaaacagtgtatttctgttcttttagccaattctattaactatctttttcttcttgatttgtaagtttttaaacttaaaaatcagttcttagacttgtcatctatttgcaaatattcacccaggtttttttttaaaaaaaatctgttatatcttttaaggtgacattaaattgttttaatttaaaaaagactttttttttagagtagtttcaagatcacagcaaaactgaacagaaagtacaaaaagctcccatatgacccctgccctgcttccccaaattccctataacatccgcaaaccacaatggtccatttgttataataatgaacctacactgatacatcattatcactgaaagtccataatttacattagggctatgttatacattctctgggttttgacaaatgtataatgacgtgtatccatttacagtttcaaacagagtagtttcactgccctaaaaatgccctgtgctccacctagtcctctttacctcccacaaagcctcagtaaccacttatctttctactgcttccatagttctgccttctccagaatgtcatatatagtaagtcttcatttaacatcttccataggtttttggaaactgacttaagcaaaataattgtacaacaaaaccaacattccccaatcatcaacactgtaacgaaatgacattattacttgaggacctgttgtacattaattggatatatcagtttatttatctagtcacctattaaaacatcttggttgcttccaagttttggaaattataaataaagctgctatgaacatcaatctgcaggtttttgtgtagacctaagttttcaattcatttgggtaaataccaaggagaagcaagactgctaaaccatatggtaagaatatagttagttttgtgagaaatcaccaaactgtcttccaaagtggctataccatttttcattctgaccagtaataaatgagtgtgcctgttgctccccatcctcaccacaccagcactgatgaactccctcagcttttgtctgaaaaattttttatttctccttcatttctgaaggacagctttactggttatagtattcttggttggcaggggtacttttttctttttttcagatggggtctcactctgtcacccaggttggagggcagtgtcacaatcttggctcactacaacctccacctcctaggctcaagcaattttctcaccttggcctcctgagtagctgggaccacaggtgtgtaccaacacacccggctaatttcagttttgttttttaattctttcagcactttaaatacaccacccatctctcctggcctgcaaactttctgctgaaaaagctgattgtctaatgaagactcccttgttatgtggcacgttgcttttactcttgctgcttttattcacaatagcaaagatacagaagacaacccaagtgtcccatcaacagatgaataaataaagaaatggagggttatacacacaattgaatgttatcctgccttaaaaagggagatcctaccacttttggcatggatgaatctggaagacattatgccaaggaaattaggtggacatagaaagacacatggcataatctcatatgtggggttttttttttttaagccaaatacatagaaacataataaaatggtgattacaggttggggggaaaatagggagattataggtcaaagggtataaagttgcagatatgtaagatatgcccagagatctaatgtacaacctgaggactacagttacaatattgtgttgtatactggaaatttagtaagtcaattttaggtgctcttatcacacacataaaaaggtgactatgtgagatgatggatttagttgactacagcaaccatttcactacatacaccaaatatcatgttatataccttaaacatatacaataaaaatgtatgctttaaaaagtctaatttactgaatacagactaaagtgttcacaaaccttccagaaaactgggaatcatcctgggttgcttcttcaaccttaacccaaatatgatcactagtcatattctaagcctcagcaatatgtatcaaaagcacccacttctcccccatgtcacctaaaaccagccagacatatagtgtaataaacaagaacaggaactctagaatctgacatcctactgaatttctctgtcattttctagctattttttaatgaggttcattacagcattgttttttaatttctggtaaaagttgaaccttttaaaattttaattttttgctagatgcaattacatataatgcttaagttttcctattttgcctaactatgctaatttttttttttttttttttttgagacggagtctcgctctgtcgcccaggctggagtgcagtggcgggatctcggctcactgcaagctccgcctcccgggttcacaccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgactatgctaattttttataatgaacatccatttgttgtataatttgaaatgctgtatcataatcttatgtgtagaacactgtttaacttttatctgacacagaataatggtagaaataagagattaagcttccctgccaaagtgatacaacattataatcatcaaattcagcttatgaaatatataatgcatgaatgatcattttttcatttcttgttttaaaaaacttaatccccagtgcgatagcatcttaggttttacatatttccaatttttctatgagagcataattctgttcataatgagaaaaaaggctgcttttgtttttattagaaactcctacagagttccccttatagttagtatgtagaagattggggaaaacctttgcttctgaaatagcagtaagaaaacagtggataaacaaagaaaaattctatttttctttaaagttatcacacagatatagatccaaataagtccataggaactaatttacagagagggatgagctcctccccagttaacagagagtggtaatcactttcactactgacagcatctgccaagtcaggacacagacaaaggactgagcttgccaaaggagaagccaactaaaatttcaatggccatgcacagacgacaggaatcgaagaagctgcaagcacagagctcctcttcaccagtcagttttaatacatgtctttagctgagtacatgttagcataggaagtcctgggcaaggctggaaagaaataagaatatgcagtcttgccatatttgtatctgaaagttctgataaggtagggaactgaccctccctgaaacctgagtgatgtgacattaaagcaccaaattatcacctttccaactcaaatcctaagggcagggaaaggatcagctcctcaacttggcaaatagagaaaagagttggtctttccaaagaaagtgttatctattttaatctctaatattattatatatacaacacccactatccaattaaaaaacaagagatattcaaagatggagggggaaaaaaatgaccccataatcaagagataaaacagtcaacaaaagcaggccatgttacatattaactggacacaaattatcgaagactttaaaatggaaattatatagctaaaaaataaaggatctgaaatgaaaaattcatttaattggattaagagcagactcaaagtcagggtcacatacatattatcacttgattttcaacaaaggagccaatgtaaatcaatggagaaaggaatgtctctgcaaaatggtgctaaaacaactgaaagaaatgtctgtagtaaaggaataaaaagcagcaaaaaggagccaaactggtaaatatgtaggtgaatataaaatacttctttttatcccttctaatttcctttaaaaatcaacttgatatcaaaagcaaaaaataacactgaactttggggtttatatatttttattaagtaaaatacatgtcaataatagtacaaacaacagaagtagatgaatgaaactagagtggtgtaaagttcttaaattttacatgacgttgtaaaatattacaacttaaataaacttctaggtataacataagtacaatgtaatcacgagaatgccaactgagaaaataatactaagtgttactggtaaaaggccaagagagtaaacagaatgaaacaaaaattatttgattagtctaaaaggcaggaaaacaaacagataaaaaccagagagaacaaatagacaaacaattgcaaaatggtagcctaaagccagtatcaataatccctctaaatataagcggactaaattttccaactaaaagacaaaaattgttagattaaataaaaccaaaaatatgctgtccacaagaaacacaccataaatataaagattcggatagactgaaacaattaaaaatatatcatgtaaccagaggtaagaaagaagatatggtgatgttaatatgaaatgcattttataattagggcaaattaatttggaagatgtataattccaaatgtgtatcatctaataacagaggttaaagacacacgaagcaaaaactgacaggactaaaggcacaaacagatgactctaaaatcagagctgaaaattttaacacttatcataactgacaaaataaggagattttaaaaaatcataaagaattaagaagatgtaaacactatcaaccaccctgacctaaatgacatttggaacactatagtatatacattctttccaactatatatggaactcttatcaagataagttacaagttatagcataaaataattttcataaatttccaaggactaaagtcacacacactatatgctggactgttaacagaattaaattagaaattgatgaagtatctagaaaatcctcacactcctaagaaaaacccaaacttctaaataactcatgaatcaagaagaattagaaaataagtgataatttaaaaacaacataaaatttgtaatatagagctaacataaagcttagagggaaatttatagctttaaatgtgtacattataaacaaatcaatgatctaaatgtacaccacaggaggctagaaaagaccagattaaatgaaaagtaagcagacaaaaagatgaatacaaacaaaacagaaaagagacaaagacaacaaagactactgattaatccattacaagacattctaataaaaaattaaaaagtcaaattactaacattataaattttaaaatggatctcacatatatgaaaggaataacaaatatcagaaataactttatatcaatacattctccagccttggcaacctggtgaaatcctatctctaaataaaacacaaaaattagccaggtgcagtagcatgtacctgtggtcccagcttctcgagaggctaaagtggggaagattgcctgagcctgggaggttgaggctgccgtgagccaaccaggccactgcactccagcctgggcaacgaagtgagatcctgtctcaattaatcaatcctatgacttaaatgaaatgaacacatttctaacaaaatccaagtttatcaaacacatacacaaaattaaaaatgtaaataattctcaatttaaaaaaccttttcctacaagagatggtttctctggaaaaatcaaactttgttttgaatacaaggtctcgctgttgcccaggctggagtgcagcggcgcaaacatggctcaatgcaacctccacctcctgggctcaagtgaccctcccaccttagcctcttaagtagctgggaccacaggtgaatgccactacccctggctaatttaaaaaaaaaaaaatttttttttgtagagacggggtcttgctttgttgcctaggttggtcttgacctcctgtgctcaagcaattctccagcattggcctcctaaaatgctaggattacaggcaagaactaccatgcccagccctatcaaaaatttaagaaagaaataatgccaaccttaaagaaactcttcgagaaaacaggagaaagccctttccaacacattttatgatattaaaactaataaacacattacaagggaaaaaaccctacagaccaatctctcataaacatagatggaaaaattctcaaaaataaaacaattcaaatccatgaaactatatgatcctctttataaacgcagaaaaaaaatttgacaaaattcaacagccatttataaaacacaattagaacattaagaacaaaaaggaaaaagaacttcctcaatcagatacaatctccaaaatatccacaattaacatcatacttaaagggggaattgtgaaatgtgttcttcctataatcagaacaatgcaaaaatgtccattcttatagcttcaacagtttattgtaggtcttagttaggacagaaaaagaaaaaagcatgaagactggggaaaaaaagaaaaactgtcagccgggcacagtggctcacggctgtaatcccagcactttgggaggccgaggcgggtggatcacctgaggttgggagttcgagaccagcctgaccaacgtggagaaactccgtctctactaaaatacgaaaaataagctgggcgtggtagtgcatgcctgtaaacccagctactcaggaggttcaggttacagtgagctgagatcatgccattgcactctagcctgggcaacaagagtgaaactccttctcaaaaaacaatcaaacaaaaaaaaactgtccttatcaacagatgacatggctgtgtatgcagaaaacctcaagaatctacagaattctagaaccaaaaagtcaatttaacaagaatgcaggagaaaagaatatacaaaaatcaagtatttcccatatcctaggaacaactggaaaataaaatgtaaaaacaaaaacgtataacagcactaaaagtataaaatactaaaaaatttatctaatgaaagacatgctatacatctacatcaaaaactgtttaacacatggcagagaaaaggcattgttataagactattatcctgaagttgtcaaacctgacccctcatttttgacaaaaatcttactttcctattttatagagctgatcctaaaccacaaaaatcaagtgcttctgtgtctggatctcaattcttcactttccttcacatctttgtgcaatccactatcttcctttttcttaatggttaactcctcttaacattttaactaccttcatacagtgcttattacaggttagaacacatagatgccttataaatatcagtcctattaatactctatgagttaaatgctattattgtccctattttacagatttaaaaactaggttacctagctagcatatgtaagaggaacatttcaaactcagatagtctagctcagagtctcactatgctattttgattatatgcatttagttaagaggagtaagtcttgtaagtggagtgtatgggaaaactgtctaggagtacaaaaaactagtagtttacaagaagaaaaaattaaaatgtattttctatttatttaatctcatccttcaatttctaatttttgtatatatttttaaatgtacttgaagtacctgtatataacttacaaataattaagtgtacatattagtaggatactctcaaaatcttaatactcactgtattagcttcctagggcttgctctaacaaaataccacaaactgggtggcttaaaacaacagaaatttattttttcagagctttgaaggacctaagtcccaagacaaggtgtcagcaaagccatgctctctcaaaggctcaaggggagaatctgttccatgcctttctcttaagcttttgggtttcccaacaatcctaggaattgctcagcttgcaggtgctaactccagttacctgcctccatcttcatatagcacattcctccctatcttataaagacaccagtcatatagaattagggcccatcgtacttcagtatgacttcatcttaaacaactacatttacaaagatgctactcccaaacaaggccacattctgaggtattggaggttagcacctcattttatcttctgggacacaggcagattaaaaaaccctttaagtctctttgtgtatcttggaccaagcacagtgtatgtagaagatacaaaactgaattgtgagttatgaaatccacatcttatgatctattatattctatttctctatatacctgtttgaacaaatatgttcataaaaatcatgacttgaaaagggactgattatacaatactacaaaggttaatcgaacttataaatttcttacgatgtccagcctgatctctaatatccactataaaggaagaataaagtcttgaccagcaaaatctaaatcaaaaaaaaaaagaaaaaagtaacaagtgcttgttcgtacacttacttattatgcctaatttatcctctggttgcccttttaaaaaatttcaattcattatttttaacagcaggttatgaaagatgaatttaattatgtccttccttctggaaggtatgaaccagagttagagaggtggccaactttgttctaaattggagccctgcatcagtcagaattgtttcttgccatggccccaagagagaaactgatattgggtaagaggctggcagccaaactaactgttggcatctcatgaatcacatattcccattgccatacagtaatttttaaacctgtcattcagaaagccagtaacactgctccactgaaacagaaatattaggttgggttcaaagttagccccaacactgcaattattttagctggctgattcagcttattctccacttttgtactttgattcatttatcatacataacgaatacttgtattattgctcctcctgtgtttcagttatattgctgaataggtgtctgtgcactaaattagaatccctgcagccttttttttctggcttatttcacttaacatactgctttcaaggtccatccatgttgccacacgtcatgctatactgtcattcctttacatggttgaataattccattgcagaaacatacctcattttattcatccattcatcatttgatggacatctgagttgtttctaactttgaatattaagaataatgcctgcataaatggtcatgtacaagtttttgagtagacatgttttcagttcacttggatacatagctggccacaatatgttaactctgtatttaactttttgaggaacaggaaacttttccaaagtgttgaaccatttaacattcctactagcgatatatgaggactccaatttctccacatcctcaccaacatttgttattgtccttttttgattatagcatctagtaggtgtgaggtagtatctcactgtggtttatgacgttcagtatcttttcccatcattcacttttaaatgtcacagtaacagctgtccatcacaggcaaaaaagaatattattgcttcaagaagagtgtcatctaattttagtaaaacatatgtggaaagtcaaatattatttgcattaagatgtataacacgttatttccaacgttcattagattatctacctttcttagttatctggtactcctaaacacccaaatgtatgattagctacagcagaaacttctttacctgggagtccaaaaaaacggatttaaacaagagaattattgtaacccctccctcccccaccaatgttaatccacttaaaaataatttagattatcataaccaagaatgcattagtgttaagatgtggagaaagactgatggtataatttgtcaggttgtgatattaaggtgtccaacagttaagatacagacaggtaaaatgaatcaaactggacaattacaatgacatcaaagtgatttcactggtagtttattagttctgctgagttatacattttattacgtaagacgtgatttaaagctttaatttttttcttcatcactttttggagttgatagctaagcataagaaattaatctactataattcaaaactcactattaggttaaaaaagcagtgaaaagctgatccccatccttcacccccaaattcctctgaaaatctgttatttgagtaattatggttttttatcacagagagatacttagtcatagggttactaaaattttcaacagaagcaaatacttaaaaagaaataaaagtatgtgcatgttttcaaattttcatttactctaataaaaaataacaattattctgcagagtagcatacgttataatttttcagtgacaacatggacctctttggtagttcagatatgttaaatcaagatagaagatcatcttttttggtatgcgtctcaacttctctaaatttaagagtaacatcttttgtgaatttcaaacaatacaagaaatgtatatctaataactgaggaattttcaaagacattttttttacctgtgtccatactttgattcaactgttggtcacttgtttctccatcttcactgatatatccaggaggtggcgtttctacaaaagtttaaaacaaatcaagcacagctgcaacataatctcactaccttttctctcagctaccagagataaccaatgaatcactccaaataacaaataataatgttatataatattataaaaagtaatattgcatactgagggtgtataattcaggatcttgtccaaattttgcagtgaatccttaacatccacttttaataaaatcctactctctggacatacacattatgtacgtatcttgctcattcctatatgtacatattctggggcaagagccaaaaacgtaactttaaaaatgcctcagatctgaatcagtaggctgcaaaaccatcagtaactacaattttttgttgttgttgtttaatctaatgaacatcgttattttatgagtacttagaaaattaaaaaacacacaagattttggattataaaagtattaaataatacaggcttacaacttacactaagttctatagggtaaaatatggtagagtatggttccggattggtccaggctgaattctatctaaaaagtgtgtttctccaaggattcctaactggtaaagtctaagtgtttgaagcagaaaattcaattcaaatatagactactgtataaagaggtaaaatgctccctgaaaataaccattaggattctaatatattatttccaacatgttgtctgaataaaacacttatgttcagaaaggtatctgaatagctgaataaactgcatgtaaaataaaaacatgtatacaatttaatcaactgtaattccagggaggaaaaataagttcagaagactttcatcagttttacatttacactgaacagttttgagcgattcaagataacaaagacacatatccaaacaattttaaaattatcaaaagaacgaggccaggcgcggtggcttatgcctgtaatcccagcactttgggaggccgaggcaggcagatcacctgaggtggggagttcgagaccagcctgacaaacatggagaaaccccatctctactaaaaacacaaaattagccgggcatggtggtgcatccctataattccagttactagggaggctgaggcaggagaatcatttgaacccaggaggtggaggctgcggtgagccgagatcacaccattgtactccagcctgggcaacaagagcaaaacaccgtctcaaaaaaaaaaaaaaaaaaaaaaaaagaggaagagaagatacaggttaagggtctccttcaataaccttttacaatatctattcaataaactaaccacaaactttaagtatcaaacttttcatttaagtgtcagtacccccaaatttttaaaacaaaaattctaagaataaattatcttcatatactcaaagaacataaaaataagggtacatattatgcatattttaaaagttaaagctaataaagttaaacggcgctaagctttttgagtttaacctgtatttcaaagatctaatcagaaagaaatgctgaaccttaaaatacgttatcttactgtgtttattttttccattattgtaataaataataaagctattagcatttttgagaaaatgttaaaatttcttttaagtggaataaaatgtgaaccctttggttttgctgttgcttgaaaccggataaagccccactgtccagaaaagcaaatgggtataatccacttctgattttctactttataaaatactcaaatctcaataattaaaggaataaaaaagaaaggaaaaatgagcccaaacatcttcacaagtgaaagccactaaacattctggtgaatagccttccaaataattactggatatgcgtgttgtccctaagactgcatgtttatacctaaggttagtattgctggctgaataacagtaattcccacactaacgacttaaaatgcctccccttccccacaccaacgttcacacaactccactcccttttctacctagcaattgccctgtttcatagtcccgggttttccctcctcctagtgttatcatactacatcccaccctctccctctcttaacttcagtaagtttgtatttcctagcaacccataaagcagctttaaatcctcttctggaataaaacagtaatcaaagaaatatacattaaaacaatcaaaaaccacttcccatttgtaaaaccagctatttaaaaaaaaaacttatctttcttagttatcttttcttttttttcttccttacatttaaaaaattatcttcaatgaataagcattatttccatgatggatacatgaaagaaataattgtttaaatgtactaaaactgtattttaagaattttgtaaatgctcttaagttccttacatatttttagtgtataaaataagagtggaataaaagaatattacaaaaggaagaaagaaatcgagacactacagcttaatcctcatcctaacatcatgctgtttctgctagggagaaaaatcaaccaaacaaaaaggaaaacatacaagaaaagtaacaaagtattagttgttctccaaaaaaaaaaaaaagaaaccataaaaaacgaaaaggccagatatcatatcgtggagtattactggatcacataatacatcagaacaaaatttgagaaccatgtagctgaattcaattttcatcagaaattactgagatgcagacgaaacataattaaaggaggttttctgacgttcgtgttataatatgtaagtgttgctatgtctatagaactaagtattatatttcttatagaaatgttatatttctgttaaatattaccaagttatctaagaaaaagtgatcattgggtggatattcagttacatgtgtttggggggtacttttctcctacaccatttgttttgcttacattctgcatctcgcttagcttcaacaactaagacaaacttactaagatcttttcttttctgcttctcacagtactttgattaaagtcactgcaaaagaaaatgaaatataaagtaaaactcttctccaaacaaaactgtttaatgtactaggcttatacatttcacaaaataatcacccaacgaatccaatttttctattaaaaactcaaaagcatttttaaaaaagtgaaaccacaatttactaaaacttgaatgcttatgaacaaaatttgtatctatccaagttttaggagattcagaaggcaaaaatacctggaatataattactctgtggctcaattcctgctgggaagttagtgttttctggaatggagtgagtatagtcatccagaggcggaagttctgttaggatctcggtgtgtcggggcactaatactggaggcaaaactgaaaaagttcaagaaatccaagttaatggcaaagagcaaaggggagtgggggaaccttttttaaagttttcaacaagaagagaagttgtagcttaatttttaaagctagggtccacctactcgatatatactagttactgagaaaatgacaaatctgattatggctctaacttaggtagtctattatccaaatttccaagttctaatttatctcaaacttttgggaacaatgtgatcctggtaatattatattaccataaaagttcataaatccccattggaaaacttaacattgtctttatctgtaaaatcagatataggaaattttccaaaaacgcagctactgctatattttttaatagtttcaggtagacagctaactaaatgaaaagtcttgttacaagctttactaaacggtgtacatacaaatgatgtcattaaagtacttctaaaagcactccaagtgcaaaatgcttgaaaatgttactgcagcagggacatgtagaagcacatcagcatagcgctgagcagactgccaatctacaggatttcctggatatgcactttcatgccaaatcatatgctattccaagaaacagatatgttttctcattaaaaatttttaaaaataaaaaaattttaattaccaccaaataatatgcacaatttaaggtaatttattagaatttacactaaaattttcctgggtcacaagagtacttaaatatactgaagttcaggcatttaattcaaaaccaagaaaaaaacttgcaatattcctacctggtgtctcaactctctgatagtggtaagggtttacacatacttcatcctttttaagattaaaagcatattcgcagttttcaattgccttgagttcatgatgactgtgaagatcaggccagcgccataatcggcaatatataacatgtggcaatccttttcgatgggatacctggagacgaccatcaagagacctgttgggaagcaaggggaaaagaaaggagggaactttaaaaaaaaaaaaaaaaaagtgcagtcaaatgggctaaattagtacaataaaagcataaagaaaagaatgacagccatttagttagttttagtgagaatcaagaacaaaaatgtactatttaatggatctgataaaagtatgcagcagcactagcagatgtttcttataaatatgtcacataaatgactcaaatgccaatgaaaggctaacaacttgggaaaaactgattttttaaaaaagagagtttatgcagttatacttgaaaaactttgtcaacttctatgtttagtaaatcaaactcattttagagatgcttctaaggatattaattctggaggtgactgaagagtcagaaaaggaactagtgtgaagaatgataaataccaacaatgatgtgatagtaacttcctcagactactgcaactctttacccagttgtgactgttttgagaactgaggtatatttatgtagttcacaaataaatgtggatggtgatgaatatgatgagatgaaatgaacaaataccatatacgcaaaaaagaaaatgaagtgattaaaaaaagtaacataaaaatgagttaacctactgttaattgtgatataaggggttcattaagtatgtatttattagtataaagatgagattctgataacaagaaatttagcaaaactcatcatgtatctacttaaaaattaggccaacaacagattataatctgatctcaagctaaaataaatatatagttatcaaaattattattctttaggggatacagtaatttaaagaagattcaaactagaattgcattgattaaaacatcagctgaaacatttaatatattttttatactggcaagcagatattttaaatgctatgccttattttacattaaggaaacatcctaggcaaaattatactaagcaaccccatataggtctttcaaaatatacccccctcccacaagatctctaagattcgacagagggcagaatattcacctggtttgttcagagaagctgtaaaggcctgttgtatcccactgatctatcgtatttggtgtactcagtccccaaatttcagagcaagtgctgtgcataaattgaaaaacaaaaaattgatgtgaacatggaagcatggttattcaaaataccatgatgtaaaacatggagaatgtacagaatacttccttcacccagaaaatatacaattgcttcactttttcacaggcatgtagtgctggttactatattttctatatgaaggaagccaataaaatggaacatgtgactccagataagtcatgattatgtttttaaaatgtgaacaccaacgccctctagctcaatgaatcatacctataatgcccttaccactttcctgtattcaaaagatctaaaacctctgccatcagctttactaagtgcttcattttataatccagttttttaaaaaattatctaaaaacagatgtcaactgatttttaatatagaaaaaaatcccaataaaaatagacatgcatccacagttaagattttcaggttatctggtcatgatatttttaagttttactgaaaattattttgttctcatctctagaataaataaagaaatagactttgaagtcattctaatttagtataccaccttaaaaattttctcccacatttctctccagaatatgggcagctcagagataattctccctttttccctacctttatttcatttcatagtaacttctggtcagtgagagaagggaaagagagcttaaaaggaagttttggaatggaactttgacagccaatgtctcaagtactaagttgtacttttctgaaaagtccatttcttacatattacaaaatcatcaaaacttcaatgcggataaaggagtatttcaaaacatcttttgaaaatgaatcaagcaattgattaaatttcatatttacacattgttagtgagcttaactggatcaacagttcaaagggcaatggtgagaagcgctggcttcctgtggccaggcaacagaaccacctggcatccttggctttagtactacaggtgctgtcacatagctatcaggctgcaggaacacatcatgccctgctttgggggctacagtgacccgacagttcaaaacaaaacctgttctgaaattttccagcatctcattcaagtattttatagattctcttgctttttcaggctgcaaaatttaccagactataaaagccagaaaaagccaggtaaattaaggcttagacctttcccttttttccaaagatatactgatttaaaaaccatgacattaatggtttatttaaaagatattttcaaatatctattggaaacatatagcatgatgtagtttaaatcacaacagaatcacctcaattctacagacttctgagtctattaaagaaatggtatacaggagactattctttgaaaataattaacaaaagtgtagcacaagaggctattctgctctgtatcagaacatttcactcaagttattctgggactcacatgagaaccagaatctaaaatagagcatgaagtttacattgtactttatttaatccttgaaaggaatcagagaagaataaacagtaattgttaagaacttgcaatcaatctagaggcagacagatctagaccccaaccctaattcggccactttccaactgctgccatagggtatatttaagcctcagttccatcattatcatgcctaacaaaattggaaggtttattttaaaacattaaatttgcttctagctagtaaaatcattgcctgtttacataataaaaaatattttttaaaataagccaatttataataaaacatagagccctctgtatccaagggttccacatccttggattcaaccaaccgtggatcaaaaagtagaaaaaataagtaaatttttaaaactaaaaaatacaacaattgaaaaatacaaaatttaaaaacaatatggtataacaactatttacacagcatttacaatgtattacatattatgcataatatagagatgacttaaagcaggagtctcagaggccacagactgataccggtccacggcctgttaggaaccaggacacacagcagaaggtgagcagcaggggagagaccattaccacctgagctctgcctcctggaagatcagcagtggcattagattctcataggagcaagaaccctattgtgaactgcacatgcgagggctttaggctgggcactccttaagagaatctaactaatgcctgatgactgaggtggaacgtctttatcccaaaaccattgccgcaccaccacggtcagtggaaaacttgcctttcatgactctgtctcctggtgccaaaacggttgggaacagccgatttaaagtatgagaaaatgtgcataggttatatgcaaatacaatgccattttatttttaaaataaggcttactgcggccttgacctcccagcctcaagtagttctccagcctcagcctcctgagtagctgggactataggcgtgtgtcaccacgattggctaattttaacactttttgtagagacaaagtctcttgagtcctggactcaagtgatcctctcacctcagcctcccaaaatgctgggattacagaagtaagtcaacgtgcccaggcttacaatgccattttttatcagaacttgagcatccactaattctggtatgagtgggaaatcctagaaccaatcccccttagatagtgagagttgtataagcagcatctagataaatgtaattaaaactgtgtcaaactatacaaagaaacattttaaacataactaaagaacacaaaagtgcactgagcaaaaaagaaaaacatacgtccctacacaggaagataccatcatagaggtattaactctaccaaatttatatatttgatgcaatctcaataaaaataaatgttttaaaaatccaggtattagtccaaatactgtaataagccaaaacaaataagtatgaccagaaaattctaacaaatagtaaagacctgtcctaccagattctgaagcacataataaattctcaataattaaaacagtatgcaattagtaaaagaatacacaaaacagaatggaggttctaattccagtaatggcagagcagcctcaattaggctaactttccttcatataacaatgataaactctgaacaaaataatcaactatttgaaaatagcagacacagatcaaaaacagacaaaagctgaagggaggtccaactgtcaaagctgcaaactgtactggatgagagctgcatttctgtggctgtgtacccaagggcactccccagccacagctaggcagggcaactagaattcaaacagaacactgcaggggggttgtttttagaaaactgcagttttactgacctagaatcagaggacacatttggggctgccagagagtttgaaaaaagaaggaagataccctgtaaagaaagaggcacaagggaaaaacatcaacaatgtgactgtgaactctgcccaaactcaactttgctcaaagatattttttaaaagctaagtatatagagatacagcatattcacagatgagtcaatattaagatgtccatctgacctaattccctaatgattgttgcctatttgttttatatctattacagtgaccatttcagcaaaaatatttttgtagcaactgacaagctgatataaaatgtatatggaaatactaaggatcttgaatagcaaaacaatcttgaaaaagaattactgacccatggatgaatcttgggaatattctgatcaagagaagctgaacactaaagtatctacactgaatgactccacttatacgaagctctagaagtggcagaacaaattcaaagtgaaaaacaacagtaattgtttccagaagaaccgctaggaaagagtatgaaagaactttctggatgattgaaatttctttatcttaaaacactggtatatgcatttgttgaatctaactaaactgaatatatgatttgtgcacttcacctataaaaaatttacctgaaaaaaggaaaaacacaaaagaatgcaaagaaaagtaaaaaccaaaacagaaaaagtcccaacaaaaaattcatagaacaatttagcatatgatgaaggcaccctatgaactgatatggaaaggtctaaaatatgctactccctgtattaaaaaaggacaggtaaaaagatctgtaattactcactaatatatgcataaagacacacatacatcatggacagtagttacttgaggtgcagagtgggaagggagaggttccaatgtatgtgtatatgcatgcttgtatgtgtatacatacataaacatacgtatttttgagccatgtgaatgtatattgcctttcaccaaaattgtaaaaataaaacagaagaaaatattgccagagaataaaatgcaagtcaatgtcatcttgacacttctataaaaagatatggttctaaaacattagaggcacattacttcctatactgcatcatttaaagcgcagtttgggcattactataagagacaaataataacatgccagcctgagccctgatcattcttttctcacacaatgtcctttctgtctcacatgaacctttggtaccaattttcttccatgtgcaatttatgttaactgccccttcctagccaccttttaactttactactaattctttaataagtctaacaaacgaggtcaatttttaagatgcctttggtaggttttaatgaggcagttttaatcacccactcttccttaaagattctgtctaaccacaatgtatttcccaacaacaccctgagctcccaaagccctttgtgtaccacccagcaaacaacatatttggtgacccaactggtattttcatagtacaaaagtggattataatattccttatcacattaaatcataacatcctaaataacactggggaaaaactgtatctcccaggttttcattttgttaataaaaagtgtaagttataacttctaggtatggccagtttctaaaaaatattaaaagaaacaaatgcaggaaaaattttagagaagtagcactgattataacaactatataaaaagctttttacacattcaataaatttcactaatctaagattatctactttaaaatgcaacattatttgtgtaacacttgaaaatcctctttcaattttatttataaggggcatctcaaagtgaaaaaaatgtgcatcttacaaacaaatatttaatgacaattgtcttcataagctagctactttatatcaagcactgtgtaagactaaatggattagggacctcaaagtaacctgcaagttatgtaaaaatagtatccatcacctattaaattgatgttaattggaattttgtgggttatataactgagtataaatttgtcttttggttagcgttaagtttgcacttaagtatgtttctatacatttaaataatattaaaggaagtccacaagaaatgtctgtacattactcaaatgtgaaaaacagaaacctgtacaacatcaagctgtttacaaagtactaaggatagaaaataggtctgaaaatgttaaactaagactacttgctatgtaaaatcaacatatcctaaagagattattaagttattataacaatgatagcaatatcccaaacacattggctcaacatttcctaaatttatttgaccatctaacttcaggatattcttaaaactctcatgtattgaaaaatatcagcaaaaattggtctcataaattctgcctgaacaaatttgatactgtttactaacaaattaatgtgaaatattacaatatgttgaaataagatgtagcagaccattaactaactacaatgatgtccctgcatcaatatacagatgaacaagcatacgtatgttatctcacgcaaagtcccaaagttctttgcatggaacagtttcttaaagacagattatcccccatcaactgtgtaatgttcttgcttatatatctagcttaaattaaaaagaggtggggaggagaggcaaaacagctattaaagtcataaacatactaatatagcaactacctttgttggcatacagtatattaatcactaaactaacaggatgacttggtaataaacctaatagaaatccttatcaaatttccctagtaataacttttacaataagtatttcagtaaaacacatcaaagattttcttcatctaagaataagctgacttttgaaaactgaaattaaaatttaatatctagtgtacaatttacaaagtatacactcgcctacatatatacacatctaaattaacattttgcactttgttccaattatccagatattatgtttggtcaatttactactttttttgcgttaaggatatagatatttattcacatctttgttatggagaaagaaaagagaagcagtgaaaattaagttgaagaaaacactaccaactttgggcaaaaggtggctcgcatcacagaatctggtaaccctttaaaccagttttactgttcctaccatatctgcaagatttactgctgcagttagacaaccaataacaaaagtaataaaccccattgttttactaatttattatttttcatgatcttcttgcctaaacagtgtatttttttttttttttaacaaatcaaaagggataacaacctaagttgccaccttggtaagattaaaagcatgctgaacactcagtaaaattagtcaattagcagaatattatcaacaaaaggaactttcctaaggctccagctcttgattactgatctactcatttaatacagacttctaggggagtaatctgtaactatgcatccataattatttctacttaaaataatcctttcatttttatatgtgacttaagactaaaagtttagatttaaacagctcaggaatgaagagttaatcactgtaataatttttttaagtctccataattacaagtactatgtgtggctgtatattttatcttgactacaaatataattgaaagacacaaaatagattgtagtattcaattacaaatgtttaaatgtcatttatcacatcactgaaaacaatgtgactactttgattaaacttaaatttttaatcaatgattaagaatgatagccttttatttgcctcagaatccagtctcttccccatattttatttgcaaaatgtagacaatcctgattgagaaataagtaggtgcaaatgattttttaagttgctgcattacagatgcaaaaaactgtatctcttgaaaatttgagatattcctgaataaaaattgaaaatataaaagaaatatattaagaaatttatttcaaaaaggttgaatcatcaacaatagctaataagtgctcacattccttcataattaaggcataattgggcagtaattaaatctggagacagtttaacagggtccttaactggcttaaaccttcactctgtgtagaaaatgtttttcgattttatcttgtagcaatgaaatagtaaccattcaaaaacaaacagtcaccaaatgtgcattccggtatgtcagggtttcattctaagtttcaaatcagaacagagcatgtctacattccagatacccaagctgtacagagctctaagtagagctcaccacacaatggtgtggtactgttatttgtataattttataagaacacacatgaaacagaattttaaaaaataaactaataccaagtcttcctaatcggtaacatagtaagtccaaataatgtccagatatgtgaggaatagctttattccaaggtctttgatgctcatgtaataagtacaattttaacaactaattctattacaaaagactgcagaaagctctgtacagctggatccctatacgttcttaagaatcaagcaaacagcctgtgcaacaaagtgagaccccatctctacaaaataattaaaaaattagccaggcatggtggcatgtgcctgcagtcccagctatttgggaggctgaggcaggaggatagtttgagttcaggagtttcaggccacagtgagctatgacgcactactgcactccagcctgggtaaccgtgagatcccatcttaaaaaacaaaacaaaacgaaagaatcaagcaaacttttggagaggaatatctcagaaaagaaaaactcaacagtttctaagtatttattccaacttctcagatacttccatgaacaagctttccatcttctcctgagttctgtatgataaaaaatttcaaacatccattaaagttacgagtaagcaccctacacattgatcagctaaattctgtaatttggatttgttttcttttgctctctcatgtatctacttaacctctctatccatcccttactttttggaacattaaaaataagggtgtatgtgggcagcctgggcaacatggtgaaaccccgtctctatcaaaaatacaaaatattagctgggtgtgctggtgcacacctatgctcctagtattcaggaggccgagacttgagcccagtaggtggaggctgcagtgagactgcaccactgcactcactccatcttgaatgacagagctagaccctgtctcagagagaaaaataaaagctgcagataacacaaatctagacacttaagaatgcacataactagagttcgctgttctttttttctttaggttaaatttacacagcatgaaacacacatcttaatggtaccatttgagttttctcagatgcatacattgtacacttctcaaccctgtcaagatcatcacccatgtccatttctcaatgtctggcatccatgcgctcatccccagaggcaaccactaatctgatcttttcaccataggtgtcgtgtcttctggaaagtctatgtatgaatggaatatggtacatattcttttgggtcttttttgactcagcatgattttgagattcatccatgttaatgtatatgacgtgtgtgtgtgtgtgtgtgtgtgtgtgtgtgtggagtcgttttccattacttgaacaagcatgatttatttagtcattcttatactgatagacacctgacctgttgccaggttttaattattgtgaataaagttgtcatgaacattcaagaaagtacatatcattatatagaaatatgatttctttttttctcgggtaaacacctagaagtgaaaatcttgagtcagtggatagatgcatgtttagcttttcaataaattgccagatcattttccagagtacgattttacagtcctccctctttcaatgtatgagagagagctcctggttattccaaagcctcatcaacatttggtgtggtcagtctttaaattataggtagtctgatgattgtgcagtggtatttcattgtggtttcaattgtcattttcctgaagcctaccgatattacacatttttccatttctttactggacctttatcttcagtgaagtagccaactactgtccattttaaaattaggctatctttacattactgagttatagaaatctttataaattctagattcaatcctttcagaaatgttttgcaaatattttctcccactctgacttattttttaacaatgtattttaataatatgttttgtataccaatggagtctaacttagcagctttcatggtcactgctttctatatactttgaacaattctctgtttacccccaagtcataaatattctcctatattttcttataaaagctttatagttttagctttaattagactacaatttatccagaaatattttgttttcactggtgtaaggtggagtcatgttcattcttccacatggatattcagctgttccagcaccatttgttgaaagactttcctttccctactgggttgctttggcaactttgttgaaaatcatataggcacacagtgtttatctatgtggggctatcttatctgtttttatgtcagtatcacactatacagattactatggcttcaaggtgagtcttgaagtcagggtaatttaagtactctaacttattactgagttttccaattcacaagtgtatccatcagtttactgcatggtaattccaacatgtaggtcttctagggttggtctcctcattataaagggtcacattttctttgttctttgtatgttaggtaatttaggattgtatgctagacattgtgaattttatctgatggtagttagaggttctgttacaatcttccaaaagtcttcatttttgtttcaccagacaactaacctggttgcattcaaaccacaaactctgtcctggagcaattcaaatcaggctgattatctggctgtactgtctaccgtacacatgtgggatcagcaggtgattttggcaaagtttgtaggcagaatccagggctctctttctgaaactctccttgctgatattcactcctcactctccaatagttgtgattctcccaagtcttacctatggtgcttcaaggccagaaagacttggttttgtgttggaattttacctaccctgcacactttgcatggacaaaagctgtaaaacagaaaattcgcctacgccatttccttcttccgagtgtcaatcccctctaaaacatgcctatttttgtttattctccagtacttcatgttatttttagaattttgtgcagtttgttattgagggagtgtcagtctggtaagagcatacctggccatatgagaatcacaactccctcttcatttgtttaacttctctcagcaaggtttcagcattttaagcagaggtcattgtgtgtgtgtgtttaatgtattcctaagtatttagtactgatgctactattcatgaattttcttaacacccctatttgtctgctgctagtatttacaaaaatacaattgatttttagacactgaatctataaagtgcagccttgctaaatttactcatttgttttagtggctatatttatagattctttaggatttcctacataaataagcatgtcatctacaaacagaattttgaaacattccttcagatctttaaaccttttatattttgttttcctgactcattgcgcttgctaggtcttctattaaaataataaggacacaagagtagacatccctgtcttgttcttgagggaaaacacagtatttcatgattaagtaaatccttagctgttagtgtttcttaaataccttttatcagactgagaaagtctctttgtttctcatttgctgggaatgcttatcatgaatggatgatgaattttgtcaaatgcttttgaccaagtgaggtgatcttatagtttccctccttggttaatgcagtaaattacatagtttttttgtttgtttgtttgttttgcccgacagggtcttgctctgtcacccaaactggagtgtggtggcgtgatcactgctcactgcaggttcaacttcctgggtccaagtaaccctcccacctcagccttccaaataactgaaaccacaggaatgtactaccacgcttggcttttttttttttttttttttttttttgtggagacagagtcttatgttgcctaggctggtttcaaactccttaactctcaagcaatcctactgcgttggcctcccaaagtgctgggattagaggcataagccatcgcatctgacctgattaatttttcttttttcgggggtgggggacaaggtcccaatgtctcatgcaggctggagtgcactggtgcaatcatagctcacttcagccttgaacccctgggctcgagtgatcctcctgcctcagcctctgagtagctgaaaccacaggggcatgccaccatgcctgggtgggtaattttatctgtctatagaaatggggtcttgctttgttgaccaggctggtcttgaactcctaggcttaagcaatcctcctgccttggcctcccaaagtgctgggattacaggtatgagccgctgcggctggcttacactgattactttttgaaagttataaactaaccttgttggaatagaactcaattatgatgtattcttttctcatgtatgttagtgatatattaatctttaacttttcttttagttgcatctttgtcaggttttggtttcagggttatgtgagcctcataaaacaacatttttctgagtttattgtctataagattggtgatatttgttgcacaaatgcttaaatttaccagtaaaaccatgtgggcctgaagtttcctttgcaggaaagcttttgattatgaagtcaaattctttcattgttatagggctacccagatcttgtatttcttcatgcatcagctgggggtaacctaaatttcatcattacagttagtcatcaaatttaatggcataaaattgtttataatatttgcttataatctttttactgtctgtaggacctaccatgacaatccctctttcagtaccaatataggtcatttgtgattgtgggctctctgtctttttcttgatcagtctaacaagcgtttatctctccaaagaactcgcttttggctttctgatttctactcttaattttattatttcttctttctacttactttctattttatctttttaggtaactttctttcctagcagattatttaaaactataaaattttccattaggcactctttcagctacatcccacatatgtgatatgctgtattttcattataatttggtttgaaatatattttacctcatttttcccctgaataacccataagtcagaattttaaggtttaatttccaattcttaacagatgtcttattggtattaatttcttattctattggtggcagagaacatactttggatttcaatcttttaaaattgattgagacttgtgccctgtaaacagtctttcctggtgaagttaccatgaacacttgaaacgcttgtatttctactcatgttgggtttagtattctataaatatcacgtaggtagttaataatgtaacttaataatgtaacttaaaacttctatgtctttactgatttttttgttctaattgaactctccaattgtggatttgtgattctgtcccattaattctacccagttttgctgcatgtatttttaagttcctttattaagcagatacaatttattgttatgactccctgatgttggtgatttagatatatcactttacaatcttctctgttgctgatcacctgtcatttgtatgctgcgtgccatttttcaccagctgctttaagattccctctttcatgagtttgaccatgatatatctaagtgtggttttctttttatttatcctgtttgtgttgaataagaaatccaactccatttctgatacttgactgctgataggtttcaagccccaccatttcctcttccccttctgcctcgaatctgggcaagctggtaagaaagcccaggtgctccacctgttgatattagagaaatttcaaaccaggcaagtctcagcatatgtacagtgtaaaaaccagcccacagccccattccctaatcaccataaaaccccaagccagtctcctatcactgctctctcaagtcatttttggaccaacttggaagcctgccatgctctactcagacagcatcattatgtgagtaataaaccttttcatgccctcttggtgcatgtaatataggtgacatcatcagtttcacttcaaaatcaaattttatatataaaatcccatcccacatatagttcacacttattaagcaccaactatgtaccaagctcttacacatattaaaccgcttaatccttcaacagtgccatgaatcaggcactgttgtccccatttgacaaatgaggtaatggaaacacaaagtaacacgtctaaggtcctacagccagcaagtggaagagacagaggccacatttttaattattaacattattccgccccatatatagttactaaaaagaaacaagtaatataaacatagcaaatcaaagctaaaacaataaaactggtataatatcccaggtatgtaaaacatttacacaacatgtttaattataaaaactgaagatttcactgtaagagacattttctcaggaaagaaaatttctttggacaagtaaattgagaaagccccttccaaattaaaataagcagcttaggtttccaaatattaataactaaataaaaaataggcggagacaacagaacttccataatcacactcctgtaagtcacacagtcctataagaataaaattgacacttctactcatctttgatatagtatagcctttcttagaagaaggaccaggtgatgattgaaaaaaactttctcaatattttccacctccacctccaaatgctgttattaaaaactctactctgagataccgtttgatatttctgctgcccctgaaaaaacaaagtatctcccacacacaaaatagtctctactactgaaaagatttaaatatcaattctaaaaatggttgaagtatttcaagcccttccaaatacaaactttttacttaaagaaaacaaaagctaacactgaaagggttcaggtacatttactttaataacatagcttatcgattttctagatttagtcatatacacacacacacacacacacacacacacacacacacacacacacacacacatataccctccccccccaagacagtctctgtcacccaggctggagtgcagtggcacaatcttggctcactgcaacctccgcctcctgggttcaagcaattctcatgcctcagcctctcagatagctggaattatgacacttggcccagctaatttttatatgtttaatagacacaggatttcactatgttggccaggctggtctcgaactcatgacctcaagtgacccacctgcctcagcctcccaaagtgctgggattaaaggcatgagccaccgtgtctggccaatatatactgtttttaacaattaaaaagaaaaatagtaacataaatgacaaaataaatataaaatataagtacatgttattctaatcttaaaataagtgcataaaatctggaatacatggttggtctctgtatatgtgggctccacatccatggacagaaaatactagaggaaaaactagataaaataacaatacaacaatgaagaatacaggctgggcatggtgactcacgcttgtaatcccagcactttgggaggctgaggcaggcagatcgcttgagcccaggagttcgagatcagactaggcaacatgatgaaaccctgtctctaccaaaaatacaaaaattagcctagcatggtggcacacaattgtaatcccaggtattcaagaggctgaggtgggaggatcaccggagcccaggaagcagaggttgcagtaagccaacactgcactactgcactccagcctggacgacagagccagacgctgtctccccactgcctccaaaacaaagtatatggtgggggatgtacataggttatatgcgaatactatgccattttatataagagacttgagcgtctccaaattttggagatatggggtatcccaaggataccaagggatgactttacatcaaccataaaacaatgattacaatacagaatgtgattccatgaaattcaactttttaagttatacagttttataatgcttgactttgattgtaaaagtttttataatctgacaatttttgacaattagcatcccacaaaataaaaatcaactcaaatctgtatagcactctgaatgtgataaactgcttttatgcatagaggttatgtttagataacatgttaaaatgtttaggcaaatgtttaagcacatagattaatgttttatacctgtggatgcaaattatataaggcatcatataaaaattacaggaaaacccttttaaattacttaacttcattataaatttgtgttcagtatctctcaatgtccctatcatcctaaacataaatataaaaccttctttcattgcccccaaaccccgttgtcctagcaaatttcagagaaactatatctatatctatccatctatctatctatctatctatctatctatctatctatctatctaaccataaagataagcaaagttctaaaagacaaaaggctggggtgaaggagttagtgagaagtctccttatatatttcagttctaatttaagtattattagtgatcacagtttcataagagcaccaagaccatttcatagcgcttcccatcataacccaaagtcagagttaaaagttggattttgagagtaaagactaacctaccgcttcaaggaaaacgatgatgataatagaagaaaactgtagttgtaacatttctttgaaaataaagcatcactggctaatttaaccagtatcatgattatatgcaaaaaaaaaaaaaaagaaaaggcttttgttaaaatggcatgtatttcacgtagacacacgtaacatccctcttttctccccacatattcttcctgtccccagcaaccactaaatttggaattctcaattttcaaaaagaggatacagacagctcatgaaacaaactagacttagtgagctcccttccaccaccactctagtcattgctctccaacaagctcttcccaagctgcttttatcctgtctgcacaaaatcccaaaaagatttcaacacttcctagtcatatccagatatttgtattaacaataaatgtcttcagaaattaaaatccagccacagcaaagccaaaatcttactatctcattaattcttttcacgctacctcttccagtactctccagctattatttttaaggcccctcccggttctgaaatagcaggaagagggagtctgagagaaaaggggcacgatcttaagtggctggctggactgtaatctgatgtgacagtaatgtgtgatggagtcctgtggaggttggaagtccaaatgcagactctcacctatagttagttcctgatgcaggaacttctcaggcttgtctgcttggatcactgtgacccttcaaccaagtatggcctcttgatcctttcaaggtaagccaacttcaactattatgtcttactaacgtctactttgtccatgggggtaattcttccacctttgacccatcaaactctgacaaagtgctggcccactcccattgtgccctttcttcattctaccgatacaggggcagctccagcctttatctcactttttaggctttttcagatagaagtcaagtaccagtctatttatctctcaaacctcagcagacacatgtcaaactgagaagttctcgtcaagtccttcaaattggattaacaaaagggagaaataccttaacatatactactctcgccaaaaatcttttcactatggggtccttctcttgaactcacgatctttatacagcctacaggtgagtaacaggttttaactgtagcaatgcttgactcagggtgtcttttctgcatgttctgcatgaacactatagcacctcaattttgaatgcaggttactggcaatctactgttctcagatttggggtaaataccagatttggtaaataccagaacatttcctattataacattctgctatagttccaactccaggtaaaatataagcaggtcacagcagtccaatgttcttactagaggggaaaaaagggaaaaaaaaaaaacttgctcaaaagacaatggagagctatcaaactaatgagatccagatgaactaaaactgcagcaaagcagctttctaggtgaactgacaaatgcctatcacttcctcccctggagtcacgtgtagattctaggtgcaggctaaaggcttggtctgagaaaagaagctctgaggaataaaacagtagaacttttgacagtcacatgagtattccccctcaagacgcttatcagatcttaaagctgaggctaaagagctcatactttcaaagtcacctcatacttcgaaaaagtagaagtgaatctcccagtgtttcaggggttaggtgacagtctaacaagctttcaatcaaaatccctggagcgctgtttgcaggaaaggtataatccagtggcagactaaaccaaattaaaatggcagtctagccccacccagctcaatcgctaattagattaaggggagcttctctctatctacctggtaaaggtaggaaaggtcaaatactctggggagagcattatttgcaagatctttatgagtgaattttacataatgtacaaaacatatggcatacaataaaagctgtatgacatgaaaatgcaggaaaatttgagaaagaaaagaatggacaataacagaagcagaccaacagatgatccagacattagaactgccacacagaagactttaaagtaactattataaatatattaaggaaatagacaaaatggagaatttcaacagatttggggtctataatatcaaaggaacatactataactgaaggatatatttgaaattaagaacttacgtaggcttaacagactgaatacagcacaaaaacaggatcagtaaactcaaaagtagatcaacagaaaatatctaaattgaaaaagagaaaaagaaaaaaaaggaaatgaaaacaacagaactgtaagagacgttctgattttagcccaagtacaacagaagatttaaagcaagatatcctaaactgctgttttactattatctcacctctctccatagtccatgtgtgggtattgtctatctcaggcactttggatagtgatacatttacttatattgccagtgaggaccacacaggcctggaaggactctactacaagacaggaaggggaaggagtaaacagtatggtttttcccagaatgtagtcacataagaatgtcctgggtatgacattttgggctggatggtaaatactttaaaaaaaaaaaggcctgggtagcctagaatggttccaggtaagactggaaacagtcgggcgcggtggctcacacctgtaatcccagcactttgggaggccgaggtgggcggatcacgaggtcaggagatcgagaccatcctggctaacacggtgaaactccgtctctactaaaaatacaaaaaattagccaggcatggtggcaggcgcctgtagtcccagctactcaggaggctgaggcaggagaatggcgtgaatccgggaggcagagcttgcagtgagccgacatcacgccactgcactccagcctgggtgacagagcgagactccatctcaaaaaaaaaaaaaaggactggaaacagaccaaggatgttgggaaaacaaaagattactgtaattttttaaatgcctattttagctaggttgactctttcctgaagctaatatgttaaacaggacaagaaaagagggtatattgttcattgcatcaggtgttacatgataaaattacagaaattgattaatttaggtataatttcagtaatttttataaagggacaaaggtcctagggcaggtaggtattttccctgataaggtaagtgataaaaatgccccatgcaagaatataccatatacacaagggactttgaataccaggtcctggagcaggagccccctcaaaatacctaactgtaaatgtaggcaccagataaggtccagggcttagcaaagtgccttccaaagtgtgtttcacgtgatacttgacctcatcacaagtgctttcacatttataaactgtatatgacaaactggatgataaggctgataaaaggtccctattccccataacctcaaagttctaattcatatttataaagttttattgctctgactttatcaacaaattttatacatttaataaactaaattatacatcatgcaatgttgcctggcaaaaactttttctaagcagagacaatacattttaatgtctacaatttaatgtgagttctcctgaaaaacaaaaatagagaacgaagacctagaatatctgaatatttccaataaatcatattcctagctataatgttttatagcttatgaagctcatttacattatttcaatggacccaaaagtcatactgtgaaagtactcagatagcactactgcctttcacagctgtgaacagtaaaaaaagtacagtcatattccctaggatctacattcatcaatactaaagaagctgacacaaaaacaggttatcaaacttgaaattcagagttccctccaccatagtgtttcatacatattacgatacagacagacacacgcacatgcctatgtatgaatgagaagaaagaattatcctattatgaaaaagcagttgcttaagaatggaagaatactacagtttgggttcaaaaagacttctctttagctattcctggttacctagagaagcaaaagggtatgaacatgaggttagaaataaaagatgacagtttttttaatgacaactgctctattccaagacagtctgcataaagttactaattactctgatgtttaaaagtctgtaagaggtggccgggcatggtggctcatgcctgtaatcccagcactttgggaggccgaggcgggcgggtcacctgaggtcaggagttcgaaaccagcctgaccaacatggagaaaccctgtctctactaaaaaatacaaaattagacaggcatggtggcgcatgcctataatcccagctacttgggaggctgaggcaggtgaatcgcttgaacctgggaggcggaagttgcagtgagccgagatcccgccactgcaccgcagcctgggcagtaagagcaaaactctgtctcgtttctaagaggcaaaacaaaatccaaatgttaatggcagcattaaaaagaaacatcctggaaggacacatgaggaactagtaatacaacgttcactacagaggaaaactgggtgatgaaaaaacaggggtgggagggagactgatttttccaccgtataatcatggttgatttttcagttatgtacatgctactttatgtttttaagtaactttttttttttttaaagggacagactctcactatgttgcccggtatggagtgcagtggctgttcacagatgtgatcactgcacactagcctggaatttctgggctcaagtgaccctcctgcctcaacctcccaagcagctgggactacaggtgaatgctgccacgtctggctagaaatacactttttgaaggcaaaaacagtcataaacatacaaatatcagaatgctaaaaaaaatagaattgccttttaacagaaaaaactgacttcaaagaaaaaagacaagaatagtcttgtcataaatagacacgaattaaattgcccaaaagtcctatttaaacatttaattgtgctgactataaaagtgatatacttttatatataaatactagaaaaaaaaatacaggacttttctgggtcacccatactcattactaaaaatttggtcaattaatctctaaaagttcataattaagtgttaacatttttagaagtatgctttatcaagctaagaaaactcttatttctaatttgttaatatgaatagcaaattttatagaaagccctttctggatccatgatgatcataaagtgcttcttaaatatgattatgtggtatcttatactaatagatttcctgtagttgagtcatccttgaatgacaataaacattacctagacattttttttttttttttttttgagacggaattttgctcatcgcccaagctgcagtgcagtggctcaatctgggctcaccgcaacctgtgcctcctgggttcaagcaattctcctgcctcagcctcccgagtagctgggattacaggcacatgccaccacacccagctagtttttgtattttcagtagagaccgggtttcactatgttggccaggctagtctgaaactcctgacctcaggtgatctgcctgcctcggcctcccaaagtgctaggattacaggcgtgagccaccatgcctagttatgtttttgtggttttgtttttaataaaccactgaattctagtttctgatattttatttatgacttttgcatctatgtttataaagagtggcataaacttttctttcgctattcttgtttaattgtggtataaaataagcttaagtgttctttattaaagaaactaaaggttaggactgggttttttctaattcatattaaaaacaatacagattccaatggactggtggaaaaaatgatactgaaacaaacatcaggaatctttgacaatattctgattatttccttgggatgaaagatcaaaaatgtgattacatggtcagagtaccaccttaggaaagtccttttaatttatgcttatgaaaataaattttgcattcctatacatttatgtataatcaatattataaaatagccattttagaccccatagtccttacttttaactttacagacctccatccccactgcaatttcaattttgctttactgtggataataatatattgaaagctttttccttatgtctgattctttatctaaatatcaattgccattctgatttcacgaccaagttgtctcccatccctcggactcaaaaatgtttgagatgaaaaagcttcctgaaattttttattatttagctcactgcagcttttattgaggttaagctctacctataaattactctgtgtcaccacagaaaatggtgggaagggagcgacagtgacgtatctataactacagcttttaaactgccagaggcaacaagagtaatgagatgaggggagtgggagggacacaaagccaggactatgtttctgccctaactttaaccccactctaatattaaggggctgaaagtagagaggaggaactgttcagtaaacatttcaacagaaaacatttgccatttcttaaaattaagcaatttgtttcccgttcttcatcagctgaacttagttgtattttttggcttataaaaccataaaggcactttactaacattttacttgaaattctgagtaaacgtgcttacaaatccattgtgtatcacattttgaataattctgtttaagctaaggtttggatttagccataacaaatcttttccatcccacttcccatcttttacactctacatataaatgagttccctgaattccaactaaatttcttacatttaagaatatttagttgttaagaaatgactaataacctgacacaatttaattgttctactactaaaaacaagctttataaaatatatggcactaagctacagtgtgtaaaaagttaaaatttttttgatagaccatgatcaataataacaaatctccatttttgcaacatctaaaaaaaccaccaaattaggcaaatttctacgcttcaaggaaacttcaatagtgaaaaacaagataatggacaattatcacttcaacttcattaatcaggtgagagggcagaaaaaaatgtttttaatgatgaagcagctccagaatatgagctctcagagatctctatctccaaaagaggctgtaaaaagaatgggaaataaggaaaagagctatgactaaggtgacctcctccacaggttaaataccagcaatggccaattttagtactgctgtacctccctaaaagattagactctctcaggctctgctctggataacctcactgcaatggcaacttgagccttgttgaagttgtgcaaaaacatggctctatctctgctgtatcacacagctcccttcaatcaagtgataccagtctcccggcctccattcttgacagcctcaaggagttttctcgctgcaacccacgttgcacttgaaattaatctgacttctgagccttcagaccctacggcacttaaacggccccaacctcacccgtcaccctcaggttaagtgtgaacactggcacagcatgaagtgactccttactacctatacacactatggccatttgccaccccttactttatactctaaggatacccaacttgtttggaacgcttcaccaatcctcccccacctcccaatctccacaccaccgcactacatgtgatgaaacaggcttctcctaattcctcctttaccccgctcaactcaaaatcaccagtattcctccagaaggaaactttccacaagcctcctctggatatagccccaagcatacttcttttataacatctaccaagcctcatgaaaccatctttttctaagtttatctcccttactaggaagtaagtagtttaaaagcaaacactgtatcttaactccagtgaggaagagcacaccaggcacatagtgggcatatgataaatggttacctaattgaaatcccaagcactacacaatgaagaatgaaatatagcttgacttctcagcccattcaccaggaagtcctcagttccacttctaaaacccatgccaaatctgtttacttcgtgtgctagcacagccaccacgccagtccagcctctatcgtcttgcatttagattcctcacagcctcctaattttcctgcttccatctaccctactacacacataccactctcccgcagccagaaaaatctttgtaaaaatatgtaagatcctctttaaaatccatcagaataaacttacttgcatcctgttatattcagactaacattcaaactctcaccacactctaggatgccctgtataagctttgggcaagtcttgtcctccatctacactgggctccttttaaatattctaatacaagaagctcacctcagtgtcttcactctggctcttccctctgcctagaagactcttccctcagttggctgctgcttctccaagctccacgcaagcatcacaatccgacccaaagcagctttttaattcttcattctatcatatcactgcatttggttgtcttctttgcactcattaccatatcaaattataattaatttgtttacttgtttatcgtgtatttctatcccttaggaaggcaggagttttgtgttttgttaatcactgttatcctcatatgtctagaaacagtgccttctacatagcaaacactcaataagcatttgtaaaacaaatcaacaaaccaaaaaagcaacctttaagatatacataaaacaagtaagggaaagaaatggatggtctaccaaacaaggcaagaaacattctactgttagtatttgcaactagacaggctgcactggtgttattgggatctgttatctataagcatcaaaagtgtacttctcaaagttcaaagtcaagtagaatggtttcacatgctatatgctagcccacggtatgacactgcaaactatcattttagagaattcttacatttaacaatctccccaaaatctgtaatgtacacaagtagtaaaacacactttaaaacacctgtcacttaattaaaaaacaatacttatgacagtggtacttatctgtaaatgattaaatttatcctcagaaaacttcagacttttaaagtaacaggtcctcctaacctaagaggcaggtctttaagacaggttctgactaatgcctacaacaattaagaagccacctaacacactattctttcttggaagcaatgctgcaacgcaaagaaaaaccatataaaattcattaaaaagtgagcagcctcttttcacccctgatgaaagttttgactaaaggaggagaaaactgtaggttgctactatgttagtgatagaaaaagcttcaattctttattcaagtatcattcaatcacggaaatgaggataacatacaaatgtaggcaatgaagataataaatctaagtatcttatttagcttgattaaacctcactattcaagaaaataatttataaaacaagtcagctagcaaaaacaatttatacaaggttaaaaacagtcatatttcaatcatcactttttacaggcaacttgaaaggaacacaaattcagtaactttccttcagattccttgacataatttgatcaaacctgggatctaacaaaacttaccttggtatggtaacacatttagtattacagttttgagtggtgatggctttctcaagctcatctaatcgtcctgttttctttagcttcttcaccagacttttcactgctttctcacaccacttttcttcctgcccattctgctctcctccgcctgctcctccagacccaccagctgacttcttccatcccagcagtctcttcacaactggcggcgtgaatggcaagatggacgacatgttcttaccaaaggcagcaagccacgctaggaaaacagcctcttgtatcgaacctagcagaaatattgaaaggatgatgtagagactaccttgaacatcaagtaataatttcaacttatcatagaaagcaaactgcaaagcaagatagaaattcgaattatgactttcccaatagacttctccacccatgaaaacgttatctttatgaatttaaatgaatgatggaaacaaacccttctaaaaacaagaatgttgtaaggactcctcttgtgggaaaatacagtaattttgcaagtaaaatcagatacttttaacgatttttcaccaccaatactattttaaactcttagtagtgtcaattaaaatattttcacaaaaggttctcttactttttagaacttcactctaatctcaaaagactatacaaaaatacattgaaaatttgtaagcccactctcccccgggttttaaactttcataactaataggaggcaaaatctacagttacaagaagggaaaatgcgtaaagtgtgaagtaatcaagaataaagaaataaacatggcaaacagagtccgtggagaaaagctgtagtccggtttcacctgctcttgagagaaattttttaacacatgtttttttcattttcatctaaataacaatttgcatagtgagtaaagtcagatagtttctcttcccaatttaaggaattgtaccttgtcttttctcttccataggaatcatttttattaagctgttttgtctattcagcgtcattttacaaatataaacatgtatacatacaactaaccacattcccaccttattgctgtacaaaagtagcataatattccttattttgtatatcttgaaattatttttttatttttatttttttgcttaattccctgtaggtcattccttatcagttcacacagaatttagaaagcactgtcccctcaattttctagactccactactgatactggtaagtcccacataacttttattcctgatcctttaattggggtttaaaaattgtttcgctccagaagctcttaatatcttagctcttacgcttttctttcctttgccttcaattttagtgagatataggaaaaaggaaaatgaatgtgttcaatttgccatatttaataaagttcccaaaaggcatcctttttagaaagtaaagaggtctgtagtctttacatcacacaccccaaatactgaaattgtagttttcaaagtgtatctttaagaaaacaatgatgcttacattttcattagtttgttccttaattatcataatgatcagacaatagtttttaaacgtagaggaggaagtacaagttaaaataataataaggcatcatttcatgcccaatctagctggcaaaaattgaattaattaaaatacctactgctggagaagatgtgaagaaattgttatcattccacattgctggtgaaaaggtcaaatgtgacagctttattctaagtaatctggcaatgtgccacgtgttacaactagtaactggattatacgtgtataaacaaaaatctaggatattaatatgggttgcagatataccaatatgcagaaaagggggtgaaaagatgaaaaaggctgaatgatatggccattgtgtatgtttttgtgtatgtgtgtacaaaaaactggataaaacatttttaaaggaaaaaaacagtttttaagcacactttgcacatattcttaacgttaaagaagatcctaacacaagatgcaaatttatttcccatcaaagaacatggctaattttcatagattatatgctaagattcatttccaatgtacacaaactgcattcctgctctaacctctccataattccattattttggtttgcaccacatggaagaataatttttttttttaaatattccctcttctcaggatggtcaatgactagtgaagaagactgccatgattaaaatacacatgacaattaagagaaattgcaagggggattacaggtacacaaagaaacaccatctgattttgctttaggcgtcaggaaagattttcctgaggaaatatttgcacttccttggcagcttgccatttattcattcctttttgcattcaacaattttttttttttgcctgtctattgtgcctgtatttacctgtttattctcaaatccagtctgtgttattcatctgcaaactacactgttgagctgggacgggtaggacaaaagaaatcctttgtagcaaggtattggcagtggggaatggagaaggggtaagtttttaagggcagagagatcaaccagcagagaattgcaatacacaaaaggaagaatagctattagggacatagaaggaacagagttgattaagaaaaagttacaaattacaggttcttgcttgaaaaaccagttgaatgaaaatacaattcgccaaaatacgaagtatttggggaacataagtgttgtgttagtcaaactaaatttgctgtgactatgaaattccagaaggaggtgcccgataagcagctagaaacaaaggtttggagcttagcagagagatcaaactgtcatgtggtaatgaaacgcaatgctggtatatgggagagctcagaaagcgccaagttcagtgaaaaaaaaattctaagaaatacatataaaggagttatcaaatgtggaaaaaaagtggatgattagggagaaaggtgtcatgaatacaaaggacaatttatagcaacacaacatggtaacacaacttttaagtgccaacactaggatttatatcaagcagcatgatgccagagaacaagtacttaattgtgtcaatgcattgtgttgcacataacaatctgaagctaatctggagacctaaaaagagccattaaaggctgagctctttatacaatcaacagagctatctgtgcctgacaaattagtccattagataggattagaatgacacatttagctccaactcctttctcaatctacaaatcatttaactagtctttcagtcaccaccttctaccttctttgatgcaaacagctttctaaaatgcatactgcatgtcaccctactactaaaaatccttcaatatttgcaaaaagtaacagtaaaatgacttaatatcctttaagaacccataaacagtgtaatgcttcagagaacagattctgaagccaattggccaggttcaaatcccaaggatgccacttactagctgcatggcaacctctatacaccccagttttctcagctgtaaaataaggataacagtacctatcttaaagccaatataacaacctctataaaaatgtaatatgagctacatatgtactttaagttctctaatgacattttaaaaagggaaagaaaataggcaacattttaatgatgtatttaacccaatatatccaaaatgccatcatttcaacctgcaatcaatataaaaaaaattttcatactaagtctacaaaatctgttgagtactttacacttacaggacaactcaactaggactagccacatttcaagtactcaatagctacacaaaggtgctgcctacccatattgaatgatccagccctaactactcaaaatttctgcctactctgcctatcccatattctccataaactgttcataaatgcctctatttaacggctgtaggatccgtagtgatgtgacatttttcaattcctattatttaaatttatgttctctctccccctccccatcctccttttatcagttttgctaagtggtcaattacattaatcttttcaaagaaccaactttttcttagctttgtcaattttctctatgtaagattactttctattcactaatttctgctcttgtcttcattatttctttacttctactgtctttaggtttgatttcctattccttttctacctccttaaaaaagctttcttttccaatgcatagacttaaggctataaatttcatcttagcatttcagcagcagcaatctagatcattgtagttcaccttcattttcaatcagtttaaaatattttctaatagccatcataaattcttattttaagtcatatgttattcaaaagcatagtgttttatttctaggcagctaggaattttctagttatttttatttactataatacaaacaacatattcaattattaaaatcaatgatatttgctgaggctttgttcatggccctagcttatggtcaattctagtacaatttccatgtgcaagggaaaagatggttaataccaccattaatagtttcaatgttctacatatgacaattagatcaagcctgctaattgtgatgtatgtatgtcctatatatgtgcatccattgtgatggcatatttgtctgtttcttttagttcaaaataaaatttttggtttatagatgtttgggctattttactgggtacacataaaggattgtggtaactctggtggatcaatccccttacactataaaatgtagttctctttttctactactgtttattgtattaaagtctcctttgcctgattggtatagccacacttatttccttcagttagcatttggatggtataccttttcgcatcattttctctcaatctttctaggtacttatatttaggtaattattatttgtccagtctgatgatttttgccatttacttgaaatatttagcccatttccatgtaacataattactaatttagttgcctgcttgttttatattttctttcttgtcttcttctgaatttatcacatattctatatccaatttttttctgtattcatttgttacattcttttcttttagtggttaccctagatattttcttattcatccttcacttaacacaattttcatacatatacttttactacttcctctataatgccagaatcatagaacactgctgagtagcagttttgctatgaaggagactacctctggtttgtccctgttcctaggatgagactctgcagagccttcatttcaaaagctagcagatcgttatcttctaggtacctagatactataagaattgctttgtttttaagagacttctggtttagctctctagcctaagcagcttcagaatttggcaaatgtctacgggggaagaaactgggtgtgttgaaaatcatcagtgtgtattcaccacttcctcaaacgctttcaactctcacctattgttctcaagtcgcttcccctagagaatctttatctcaacaccataggactagaaaatatcccaatctccttttctgagattttggtttatctcttccgcccagctgaactacagaatttaggaatatactgagggcgttctctgtgtttaaaggcccctcatatttccaatctgccactcaggctgcagcccaaaggcctcctctactctgtacccaggaaaaacaatgatcagctgcagacctctcagctcacttgtgaaaggtattcccccagggtgcaaaattttgctttctttaatcatttttacacccattgttctctatcgctaaatatataaattttgtaaattacctggcttttctagttgttttattaagagtcttggactaccaagaactactgcatcctatcccccaaaacgttctaattccatttgaatagtaagtcttccacaactataaatctatgagttgaaataatttgttgatgactttaatttcaaaataagacacaagatcacttaccacttgaggacagagatggagagttaagatttgagaacaggaaaaaatagagaaacgtagccctgagaaaatcaaccattatgaaacaacagaaaacgtgtcagttatgtattatcagactatatacttaaaaagtattccatagaaggaattccacttctgattaggacgtagaaagttacaacagagcatcactttcattctaataatcaaaactagccagataagctacaaaatcatggtctctctgaaccagagttgaggatacaaagcagcctaagaagaactaaattccaagtgttgagccttgagagaagagaggctgcatggatggtctctttcctggtggagcggctagtgaggaataatcctgccataaatgaaagaaagaagaaaccagcctacatgcacaccgacatgacatattaaattgcaaggatcccacagagcaagtgtgcatccaccccaaccactcatccccataggtttccactaagtacttgcaaaaagtatgtcaaagcttggggaacaggactggaaagctgagggagatcccctaaggagcttaagatctcccataaatgcaaaaaatctaccctcatcaatgggggatggggggagggacaggcaagaaaggtgagaaaaagatgatcccaagagagtctagacattgagctgccaagggctgcggtaggacaggaaagatgagaaaactttcacccagatactcaggacattgatctaccgaggctgaaatgagtagcgaacttgaagacagggtaggattgctaaaagaaacctctggaaggtattaatagcagaaagatgtctcactgggcacaaaagcttggaggcaggactagagaaagagggggtggggggaaagaaaataagaatgaccaaggaattgacagctgagctatagagaaatttctcatggttcagaaagctgacggctcagctataaaccaaaaagagatccaaaatcacacttggacaaaacaagaaatgatggaccattttctaaaagtaaatattatttacttcaatctccattgtttttatacaaatgttcagcattcaatcaaaaattacaagatacagggagtagcaaacagtcaaaacatgaataaaatcagataactataataaaaatgctaaagaaactgatggaagagatagcaacatgaataatgaaaaaacttcatcacagatatcaaagttacaaaagaggatcacaggaaaacgttagaaatgaaaactatagtattagaaattaaggataccattagatgggcttaacagaaatgagcagtgaacttgaagacaggccaaattaaagtatgcaaattgaaacacaaagagggaaaaaacagtgtgggggggggggggactcagaatatccaaaaccaaatgtcagttgggtttaattggggtgccagagaaagatgaaagacaatggggaacaaaaaaatgtatgaagagataatggccataaacttttcaagagatgacagatattaatccacatatggaaagaaaacacattcatggtcaacctgctgaatattaaagataaaagtaaggatgaaaggccgagctaggataacagttaaaatccctgggagtcctcgatagaaagagaatctgcactcattcacaagctcttttccaagggcctcaactgagtgctcttgaaaaaaggcagaaaacggaagagagctccttcctcccatttggtggcatctcgtatgaagcaaatgccttcaactatgacgggagaggcaggaaagtctaccaaacccaagggcaagcaaagatcccctgcctcaaagggaagggtagagcaaaagacatgtgctgctgagttgggggatttgtggagcaaaacttacttgcccatctcccacacacaaacatgcctttcactctgtaacaataaccaccatattctactgccacgggaagggaggaaacattgctaccaccagtcccagacaaaggcacacagatgctgaggaatgagaagcaacagctgtctgatactgaaaaagggacaacaagccggcttgggcccaagatcccgtactaatacacagcaaaggtctgttactactagatgcaaaaatcctaaacaaaatattagcaaatcacatccagcaacataatagaaaaggtcatcatcactaagtaggatttatcccaaggagcaaaattggtttaacattcaaaaatcaagcacctcatttatagtacaaaggagaaaacgcacctatgattctctcaaatgagcgagaaaaaaggtatctgaaaatgttaattcaacactcatctataatttaaaactcccagcaacactagaaaagaatgttcttcaatctgaaaaggacatctatgaaaaacctagagctagcatatgtcataaagaaacattaaatctctcccttacaactgggaataagacaaagatgtccacggttaccctttctattcagtaatgcattggatattgtagacaggacaactatgcaacaaagaaaagatagactggaaagaaataaataaaactgactttatattctacagtgatatgactgtctccatggaaaagtgcatggaatctacaagtaatctacttactggaactagtaagtaaatttagcaaggtttcaagataaagggtcaagatttggaaaatgaaatttcaagaaatacgcttgaaacaacagatattttctacatatctaaagaaagatactcaagatctcaacactaagaattacaaaatattgctaagaaaaatgaaaaacactgaacaaagagagatcatgttcatagacttgaagattcatattgcttaaatgtccattctttccaatttgatatatggattcaatgtaatccctaccaaacttccagcagagttaagcaattcatatgatataaaattcatatggaaacaaaaaaaaaaactagaataaccaaaccattcttgaaaaagaaaactggaggccttacaccaccttatttcaaggcttactaaaaagacttagtaatcaagagtatagagtaggcataagaaaaaaagatcagtggaacagaacaagtctagaaatagacccacacatatacagtcaactcattttccagtaaggcccaaggtcaatctagttttcaacaacttttcaacaacatggaaaataacaagcctcaaccacaagtgcataccatcttcaatgggaaagcagaatcttaagctcttagaggaaaacacagaatacattcatgaccttaaaacataaaaagcattaaccacaagagaaatacagttgagccacgcatggtggctcacacctgtaatcccagcactttgggaggccaaaataggaggactgcttgagctctagtgttcaagaccagcctggacagcatggcaagaccccatctctactaaaaaacaaaaaatacaaaaaaaatagctgggcgtggtgcctcctgtgctcccagttaggaggctgaggtgggaggatcatttgagcacaggggtgcggaggctgcagtgagccaagatcactccattgcactccaggctgagtggcagaacaagaccatgtctcaaaaagaaaaaaaaagaaatagaaaaagaaaaaaaaaatacaggctgagcatcacaaatccgaaaactgaaatctaaaatgctccaaaatctgaaacttcttgagtaccaacatgacacccccaaaaaaacggtcattgtactatacagctataatgcaaatattctaaaaattggaaaaaatctgaaccacttcgggtcccaagcattttggataagggatactcaaatctgtgtatgtaacataaaccaacaaaatttaaaaatcacacaaaaaggtaagctcagcttttttgttaaacaggaaaagaataatagacatgtcataaaagacacaggagcacatgaagaggtatttagtatcaccaatcatcaggaaaacgcaaactaaaaccataatgcaataccatttcacaccatctagaatggtttaaaatttttctgacactactaaatgttgatgaagatgtggagtgtattagtatactactgctgctgtaacaaataatcgcaatcacagcacaaatttagcaaaatcagtttcaatgaactacagtcacagtgttggcaggactgattcctcctggagtgtctgaggggaagttcgtccttgcctttttcagcttctagtggttacctgtagtctttagcttgtgctcccttcccttagcttgtgctctctcccccaccttcagagcacatcattccaatctctgcttccatcgtcacactgccttctcttctgtattcaaatctccctctatggccttctagtaagagctcttggcattacatttaaagcccacccagataatccaggatcatctctccatctcaagatccttaatttaatcacatctgtaaagtctctcttgccatataaaacaacattcacaggttcttgggattagaacctgaatatctttggagaccatgattcagtctaccacatcaagcaactagaacattcataaactgctgaaatgaaagtataaaatggtatatagcacaattggaaaaccggcaagttccaaaaagttaaacatagatctaccctgtatcacacattcaggaaaaataaatacgtatgtccacaaaaagaaacctgtataagaatgttcatagtagccatgttaataatcgccaaaaactaaaaacagccaaaatatcaaaagaaaacaaataattatagtgtgctcataaaaaggaatactgctcaggaacaaatatgaatgagcttatacactccacaacacggatcagtctcaaaaacatgctgggcaaaagacaaagaaatatagactgatttcattcatggcttcccacaacaggcaaaactaatctaatgacaagtcaagatgaccatctcagaggcactaaggaagagaagtggaaatgtttggacagaagcacaaagtacctttctacggtgacaaaagtgttctctatctttgttttattccctcgctcctgtaaatccactgttgaattcctgaatgttttctatcttgagaggtaatcacacatgagtacaagttaccaaaactcacagaactggccgagcccagtggctcacacctataatcccagcactttgggaggctgaggcagacagattgcttgatttctggagttcaagaccagtatgagcaacatggcgaaaccctgtctctacaaaaaatacagaaaaaagttagccatgtgcatgtctatactcctagctacttgaaaggatcactagagcccaggaggcagaggctgcagtgagccgagatcgtgccactgcactccagcaccctgggcgagagagtgagactctatctcaaaaacactcacagaactgaacatttgaagtctgtgcattttagcaatgtaaattacaattcaaaaaaatttaaaaggtgcctggacaaacacattaagaagttcctaaattaagttaaatagacttctttactgaagaacttctcaaaagcttcaacatgccaatgcacattacaaatttcagaagggaggaggttgcaagtgaccaaagatgtaagcttggaagtttccgtccacaacatgcagatagcctctgcaagtacatgtaggcaaatgttcgtggatggagggtggaaggggtattgttttgaggacaaaaattgagagcccaaatgacagccatcacaaacatacatgaggcactgacaaaatggttgttgtaacagagctatataattgacccgtggacaacatgggtttaaactgtataggtccatttatacacagattttattcaagaaacattgcaaaatgtcttggagatttgagacaatctgaaaaaaactcataaaccaggtagcctagaaacactgaaaaaaactaagaaaaaggtatgttataaagcataaaagatatgtagatactactctatcatttaccatcatgaaatacaaaaatctactataaaaagttaaaatttatcaaaacttacacaaacacagaccatacatggagccatttacagttgagaaatgtaaacattcagatgaagtattaaatcattaactacataaaattaacggtagtacatactgtactactgtaataatttcatcgccacctcctgttgctatcacggtgagcggaagtgttgcgagtatccactgtgtgaggctaatcatctctgcatgagcagttcttctctccagtaaattatcacagtaaaaagtgatctctcacatttctcatgtaattttcaccatgtgtagtgcaataccataagccttgactaataccatgagatccatacgatgtgccactagtgatgctgacagtgctcccaagaagcagagaaaaatcatgacattacaagaaaaactccaattgcttggtatgtaccacagactgaggtctgcagctgcagttgcccaccatttcaagataaatgaatccagtgtaagaactacagctaaaaaaaaaaaaaaaagaaaatttgtgaagctgccactgcagctaggccaacaggtgtgaagatcttgcaccttttgtgaaacaacttttgatctcatattgaaaatgcaggttttatgtaggtacaggattgctataaagaaaggcgtacctatagactattacatggtttgagaaaaagcggagtcattatatgacaacttaaagcaaaattaaggtgaaggatctaaagctggaaaatttaatgaaatcaaaagatggttgagaatttagaaacaggctggcttaaaaaatgtcaagataacaggaaaggagcttctgtcaaccaaagtagatgagttagttcctaggcaccattaagaaaatcactgaggagaaagggtatctgcctgaacgggtttttaatgcaggcgcaagtgctgtattctaggggaaaaaactgccacaaaggacatttattagcaaaaagagaaacaagcaccagatctgaggtaggaaaggacaggctaactctactgttttgtgcaaatatgtccaggtttatgatcagcactgcccttctctataaagctgctgacctccaatccttgaagggaaaagataaacaccggctgccacaacaaaaaggccagggcaaccagaacgcttttctctggattcgttccatcaatgctttgtccctgaagtcaagtaccctgccagtaaaagactgccttttaaagttcttttgacattggacaatgtcgctggtaacccacaatcccatgattccaacaccaaatatgtcaaagtgatctacttgtccctgaacacattaataacatctctaaatcagggagtcataaggacctttaaggctcattacacacagtactccatggaaaagaccgtcaatgttacaaaaaagaactctgatagagtgtcatcaaagtatggaaggattacgccatggaagatgccattgctgttatagaaaaaaccatgaaagccatcaagtccaaaatgatacattcctactagagaaaacagtatccagatgtgcccgacttcacagcatttacaccagagcctatcgaggaaatcataagagattgtggatatggaaaaaaaaaaaaaaaagtggggagtgaagggcttcaagagatggatctttttagagaaattcaagggctaacagactccacacatcagaggaattaacagaagacgacgtaacagagatcagtgcttctaaactagctccagatgatgaggaagaagatgcagaagaagcagtgccagaaaacaaattgacataggacaatctagctatatataatatagggttctaattattgaaggctgcttttgacttcttttataacacagatccttccattacatgggcactgaaactaaagcaaaaggtgtaaggaggactggtaccacacagaaacatttttggagaaatgaaaatgcaaaaagtcaggcaaaaattgcttattttcataaagttacactgaatgtgcctgactcccagtctgcctcttctacctgtgagacagcatgaccaaccactcctcagcctactcagagtgaagacaatgaggatgaagaccttcatgatgatccacttccacttagtgaatagtatatgtattttctcttccttatgattttcttagtaggtttcttttctctagcttaaagaatacagtttatcatgcatgtgacatgcaaaatatgggttaatcaactgtttatgtattggtaaggcttccagtcaacagtaggtcgtaagttttaggagagtcaaaagttatacacagattcttcactgtgcaggacagcaccccaaccaccccattgttcaagggtcaactgtatatttactaaaaaagaaacattaaataaaagctcaaaaaaggactttaaattatcaaaagaatgttctcaaaaaaggtcctcaaactgaggatattcagcccttggtataatttgctagaaaataatggccataactgccaggcgtggtggctcacgcctgtaatcccagcactttgagaggcagaggcggttggatcacgaggtcaggcattcgagaactagcctgaccaacatggtgaaaccccatgtctactaaaaatacaaaaattagctgggcgtggtggcgagtgcctgtagtcccaactactcgtgaggctgaggcaggagaatcgcttgaacctgggaggcagaggttgcagtgagccaaaaccacgccactgcactctagtctgggcaacagagcgagactccatctggaaaaaaaaaaaaaaagaaaataatggccataacctaatataatcatactcacgcccctcgaaacagaaaaaaaatcaatgcatcctcaagctcaattcaggagactggccccaaggcctccctccaggaagaggcaacacagcatgccaaatttcataaatttcataaatttggccatgtcaaccctttttagggatgtatggaatgccacataacaatactgcattggcaaccttgggagtccaactagggttcaaacactaaaaatttgaaaggagtcaataataggattatgtaactttctttagcaatatagtagaaatggtgggaaagtgaggtttgcatagaattagggaactgtaatgcaaataaaagagcaacagtgaacttaacagcccggttaaactgtctatagtggtagacctataatacgacacataaataagcactgtagtatgtaacttgataaaataaagcaaatacacaaaactccatcaaacgcatgtaatcatctaccaactaataacctgggactatcaggcagcaaaaagtgtacttggctacctttggcccctgttggattcctactctgtgccacaaagtatgctctagaggagccaactacagacaccgtagtatcatgtgacacagtcttatcctagcacagagaacaggattcaacctttggaagggaaaggtgacactaaagttgacaccagagcacaagtattgagagagatagtacagcaggcagaaagttcagcatgttttctaaagacaggaaacgttttaggagagacgaaaaatttaggttatcactaaaatacggtgcacaggaagcactgtggcagaagatgaggggaaaataaggccagtgcagattaaagagctgaagacagaaattactgctaatgataggagtattacttcatttattccagtgacaatttgcattttgaatgacctactggacgtgcagtttagggaaaaggattgaaacacaactaatgtgaccgactacctaatgtaactgagtggcatgtaatggtacattcatcactattaggaatgaggaaagagaagcaaccctgaaggctaaagggtcagttttatacatgcctttatgtaagtaactatgttcatcacatggccaggaggcagcataaaatatagtagactcaggggagctagcagtcagtgtacaagtaagagtgtgtgccagagctaggcagagacaactggtgtcttgaagaaaagcagagcagccaatctctaggcttggtttctgaggactgtccaggcctgttccagctccacaattatatcctcagaacaaaacctctttttgagttagcatgagtaatctctctgttccttgtgaaaaactgatagaaaaagcaaaataaaagaatctccctacaagtatctgtatctttggttcaattattccattcataagaatttagcctaaaaaaagaataaaaaatgaaacttctgtataaacagcaaaaaaaaaaaaaaaaaaaaaagggatttccagcattaggaggaatgagagtaaacagtttctgtaacactttttttttttgaggagtttcactcttgttgcccaggttggagtgcaatggcgtgacctcagctcactgcaacctccacctcccaggttcaagcagttctcctgcctcagcctccggagtagctgggattacaggcacgcgtcaacacgctcggctaattttttgtgtttttagtagagatggggtttcaccatattggccaggctggtctcaaactcctgacctcagatgatccatccgcctcggcctcccaaagcacagggattacaggcatgagccacagcgcccagcctgttacactttcgttaggagaaatgtttcttatgagttaagctgtattcctggggatctaaaagttttctataaaacctttacaatattgtttcttcactgaaatgaaactaacttaagtttaggcctattctgggtcatctgaatggccacatgacctggtattgccacatgatttcagtgtcccatgtcttacaagaggagttaaaaccattttggaactaagtgaacacttaaagttgccagccttacctttgcatgtctcagtaaccatggttggctgacatctgtctaatatctccggagaatttttaaattatgtaataaaataacatttgttgtaagtaatgctgataatacatcttcaattagttaagcttttattttaaaaactgaagcatttttagccaatatttttgaagtgtaaatagactgaatgtaggctgacaaggaacagataacaatgtgttccaggttaaaaacaaatgaaatacaaaaaagaaaactagatttataatcaagttgctatcaaaacgtgaatgagtcatttacagaatatacagatttccttcaatggtgtggcagcaagttctctactgaaataaattttcaacatctgcaagaattgaaatctaagttcagacactatttctaattccagcaataagtgatacttacataatgcagatttcaaaagaacacaaagactatctttacagctgaataagtcagcttaccaaatgataccttagtaaaattaggattctacgattactcaccggaaagtttcaataaggtaagaggtctaattatcctgaacttgtagtaaagccttcaagttattaactctatattatagtttgacaaatagcattctctgcacatttaattaaacaacagtgcatactctttccagagtcctcaactatgtggtccttttcttactgtttttattctgacataaaccctatcactgagtatgtattacaaaaaaatctccaaatccttagaatgacttttcattttatgttgtcttttggaacacacaaagctgtattttaattaaaaatcttttatgccacaaccttgcttttcaaagaaatcttgctgtgcctctaaatatagtaggaaacatttattgagtgcttaagcctaagagtccagtaagcaagaattccgaatcctaagaaccaactggggttaggtactattatttacaaatgaagaatgtgaggcacaaataaataccctgacgtaatacagagaatcccctctagatattcttatggatgctttagtttacttttcatattaagtttctaaaagaaagatcagaaatttggttttaagaggtgagacagtgatctaaccatctctcataaggacagcctgtgtattaaagcttaccttttgctaagtcataatgccacttctgtcgcataacaaattcctactaaaggtctgatcacacgcattctgttatttgttcacacttaacatcaatgtaagaaaatattaattactactgctttctagttagtcttgatatttgtcagggtgaccccccttccttatttttcagatgtgtagtattgctggttactttaagtttagcatgttctacaaaaatcctataggattttgattggaagtgcaatgaatttatattagtttatggagaacatatttatgatatcaagtactccgactatgcaaatgagtatttccatttatttattatctattgataagttgcatattttctccataaaaaatcttacatcttgtcaaatttacttatttctccaggtatcttggtttttattgtaaatggggactttaattacacaaaaatattacactcaacactcatgtactttccatctagctgtcatatcttagcattttgcagtacttgatcagacataagaaataagatacgaatacagctaaagccccctatgtattcctctttgataacatttccctccctcttgcttctcagagattatcactatcctgatgttcccccatggtcatttaacagttttgctacatattgtatccatacaatacagttctgtacattttataaatttatatgaaagtgtgatactgttcagtccatgctgatacatacataatcctaaatcctagttcattcattttagctgtcacatggcattccattttatgactagcacagttcactgtccattcactctggatgactagttaggtttccaattttcctctctcacaacctgctatgaataggctggtatatatcattttataccatgtaaaagctcttctagggcagaaaatttcaaactttcaaactttttaaccaaaaaaagtcccacagtgaaaagtacattttacatgcaacctagtatatacacacacactttgctaaaaaagacatttcaccatatgctgcactctacaatttctctaaactgagggtcgcgaaccgtgagtgggcatgaaatcaataattctaacaaatgtttacactaatgtaaccacaatccccaaaaaaacaacatttccagcacctcagatgtctcccttacgttccttttcagtcaatccaccttcccccgtcaggcaactactgacttctattactattaattttacctgttccagaaattcatatagatggaattataccgtatgtactcttctgtgttttttaacacccttttgaaagttctcttgtattcatttcctaagaatttttgtcatgaacaagtactaaatgttatcatatgctttcccgttgtccatcaaaattatcatatggcctttctcctttaatgtgttaacatgatgaatttcatttacgagttttctaatgcttaatcatccctacattcctgagacaaaccctaattagtcatggtatttttgttttgagtaaatactaacattttacaaactacaatttttattgccatgttctttggtgagaatgcagcctatatccccttctcacactatctggttggggtatcaagattatagtagccttgcaaaataatttttctgtaacattttgtataagattagagttaatccctcacgtttggttgcacttgcccatacggggtcttcatttgtagtctggtgttttgcttgaggacttaaaattttacattggtacaggtatatttatttatttattttgttttgttttgttttgttttgagacagagtctcactctgtcgcccaggctggagtgcagtggcacgatcttgtctcactgcaacctctgtctcctgggctctgcctcagccacctgattagctgggattacaggcgactgcaaccatgcttggctaatttttgtatttttgatagagatagggcttcaccatgttggccaggctggtctcaaactgctgacttcaagtgatcgcccaccttggcctcccaaagtggtagccaccatgccccgcctggtataggtatatttctaaacatgactaagtttttaaatcataatctagtgaagtttctaattcttattaagccaacttggtaatttgttttgctagaaattgtccactttacctgtttccaaatttaaagaaataaaactgttcacagtattcttgcagttttaaaatctcagtttgtctgcagttataccatcccttcatttccaatacatttgtacattctttttctcctctatcagtcttggcactcttttcaacttagttacatgcactaaatcaaagacactatttttgttgttgtcgttgttgagacagagtctcgctgacactatttttgttgtcgttgttgagacggagtctcgctctgtcgcccagcctggagtgcagtggtatgatctcggctcactgcaacctctgcctcctgggttcaagcgattccccttacagaatgtatcttctgtaattgttgggtgcttgctaattgtactcttccaatccttcataaccttgtagttttttaaatctaccctttcataaattactgagaggtatattaaaattttctactacgattatagatttgatttatacctgtaattcttccaattttaccttataaattacacctagtatatcttttccattcctttgcttttaaactatgtcatcatacttttaggagtatctccacttgtaaaatacagttggttggattttttaaatttttgttctcctttagccagcaagtttaatctgagattacatattgggtttatggagatatttcagcttattttctaccatcttattttgtgttttctaatacctatgcatttttcttttcttttttcttcttccctgccttatactggagtgatcaatttctctttatttccacccctcatccccactgacttggagttatacgttattctatttcaattcttttggagagttattggtaaaaaaatttttaatggaaaactttaactcatcattgcattgtagatgaaaacagcctattgaaaaccataaagaattttttttttaagatatgggttctccctatgttgtctaggcttgaactcctggactcaaccaatcctcctgcctcagcctcccaaagtgctaggattacaggcatgagccaccacgcctaaccaagggaatttttaaaaaccagaaacctcatgaggatagggagaagaggtaaggagaaaacagaagcaaaattttaatggctggaaaatgggtgagcagtaattgaacagatcagaaactactaactctaggctagctgtaggaaaagctgaaaaccattgattaacacagaaacctcaaaaagttaaggaaccaacagcaagtcacggcaggaactgagggccaggcaggggaaggaataataggtagcacttgttaagagctttgtagaaaggaattcagttcttagatttccgcccctactgtctctggataactaatcctctgcctcaacgtttactttctgcaaaggggaaaacaaaatccctggactaggagatggcctgggtataagtaggaagaaaagagggtgtgaatgaacatgagcacgctgtgttaaatgtcgactcccaaaccccttcctccactgggttttggctcccaaatactagcagccagacctccgcccagttattcagatcaaaagacttcactagggtacctgaccgacccaggaggaaaggcatatagatgctaatattgggagtttaccaacaaacagcctgcctgctcagatccctctccagtgaaactgaaaggagacaagtttcacccacatgttgagtttttgatcagctttttagatccccacttcttaagaattactttatctgaggaaaaacgtcaaacaaaaccagaaaaattcagcttcaggaaaagactatacagagaaagaaaacatttttaaaacatcaacatggccagagaaataagactgagcaaccctgaagaaagagcagcatgctctcaaaggcagcattcagagaacttaacagctcttgcatagcttgacagcagaaacgggggaaaaaaatcaatagaagtgctagaagataaagtagaagaaatcttccagaaagtagaaaagaaagatgggaaacagtagagaaaatgaaaaaaattggaagactggttccagaggtccaatgtcccaacaacagttccaaacagagatgcagagtaggggagtcaaatagataaattaagaaaaagcccctgaactgaaagatgggagtttctagatggaaagggcccatcaagaccccagtaaaacagatgaaaacaaacctacatgaaggcccatggtagcaaaaccagaatgccaaagacaaagaaagggcttaaagtttccaaggaggaaaaaaaataggttatatagaaaacaatcaaaatggctttggttttgtcaacagtatactgtaaacaaagtcaagagagcaatggcttcgtaattctgggcttcataatttttcaaaaaaaaatttccaacctagacttatgttagccagaacaaaggcattttcagacatgcaacatctccaagtatttaccgccccacccccaacacactctccaggaaggtcctgaagaatatgtctcatcaaaaggagatactagtaaaacaaaaaggaatacgatctacactcgaacccaggagtgcaaggctgcagtgagccatgatcaccctactacactccaactagacaacagagtgtgaccttgtctcaaaaaaaaaaatacacacacacacacacacacacacacacacacacacacacacacacacacaaagaataggagatctaacaaagaagaaaaaatgaaggcaatccctaatatgctagtgagggggaaatctcagaatgactgcggcgtactaggtgtagaggcaaccagtgcaaatcggagcaagctaaaaaagacgaagccaaaacaacggcagccttctctccaaagtgaacactgtagaagtcaatggaagcataaccttcactgattagagccaaatgataaatggatgggggtgactgatggggccataaagaacagctttgtaccactctttaccaatatctcagcagatttctgattccaaagattacaacgcaaaagaaaaaaattttgcctaagtggaattcttatgttagtacatgtttatatatgtatggatttctttagaccagtgctatccaacagaaacaggatgcaaaccacatattgttaaattttctatcagccacattaaaaaagtaaaaattggtgtgctttagtcagttcaggacggtataacaaagtactacagactaggtggcttataaacaacagaaatttatttctcacagttccggaggctgcaagtccgagatcagggtaccagcatggttaggttccaagtaaggccctcttctgggttgcagactgccgcttttttcaggtatctacacatggaggacagaatgctaacaacggtctcttttataaaggcactaatcccattcatgagggctctaccctcctgacctcaatatctcccaaagatcccatttcctgatgccatcacagcgggaattacaagatgaaatcataatttaataattttattaatctaacccaatatatccaaaatactatttcaattcgcaatccgtattaaaaaccattgaaatatttaacattctgtttttgtactgttagaaaattggtgtgtattttatgcttgtggtccatctcaatttcaagagctcaatagccacatggtggctagtggctatcatactggacagagcaactctagaaggataaacgaaaagctagtaacagtggttacatttctggaaagcacaactgggcagcaggaggtaggagatgtaaaggaggcttacttttttcagtatttgctattttgttctccttgacttttataccatgtgcatgtgttattcgaaaaaatgaataaagtacattctctaaaataaattacaaatgtagatattctttgaactactcctagaaatctatcttacagacatacctgcaaaggagcaaaatgctatataaacgaagttatttgttgtagcattgtttttaataccacaagactggaaacattcaacagaggactgatgatatattcagacacccggccaggcacagtggcttacgcctgtaatcccaaaactttgaggggccgtggcaggcaaatcgcttgagcccaggagttcaagacaaatctaggcaacatggcgaaaccccacctctacaaaaaattttaaaaattagctggatatggtaggcatgcgcctgcagtcccaactactcaggtagctgaggtgggagattaacttgacccctggcagtcaaggttgcagtgagctgtgatcacaccactgcactccagcctgggtgacagagtgagacactgtctcaaaaaaaaatttacagacacccatacaaaagaatattatacaacccactactccaaaaaagaagaaaggcattcattacatactgacacaaaataagatgtactattaagtgacatatgtgaccacttgtactaaaaggtaatatacacacaaaattgttcatagatgcataaaatctctggaacaccacacaaaaacctagtaaagctacttgcctttgaaaaggcaactgtatggcaaagaacagaccagtaaagagactcttcactgggtatccctgaattttggattgcagtcatggattatgtatacaaaaattcactattccacatgcagctgtagatgttttcatgtaccctgccttgccttgctgtgatattaaagtccatctaaagcctactgtttttccagttcctccatagagaggtctgaggcttctttctccaagaagccccagatgtttcaatgataccagaacacttttcattttttaatttttttaagcacacagttcccacagttctgtctcctttcattgaatggcattataacctcagccccaactactgaatcttatctctagtaaatcccccaaggccacacttcccttaaagttgactgatttttctaagtttctagtacctgggcactttctctctcaagatcaactgtatacataagagaaaacttttatattttatccaacattttcatctgtttacagtaagaagaatgggcctaacttgtgtctgtgtcattttaagaaatttagataaagacagtataaacaataacagcaaacactgaagaaagtatgatcactgagaaaagactgctaaacttgacagttcatccggaaggccagtaggaagggaaatgtgaaaaagaatggttaaaaaatatgtttgcaaagttgaagtcaagaacagatagtgattaaatgtagaaagcaaaagtagattgcacttttaaaaggtatggagggaagagaaatttcaaatcttcaaactgcaggaaaatacaaaatattccccaaatacctatgtgaatttttatttagaaagaaaaccaaagttaattatttcaacaaaaatactttaaatatgatggtgctgcctcatctagaacatctaaggtcccactagaaataatataaaatcactgtgcagtcaatcctccttatctgtgggttccaaatacatggattaaaccaaccatggataaaaaatattcaggaaaaaactgtgactgtactgaacatgtacagacttttttctcatcatttctaaaacaatatagaataacaactatttacattgtattagatattaagtaatctagagaggatttaaagaataacaataaaatgtgcataaaacaaattctacaccattttatacaagggacttcagcgttctcatattctggtgcttgcaggagagtcccggaaccaatcctctgtggagaccgagatttttagcaatctatgttcaaacatactacaaggcagagaaaaaaacagcagcatcaatgacctggaattgtataactgttttagtcaaataaataattcattagtaaccaggataatagaaaacctcaaaaaaattaaaatacataaaacccaattttttaaaaacagatttttcaattctcactacaactatgttctctccaaagcgtaagctagtaaggaaagacactgccaactggaaacctaggtcggcccccatggagaatgatgggtcatgtcttttaaacaaaagcaaacagaaaacattcatgtgttcaactttatggactgtcaaacctaatgcaagcttgaatttaattcaagaaaattattattttagcaaaagtccacattaaatagggactgctgtgtaaagagactacttatttttttttttttaactaagagttatattcctatcacctataatgagttttgtggaatccacaactctataatcaacttgtaaacacgtaacttacatattggtttatcattcccagattattaaaaaaaaaaaaaaagcacctatgacaacactacacaggcccagactcaaatcagcacaaatataaagtacaagtactctaattgctcttcaaattcccaaagtctatcctgaccctcttctgaagcagcaactaataccacgtcaattcacgtgagtggggtcctcaggccataaaagctcaattaaagcaaagtctagagtagtgccacccaacacaactttatacaatgatgtaaatgtccttgggtatctgtgctgtctaatacagtagccatcagctgcatatggctatctaaatttagattaagtaaaatttaacattcagtttctcagtcacagcagccacatttcaagtgctaaatagccacatgtggctggcagctacctgttaagatagagcaggtctacagcaaaaatttctccaagacctactgttcttcagctgtgcttcaaaggcttcctggtggtgaggatgagaggaaaactgatcaggcaggacttcaacaactgcctattcttccttccacaaaacagctttactccttttatctgttttacatttcgaaattctgcatatttctctctaaaggctttctagttgctgctgtgtgtgcaggtgtgcacatgttttaagtctgactactactggtttcgagcagaaatggccaatgcacaacctcaggccaaagctggaccctcctgataactaaaacattttttaaaaaaaagtttaattgatcagctaacatgaactacaacctaactacctgtctattaagaattttaggccgggcgcagtggctcacgcatgtaatcccaacactttgggaggccaaggtgggcgaatcacctgaggtcaggagttcgagaccagcctgaccaacatggtgaaaccccgtttctattaaaaatacaaaattagccggacatggtggcgcatgcctgtaatcctagctactcaggaggctgaggcaggagaactgcttgaacctaggaggcggaggttgcagtgagccaagatcgcaccactgcactccagcctgggcaacaggagcaaaactccgtctcaaaaaaaaaaaaaaaaagaattttaaaagtggatctcaataaggaaaatttacatttactaccacagataaagtatctctagtcaacaaaagagtttcaatagttcactcaagtcaaggcagaaggctcacgggcccagcttccactgcatcatttatgaggattttatataggaggctctgcaaaaaagatttgccaccccacattttcttttttttcttttttttttttgagacggagtcttgctctgtctcccaggctggagagcagtcgcgggatctcggctaactgcaacctcggcctccccggttcaagcaagtctcctacctcagcctcttgagcagctgggactacaggtacccgccaccacacccagctaatttttgcatttttagtagagacaaggtttcaccatgttggccaggctggtctcaaactcctgacctcaaagtgatccgcccgcctcagcctcccaaagtgctgggattacaggcgtgagccactgcctccggcctcaccacctcacattctgaaatgaaagacgtgatgaggatggaacgtttccttgatatttacaagaccttaaccattatgtctctacagaatttctggaagtagctgaagcagcatatgaaaatgtagtttacttttaaacataggcaaactataagatcacagattcactatgctacttcctcagatcaagagtcttttttgacttaagagactcaaactaatgaacagatggaataccagtggttcacccaagattattcctactgaatacattaaatgtgaaactacatcccccttccccacaaaatgagggaaggtatgacactgtagattattcaaggaaatgcaaatttttacattaaggtagacacgtgtactaaacagaagcaactaaagtctatcctcgctttccactactctacagccttgaggccaatgtaaaaccagattttgaaaaatgacagggctacctaggataattagtgacaatttcacagtaaattcacaaactttgataagaattaatcacgtcagaatttctattttcttaagactacaaacctaaagatacatcaagcacctgtcctatcaatgtgcctcagttacaaataagaggaacccactgagccaaggagaaccactcacactgtacaatgtgaggcaagcacagaagacacagaattgccctaatatttctggctatctgaccaaactaaaggcagtgtctaaatccacctggcttggaaaaattatattctccctacatgaaattgctgaactgaagctgcgagctatctttgagatgtaaatctagaatcaacattgaattatgtcctaactgaatacatcacaattacaccaacctgaaaaaatgatcaaaattgatcaatgacaagcaataagcctctaactatgcatttttaaaccaaaaaggctagtacttttgtactactgctaaaaaaaaacctgattcttaaaaacagccaaggctacatattacaaggtcaccaataattatctgatggtgtagatggtttaagaagtaaccctgaggtaaggttacaagaaaggggatcaaaaaaattatcagtgctaatactgggcagaagtcacatgacaagagtcaagaaaccctcaacagagagactggccaactatccactcttgctttatcctagaaatctcgagcatactctatctcaaaacacagtgaaaagcatacactactgtcaaagcacaagtgaaaatttatatgatactcctgcagactgacaaaaaaattacttacaccaaagaaaggggtgacatagggtgctaccacactgaaacagcctttctttactgctggctaccctttcagcttggaatctgaatggctgtctgaatggcaaaacaaatgaaaaacatcttggtcataacagctactgtgatctttcatgaaataagccataagctatagcacaatcttcaacccctttaagaacatttcttaatcatcctgagtgacaatctaaagtatattacgtagattattgcactcttaaaaagattttcccaaacatgatttaggctaattgatgaacattcattactatgctttcaggtctggtcctgcactcaatggccccagacatgctagtcaggctttgactatttttgtgtcttgtagattatctctattatcctcaccgagctgttatctgttttttctgacaagagacactaggctaacatcctactccccagcccccaccacaccccctctaagcctcccacagtacccataatctacttgtttctaatctagtgcaggtttagaagccagataactttgcttgttagaaacactttaaataaatgccaacacattcttattaagggtctccaaggctctcctaagctttaagctatggactgggacaatttggctatcccaggcctttgttgttcattgtctgcttctcaaatacattttacaataggtccataataacagtgtaggcaaatcatttggattagaaagagcccaagtaacaaacccacaactacaagagaggaagaaatcatttgggaggacccttatatctcaggcaatgttctaggtacttgaattgtgatcactgaataagaggaaggggttagtacttccattttgtgtcagaaaaccaagggcctggggttggtagtaaattgcccagtattgtaactgagaaacaaaatattaggctagggctctctgattccaaaacccaaggcctttccactacatgagactgctgtccaatcctgggtctcggtttaactaactttttacactattcccgatcctttcactgagttattcaactctgctttctttccttaaccagcttctgtaattaaagggcaataagtgatcaaattaaggtcagatgaagcttagctctacaagtgtacatctgttcagcaataaacatgtttctgaaagactggccgtatcttcagtttgtatagactgtgcaaaactggtgccaaggtccccccaaaatacacagattgttcccagtgacactgagtaacacttcacatcttccctagtgctatctgctacatgttacaggaagcaaggcaagctcactttaggaatggctcagtaatgcatgtgcccttgatttgtacactaacaactgtcttactctaaacactggagaatagggcaagggacatgagtttccacttttctaactccattaaggaacaggggtgtacttgtttgctgttaagagactttattgcctagtccagagcctgacacacagaaaaagctgtttgttgaataaatgaataaatgtatttgttgaaaataaatgcatcggccaggcgcggtgactcacgcctgtaatcccagcactttgggaggccgaggtgggcggatcacctgaggtcgggagttcgagaccagcctgaccaacatggtgaaaccccgtctctactaaaaatacaaaatcagccaggcatggtggcgcatgcctgtaatcccagctactcaggaggctgaggcaggagaagcgcttgaacccaggaggcggaggttgcggtgagccgagatcgtgccattgcactccagcctgggcaacaagagtgaactccgtctcaaaataaaataaaataaaatatataaatgcataatctctcataacctctcttaactggttgtgaattccttacgtttcacattttctgacatacctttggaatacttaggggaaaacatcttacctctcacagaaactaagggcctaaaaatggctcttctacacccatcaaaagactaagaatctaaaagacatgcccccctctaccctctaaaaatgactctttgtcctaagaatatgaataaatctccatctgccagactgcactaaatacagcttttatatgcattacaaaaacacctgtataaaaaagctgctacaaaacgaggtttttggagccctaaagcacaaaaccaacagaatcaaaaccaaacaagaacaaggaaagacttttaaaactgacagtatttgcaaaatgtaaaaattcaataggtctttggccagcggtttacacagctaaaccgagtttttccattgacatatattcccccaaatgtgaagtaaagattatagcaacatgattctaatatttacaatgtgaaaatgaaaaggggacaacaacctctggccatcttgaagtagaatagaaacaacctttgttcctactaaagttctgttgaaataccaaaaccatccccaatattcctacacaagagttaaaacacataccaagcctgataagacacaaacaacaggaaattaccctgcacagtttcttaaaagactattatttcatgaaacttacagactgtgtagagacatgaccacttatgactaagtaaacgtaggttacaaccttgaaaacccaaacttttgttgaacacctacaatgcttgtggccgcactttagaaggtgtggctaagtataaaaaccaagctctaagagcaatttcttactaaaaccccaaaatgaacgtttccaatcacattacattaattaaacctggccagtgaacagccttgaactcaattaaatccagcagagtttaatatttatagtaaaagtgggcacactctttagaaatgccgaaagatgtgaactatttatatttactacgacagctaagtttacggcaacggctaaggaactttaaaaataaaagtattacttttgaatttaatataaacgtttgctaaatgaccttctggcagaggaaattctttaaatatcttgtatgggttttccgaaggcaaattttttaaataccctcaaactatggtacatttatgaagcccattttaaattacttctcccatctctgcttcatctgcttcactaattcatgtattaaaactgttgaaactccatttaactatttgactaacttctctgtaagatggaaactttttaaagggtgttaaagtagaatagcaaattttcagcataataagagcaaatttattactaggctcaaggaaaacatcctatcagcgattcattcatacgaaactatcaggttcaattcatatgaagtcagaagagagaaaaagaattttggaaattaaatcacatttcaaagaccatttctaaaaagatgtaattattccaagttatttatttattaacaattattttacacatgtcgttttaaaagtttcacaaacccaaatttaagatagtccaaattgcaacaaacaagacatgactttgatggaaaatgctgcttgcaaattcgttttacctggaaatttcttttttaaaggtatggttgacaacacactggtggtattttgcttttaaagggtcaagagaaaggaataacaaaaccaacccaggcattctttttctgtttaggatcaaaaggacattttaaggataagtaaaagacaaaagtacctgacccaaagacaatatccccctccaagagaacaaagtaagttgcaattttaaaaaccaagtttgaaatacgagaaatcacttcgagggctttccaaaggcgtgtgataaaaactaataggctccacccgcagaacaactttcacaagtgagtgaaggatgatcacagagttatcagctgtgtgcgtgtttgtgagtacacacaagccatggaaaacccgagactaccactgttaacaaaggttacgagaccaaaaaaaaaaagtggaggcaaagtattacgcgtccctaacaaggcttccccacaactcctgaaacaagagctctggcccttcggctttaaaaatcagaaccacaaactatggagtgtgagagcagcgaggggaagggacgcaggcagcccccgcccccgtcagcctgggcggcagcgcagtgcaaccgagccccgtcccttcccggctctccggccccgaacccgcacgcccgggccggcgcacccacagcccccgaactcaccacaccccagcccccacccgcagcggccatgtgacacggcccatcgccccggccgcggacgcacgcaaacacttccctagctggaggcccgcgggcgcccaggctttacctgcaaggtggcgccaggtcccgccccgtcagatccggggggtccgggaccttttgttccttcctcttccgatgggatggagggggctgggaggggaagaggggaatgggcgattggaggcggaactgaaaacactcccggccgccgtcttcccgccccgcccccaggcccgggcccggccggcggcccgggcgcgcgggagggtaggggaagagaggggaggggaggggaggagaggg

SEQ ID NO: 1989 - DNA, 129339 bp, Homo sapiens
  source 1..129339: mol_type = genomic DNA
gcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtgggggcccgcccgggggggacccggggtcacgccggcccagccccctggcactgcggggccgacccagtggggctggagatgggaagagggagagagagggagggagtgagactgtgtgggtgcgtgtgtgtgagagtgggagagcgcgggcaggaagggggtggggggaccccaaacaaaaccatctctgatttgcaaagatcagagcccgaggcttccacgcggcactctggcttccacacctcacattccctttccacctccgggaggggagagcgggttgctgcgggactcggccgcccccactccggggagctggggctggaagttgaggcccgctttgttcggctccgcgggccggagcccctcctccgccgccgcctcccgcccccgcggcccgcgctcgtggaggtggtggtgtctttgcgtttcttttcttcagtcgggtctccccactttcctctacaggaatgcggtccgtacagctggggctgtgggtgaggagcgggagcctagtgattgacagattccttcttcgttctttctttgccttcgggattagcatttttatcgagtatttttagactcggttgtgccagtctcccgccccctgagcatgcacgcactttggttgcagtgcaatgctctgacttccaaatgggagagacaagtggcggaaaatagggtcttctcccacctcccacccccccatcccgactcttttgcccttcttttggtccaagagattttgaaaccgtgcagaacgagggagaggggcaggctgcagccgggcagataacaaaacacaccccaaagtgggcctcgcatcggccctcgcattcctgtagagccttccttcccaaagcgcgctgccatctgtctggatctcctttatccttcccgttgcgcgctagctaggtcgggcgggagcccacagatggctgatagaaggggtcagtgacttcactcccccagggccttccttagcttagatgtgcctggctgggaactgggggtgcgggtaccttggcttcctgtctctacctctcagcctcctttgatgctgaaccaagggagagagcgtgtgtgttgggggctggctcttttgggggtcccaggctgccgaggaatgagtagaaagcaccagggactgtcagccgcaaagggattgtcatccctgctcctgggccagggtggactccatccttggccacctgcttggggcagttgtacaggggctgccaggcgagtcaggcaggcacaaagcaacatctgtccacgggaaccgagggcaggcctcccctggaaataaatgccacatatggtgggagtgcggacttaaattttttttaactgggtggatccagtcaataaagggggagggaaggcggtgtgctgtctggggaagtctctgggcgtgtgatcgggagccagaattgacttcagaggaggtggtgtgatgtgatggtcagagagacctgggatttggttccagctctggttgttaattcttctgtattccttccgtgggggtggctagggtagagtgggtgagtatgctacttctctttctggggaggggtctgccaaacctaccttctccttatctgcctgggtgcattgaagacaagtgctttatgtattgaaacagaagaaaaaaagtggtatcaattgtaaaacaggcagctgtgaaaagtgtttcacagtttacaaagcactttcacatggttttctgaggtcctcaaaaaaagacagaaagcaagcaagcaaccagccatggaaagtagataaggttgttaggcttaagattatcacatttttaaagcagaggaaaccttaaaagagagaggtgaaaaggcttgagtcatagacatggggttctgcctgaatgtgctctttctgctgccccatgctgctttatactttgaagatcctgaatacattctttgctgaatgctaaagctgtgttagcttggggagggccctgtggatctttgtatgtgcggttgcttctttaatctttgggctggtgatagcttggcagagaggccttgctttcccttgccttggtaggagtttgtcctctgtggggccatacctttggcctgccttttcctcttccaaagtcctgctgagactttggaagcctaagacgtgtgaacgctttggatgattctgagagttcaagccaacctgccctgtggccttctcgtgactttgttaggactgaggcatcttctgcctgcctggataggactgaatacaaaagtagattttttttttcatcttttttttcagttagggaaacccagttgcttgggtggatccagacaaaatggattttcatccttggattttgtgcccacgcctctgggtcaccttgtgtcccttggcaacagctgctgctgttttggtcgtgggcagaaaactaaaggccacgtcttggggaggtggctggtttggccctgtgctggtgatatcaatgtgtctgctaagccccatagattgcagtgttgcttgtcaaattgtctgctttcaccacaactgccttttagtttggaaagtagagaaaggaaaatgtttaacttagtcattccccctgtgtgtggggggttggtcactgggtgcttaaaaacactctgcaagatctggactccggggtttaaggagccctcagtctaaggagattaagccaagtgtgttttggctaatatataatcatgagcagcaacagcaacatttggcaattagagctgtatactagggacttccagaccacaggcttgcttctctgtgacaccagctctgacttgtttcaattatcaggggagctggcgtgatacacacttatcgacataaagaaggtgaaagagattggtgccaaggaagtggtaagagcttcatttagatacaccaacaaaggggctgtcaggatactctgaggtctggcaggattggcagaatttacacaagttttataacagcctctcatgcctcacctgcttgagtacctgagtaaagctgcaggtatcttccttgccagtttataagaatggaatcaaagcatttgccgctgaatgagagttggtgtgtgagcgttatatgaggaataaggagctcggcacacttaaaacttagttttctggtagacactggtagcttgtacttccaccagggaatccatgccttggcctcgttgttgggagctagaccaagcttaaagcattgcttgtttggaagggaatttgggctttcttgtgtcagagcacccagtccagtggaaaattggagaattgaagcaaacactaggtctgacacacagcatctactccctccctgtgaatctgatgttttttttttggagacagagtcttgccttgttgcccaggctggagcgcagtggcatgatcttagctcactgcaacctctgcctcccggttcaagcgattcttgtgcctcagcctcccgagtagctgggattacaggcgcccgccaccacgcccagctaatttttgtatttttagtagagacggggtttcaccatgttggtcaggctggtgttgaactcctgaccttgtgatctgcccgccttggcctgccaaagtgctgggattacaggcgtgagccaccgcgcctcaccgaatctgatcttttactgtagcctcctcttattatctccttgacttttgccagggtactctcactttgagaaaggaaaaagatcctagtctttaacatgccttttccagatttctggggatagacctattactaaggctgtagaggcctcccttttctcttggctgcacttcagagcaccatgcccgtgtggcccattggaagcaagcccccttccagctgctagggaggtggtccattatctctttgctcttgttaagtttgattaggggagttccacgtagggcctgagaagaggaggtgcctgcaggacaataggtagctgatgagggatctgactcagctgcagctgaacctaggcgccacttgacgttccctgggaacatttagaaccttggaacatgctgcttgcacctgggagtggaatgtttgcagacagcccctctgttgttacagggctggattttgttgatttattgatatttattggaccctcccatgtctgagtcaattttttaggtaccagaggaggatgcagagacacgtttgagaagctcccagcctgtgagaagcttacacatcagtaagggaaacatgaatagggcattatttgagtatctaactgctatctctttctcattcccagctaccagtagaaatatgagatctagtatggatgatttttgatgggggcgggcgttgatgtgccttttaaatattgtagaattcactatgttaggaaataaaataatgacaggcatctgtttttttctgaaaaaaacacaaaattcaggtcctgtacctgccattttaccacctgcaaggatttgggaatccatttaagtttcacagcttttatatctgcacctgtcaagtcaggatgagataagttctgtggaagtgttttgtgaaccagagaatttgacaggtatgttacgtttatacttcattctgcatcattcattcattattgaattattcagtccttcgttgagaacatactacaatgaccacagcagggtccctgtactcaaagagctccctgtctagagcgggagacagacttgcccaaaggtatgaggcatgagctgcagctgaggaatgtgctaagtgcccagcaatgtggaaacacagttaattctgtgggaggaggtgtagagaggaggagaacccatgagaggtggaaaactaagaaggggacaagggttatccaaaggaagctttttggactgcagtatgatgttgggaactttttggtacatggggatagttccctataagaatgaggacgtctttatcctcttttactaaactgagtgctgctataaatatgttaccttgtaactggcactgaacagctagtgacttgggtgctatattttactccactgtaaagcattttctctttgaagtaaaaagtaagttagtactgcaaactgaaattcaggtttccttggtgggaacagggactttagatgtatcagctcagaatatgacagggagtgttaataaaaagtggacaacttggctgggcacggtggctcacacctgtaatcccaagcactttgggaggccgaggcaggcggatcacgaggtcaggagatcacaaccattctggctaacacggtgaaaccctgtctctactaaaaatacaaaaaaattagccgagcttggtggcaggcgcctgtagtcccagctactcgggaggctgaggcaagagaatggcgtgaacccaggaggcggagcttgcagtgagccgagatcgcgccactgcactccagcctgggcgacagagcgagactctgtctcaaaataaataaataaataaatgaaaagtggacaacttgcagatggttgttttgaaattcaaagcttcggtgtgacctagcttctcatttctctagttaacacttgctgagaataaatcctagacgcctgagtttctgaatgaacataggtgcttttagtggtatattttttaaaaagtctttgcaagggtgaagttttaaatgacaattttaataacagaaaaatatgaatacagtcgcatttaattctgatgagaaatgcaagaagttgatgaaattgaaagaatttgtttcaagcttatcacatcaggaatccaactaaatgagttaaaaaataaatattggtttaataatgtaaacatgtgattgctgtattattataatggaataaaattaacacgatttaatgaactgagcgaccattaatttttacttgttaatttattaggagattttaatgccatttgatgcacagtacagccattattctgcgtgagctccttaatgaaataaataagaccaagcagggcttgcttcaaattggaatcagctttcattcctgttaaccttattctcccacctttattcacctctccttcagcttcctgtaattgcaattaagttctctaagattggaatgcagttttcttaatcagcaagtctcatcaatagtcctaattgacttttgcccttttctcctttgccatattgactgattaaaacaaaagcaaaacttaaagactccattccctcccccaaatccccatctcatagtgttggttggctggcaagagaactgcccaagaaggctgctcatgatggcagcctgctgaatgtgcagggggtggaagttcaccagccatgtgcagacgtgaatggctggtgcagtgttggatgggactaactcctccctaaggaggggtatgaccttctgttggcctctgacaagtccctgagccatggagccttcagtcttcccatcttcaagcacaatggttcctggaaacagtgggaagttgccatcctaagcccaccctacagaagtttggtttctaattttactgtgttctaagctttagaaccgagacaattccaagagaacttgtccagttcatttttatgccttcctttaatgccgtaccaggtgctaatttctgtgccagataatgcggacaaaatagtgaataaggcagatactgtccctggtgccttctgtagcttctagtccactggctgtgaaacacaggttctttggagttgtaagaatgctgtatgtgttcactctttagctaatttgtaaatactgtttttttggtgccaaaccacatcccccaagctctgcagtttattgacttgacaaggatctctctctctctttctctttctctctgtataacataatcctttgtttcgacttaacagtttgagaaataaacaaatctatagcatactatccactgttggttatctaagacccttcctataaacagcagcctgccacagtggcaactgctgtagaatgttttggcagagactcagtttaaaatgaaaacacagtagaagcctattaattaagaagtttggctaattctggactaggcaaaagtttgtttagcaggcctttttgccccataaatgctgtcaaagaaaaattaataaacaagagtttggggattattttggaggtaggagtcagcagaccttggtaggttctagacgtggctctgtttctgattagctgtgtgacctgggacaagtcaccttctttgggcctcgaatgttctcaactggaaaataggctagataaactctattggagggcctttctaacttggaattggtattcatacaagcattttattttattttattttattttttgagatggagtttcgctcttgttgcccaggctaaagtgcaatggcgcggtcttgcctcactgcaacctccgcttcccaggttcaagtgattgtcctgcctcagccttctgagtagctgggattacaggcatgtgccaccacacccggctaattttgtatttttatcagagaccagtttcgccatgttggccaggctggtctccaactcctggcctcaagtgatctgcccgcctcggcctcccaaagtgctgggattccaggcctgagccaccgcgcccggccacatacaaacattttaaaagctcccagttgcacgcatctagttgatcagtgaatgacagatctttcttaattattgatgttccaagactctatcagcctggtgtcaattaatttacataagtaaaaataataaaattgtaattcagcctttaattttggtgatttccctccctcttccttgcctcttccttactctgtgagtctaaatcagtgaaatttaactacaaaggaatatgaaaataatgctaggatgaagatgtggaggctgtgcctcttgagatgcagtgaacagtttttcttcttttgttgctatttttgactattctaagaacaggaagtttacttaaactaatgaccacagatgcctaaaaatggttaaatgtaagaggtaggcattatagaggatacctgtggaaaatgtttgctcatatgtcaaagtttacccaggaagcttcctttatttatttccaagcatctatataaagaaaggctgcacttgattgcgtaagcatgagccttttgttaggcagcgtggatgttgcaagtttaaaccccaactaggaaatgaaaagtgagtttcctcctaaatagttctttttcagtatcacatggctctcccagcttacatctggcaagtttttctcttgagtgctttgccggtagtttaggactccagtattgtattgtattgtttgtttgtttctttatctctgtctctctctttttttgttttttgagacggagtcttgctgtgtcgcccaggctggagtgcagtggcgtgatctcagctcactgcaacctccgcctcccaggttcaagcagttctcctgcctcagcctcccatgtagctgggactacaggcgcccgccaccatgcccagctaatttttgtatttttagtagagatggggtaggactccagtattaagaaacactgtgtatggctttgcctttgaaacctacagagttatgaatctggtcccttttgctgctaagtgttgcatcacaaactgccaagccaagttgtaactctgaggtgtcaccattttttttttcttttcaactggacatttgaaaatagtaatgctttttgggtgtgtgttttttaaaggtctgtttttacgctgtcactgctcaaaaatgccaaaaggcattttttccttaaaaaatcacctctgggctaagcccaaatgtggagtaatgaatccagaaaggactttttgagtagttacaagtggctgaaagcaggcactggtgatggaaattgggtttttccttttgcttcaaatcttcctggttgtaaactttttcttacccttattgaagtcagactcaaggtgggtctaatttctcccagcccatgggaaggcagagtgaattactgcttgttgtgccaaccctttacattttgtgtgtggctgtttgtctctacccagacaggttcttcacatattacctggggagcaggagagggggaggacaggaagagcacagttgggcagaaagagcaaagcctctcaagtctgatgggtttgggtttgagtctgacagttattagctatgtggtgaccttgggtactttgcttcaacttattgagccccagtttctgcatctgtaaaatgaggatgaaactacctacttcatagaaatcaacccaagtggccgggcacggtggctcatgcctataatcccagcactttgggaggccaaggtggatggatcacctgaggtcaagagtttgagaccagcctgaccaatatggtgaaacctcggctctactaaaaatataaaaattagccgggcatggtagcgggcgcctgtaatttcagctactcaggaggctgagacaggagaattgcttgaacctgggagccagagcttgccgtgagccaagatcgcaccattgtactccagcctgggcaacagagtgagactctgtctcaaaaaaaaaaaaaatcaacgcaagtgagataagatgtatcaagtactttgccagtatcgatcataatacatagtagatgcttagtaaacgctcatttttcctttccaaggggaaatttggcagatgatgtccgtcgactccaataggtgatccccttcccatcccgacacacttgctcacagagcattctcctttggagagtctcagttgatataggaaaaggatctacttcaacacacacagagaacatacagacatgccacttgttgatgtaaggcttggcaggctattgaaagagaaacaattcatattcttaggcggttctgccctcccccatcaccttctctatcattattcttaaaaatttgtttggtcgactaaaaataatagtactaaaaacaaacttcgatgaatcaggtctcctggggcgggggatgggtaagatcctgaagcagaaacgcagtgactcacgcgcctgtcactgatagctgcccgtaagtgcatggaagtgcatgatgtttattgttgctggtgtttttttgaggcccaagttggaatgcacttccggctccccctcaagtactagcttactggttaggtgggctgttgagtgagaatggtcaggtccagaaactcatggctctgaaatgacccagacgtggtggctatacccttgactgccctcagatacgtgcaagagggagctcacgcttcaagagtcatgctttggccctccacctggctgtgctcctcttactggggcaaggagactgtagggccaagggacaggcccatctagagcaagcacttcctttttccagatcatgctcagaggcctgacccttccagttccctgcatcagtgtcttgagcctgtttccaagtcctgcgtgggcctcttccccaggtctgttttacttgagggcagactgtgttggccatggacagcatgtgtacctgtgggaccaatggctgggcaaggggtgcaggggcatgaaggaattggctagagcttggacttgtggcctggggactctacttgggtgtgcacaaggcctctgaaagttatgggtggtgctaggggtgggctgagatcttgggctgggtctctctgagcttccacattccattgtgaaaccaagaggtcagggaatcctaaactcaaacctggacttattaaagtattggtcaaggcaggatgatagaacgcattctgtgtaaccgtttgttaccttgatttgtctttaaatactacatatggtgtgtaggccttcctctgtatttttgctcttagggcaggcatttctgtatgtatgtatgtatgtacgtatgtatgtatgtatgtatttatttttgtagcatccgctcagttgcgtggccacaactgaatcccagtccaggtggcaccattatatgggtagcattttggagatgttcacaggaattgatttccctcaccctcaacccaggccagagtgaatttaatgcagatgagggagaaggtgctacatattatagctgctcattcaaaaagtggagcagagagctggaccactgaatgtgcctttgtttgctggaaatctttattaagtaccagagatatagagatgaagttgtgtctctgaactgctcagaggcaaaaaagggacaccagtaaccacagttatggtgggcctgtggaagagacactatagtgaaggtcaaacaaaatatttgggagcctagaggaagaacaggtctatttctggaggtatcagaaggcttcacagaggaggcaatactcaattggggccttgaaggatggataggagtgtaggagtggagtgggaggcagcacagagcacagaccagactgcggaagggcctgacatctagggaaggcaagacagtttagggtggccagagtgtggatgagggagtggccagagaggagttggagaaggatgttgtcaagggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgcccgagttatccaggtcagagtcataatcccttacagtaccatgtggacagctttaggctatgtctggagcaggttgaagatagtgttttgttcactgtcaggagagaagacatgttgttcagccaggagggctcagggaccccaggcgttcaggtaattagccagtgagtcatgtcaggcttttgatatggataccttgggaaactaagtggggtgttgctggcctccatgcagatgcctggtctacccaagcacaggcccccaaattagatctcggcctctgctgggtcttccctgtgcctgacacagtgccttcatatggaccgtctctggtcagtgttttcaatttctttgttgatgatcatcaatcaaggccaggctttccaattccagaccacactgcaatcagtggaaactacctaaattcagtactgcagacccatagcaggatgtatgtttattgaaaacagattatattccttaatgagagactaaaacagcatgtttaaatcagtattcttcattccttttatcattgagagattggttattatttacctcgcctttagagggtcagcttggtggtggtggtggtggtttaagttgctgggtttttaaaagattgagtttcatgtccaaggactgattctacttcatgggctgtttttgaaaacattgctagaaacctcttaactgaaggcaagaccaggggcagcctattgctgcggagtgccctgggttcaaatccctgctccccaacttactgcggtggtgactgtggacatgttgtttaacttatttgagcttccttttcctcatcagtaaaatgggaaaaacaatgacctccctcaaggagggatgttattgaagttatttacttaaatcagattagatttattttagattaaaagcttcttgcaagctgtgaaatgttttgcaatgtcacatattattattttttttttttgagacggagtttcgctcttgttgcccaggctggagtgcaaaggcgtgatcttggctcacggcaacctctgcttcccggattcaggctattctcctgcctcagcctcccgagtagctgggattacaggcatgcaccaccatgcctggctaattttgtatttttagtaaagacggggtttttctatgttggtcaggctggtctcgaactcccgacctcaggtgatctgcccgcgtcagcctcccaaattgctgggattgcaggtgtaagccaccgcacctcgccccccgcatattatttctttatggtgtagaactcactaatactgctaaaaaccctttctgacagagatgggagttaaggcttctaagttcacacccagatttccacagagaccttagagacaatcataaatattgcacaaaattatattggaatatgagctcggggcacataggctctggtgccttgtactagaagcttaggtgagctgttactcttggccatgtccaagcatttgactcagaagatggtcgagtcagcagtgttgactgttagcaaatcacctaagcccactcacatggggtgatcctggtacgtgttgcatggactgagtgtcaactgcatgctgagtgtatgccagagggggtgatctccttgatcttatttacttacctacagtactctgggtacttatgtatttatgtttacagaggaggaggctgaagcattgaggggtcagtggcagaacaggaatcttaactctggtctctggttcctagttctctgagctctaccccatagcccctcaagaaaggatggccattgttgtcctcatacaaaaagctatgacactgctatcattattctcatttggtaaatgacagaaacaaggttcagattacttaggtaagttgctttaagtctcaggctaagggctggagctggatttgccactgaagctctacaccttctagaatctagggtgactacataatttatcaaacaaaccaggatgtttccaagagtgaaaaggggcagcattattaattatggccactattaattacggtccttggccataaatcaggaccgtccaggcaaacctgggtaatagtcaccctgcctctggtcttgatacctgaccaaggtaatggagaattggatccgccagctcatgtgctgttgcttaagtggaagggaatgtgcaaattatgtcctgctattctaagtgaaaggacttgcccaaggtcatgcaacaagttggcaatgtaatattttaaaactggacgagatgttgaaaacatggtaaagttagcactagagcttaattaactggagtatgagttagggaacatttggctatgctgatgtctactactgaagggaaaggaggtggaggtcaaggtcaggtgtgtatggagcaggtgggggtggcagtggcagggcattcacgtggctctactatgtcggcaccatcatcaggccctgtccctttgaagtccgggagatgccactaggcccagtgcaacttggatgatatttaatggccaagagcagagacttctgggacctgacttttcctgctctccactttactttagctctgggcttcaaagggactattggctgggagtggtgaaagtttagtggataatcctgctgaagaattttggaaggccttgaggaaggaattaaaaataacagtaagcatgccttttctttctctttgattgtggtcagtgcatggaatgtgccagggccgctgcggagcaagcacgtggccccgaataacccctccctgccaacggaattctgcagagaacatgtaagggctgtgctgtttcactcctgctttgggctctcagggtttgtttccgcgatcatccaaacctcatcctccttctcttgccccagataatttattggaagtctggagagggacttgagttctctcaactctccaaccagactgttgctgtgggcgaggccatgtcgggtgagctccaaggagagcagttggaatgacagagaggaacggtttcagcctgagaaatgtgaaatataaattcaaaccaaacttggcacctgtttggagagcttcagctgatactacagtgcccctgtcgttagcctttgtggctcagctgggtcttataaatagaacacgatgcatttccccttttgctaccccacagacacgcggaggcatgtgtgggggtggcatggacagagagtattcattacttatgctccagtgcatcagatagtcatcgtgggaactgagccctggtgtcatggggatgactaggccatcttgtgggtaaggctggaagcggcttttgagtctcctgagttacagctcttcttacccttgccagcctcccttccccagctgaggccctcagtccttcatgcctgtgtgccgcagtaagccagttggccccttccgtcgtgagtccatcccacattctgtatcggagcccagcattgctgtatcaggatgcttttggccaaaagtgacttgaaacccaacaaatagcttcaatcataagagggcttattacttccactaagaaggctagaagcaggaaagtcaggcatcagaaggtctcaggagccttacatctttcctcctggccatattctcttcaagcttgtctcctgttggtccaagggtggccacaactgttgcagatattaccgtctataaacgttgcatccaagggcagaaaagggctcctattccttgggggtctctttaggaagaaaaccttccccgggagcctcctggtatcttgttggtcagtattgtatcacatgcagtcaatgacagaaataatggaccctcagaagcctctcgaggtcaagggcccaggctattcctttgactcatcagggtgattagtatggaggtaggtgcttagtaaattttatttgggttagtgcaaaagtaatggcagtttttgccattgaaaataatggcaaaaactgccattacttaggcaccaacttactgattaatgtttgttggttgctggtttccttcgctaagtgagactcctgaacacttactgatgatgtcttgctgacttctgaggacatgatggtaagtctgccctcatggagcttgcagtcaggtggagagatagtgctataattgtgtttggagtatctcctgagtagattgtggcagtctggtagctttggaagaggtgttaaattgaggcccaaggagacaaaaggacctgagaaacagagcagggggactgtctgggcctctgaatgccatgcccagggccacacattttgtgatgcaagccaggttgtttcaggtttcaagcagttgcgatttctgtctccacccctccaccagtcttattttcctgttgacaaaatgataacaacttgccctagggtttgaagtgggggcagggcacagcgctgagagcctcctccctcaggggaaattttctaaagtttctcactgtgttctagcttcaaaaccatatgcagtttaattgcatgtttagtatctttgtgcatctctcttgttttgaatctgctggaaactttctctgaaagcatatatataggaagacataaaaattctataaatgtttagtggttaaaaacaaagtcctgtccaaattatataaagttttgccgtcgtcggacggaactttctgcagatagggaatacccttgagtcttcagtcgcaaagagctaatcactaacttcaagtgtgcaagtgccctttcattccaattcagagaaaacagagcctgtcccaaggcctcgtgttttgttttcctattgatctaggagctgggataacttggaaccccagggaacatctcagagttaattagttttttgaggtcttcttgtttttcttgcttgattaaaagagttacagtttttgctctgattgtttaaaaaaagaatctatcactgctactgatccaagaggtgagggttggcatggggtgggcactccagtaaatacgtaagttgtcttcctgccgtcttgtcctggtggagcagagagaggtgcctttgagcatgggcctggaaccaacagctactttcctggaaaattcttcagtttccagaagcagtggccaggtgagccggggcatgaaaccagacgaagttgccgcagtgcgaggctggttctgtttgcctcagttctgaagttaatggtccaagttcaccactcatagagcgtcagcctgttggggagacggaggccctgacggccatgccagggtgcccccaaccctttgtttaaccacggctgtggaccagtggtctcagatgtttaccatcgcctgtttataagagggaagtgtggtcatatttctatctctcttgtgggctgcacggttgccttactggggttcatgtgggaagtggttaccgttaggaggaggatgaaataacagtactcacaaaaaggctttgatccagggatctttttaaatgtcatcttttggccactgtgtttttttatttttattttttgctatctgctttaacttcaacgatgagaaaatcaaaccatatgctggacatcattctgcccagctgggctgagtcagaattgcagttcaaactacttctgctctccctgggtttcgtgtgctttcaatgtggggatatcttccagatctgcagttctccagagctagggacccctcagctccagctgctctctggacaatacctgaacatccctacaatatctgaaattgaatgtttgccatttcttcttctttctcctcacacaacctactctgatgttcatgattactggagcccccaggttctaaaaagtgttgaattagcaagtgaacaaataaaatgagacccaaagaaactgtgatcttagcatcctgttttctgggtgaggttgagggtccttggcctctcttgctggtggagatgggctttatgactttggggaagtcaacttgacttcctgggtgttggtcttctcttctacaaaatgacaagcttgaagggagaatctgaaagaatctgtgtatccgttctcagattttctttttttttctttttttttttttttttttttttgagatggagtctcgctctgtcgcccaggctggagtgcagtgatgcgatctcggctcactgcaagctctgcctccggggttcatgctattctcctgcctcagcctcccgagtagctggcactacaggcgtctgccaccacacctggctaattttttttttttgtatttttagtagagacggggtttctttgtgttagccaggatggtctccatctcctgacctcgtgatctgcctgcctcggcctcccaaagtgctgggattacaggcatgagccaccgtgcctggccagtctcagattttcatgatagccctctgaactctccttggcttcttgcctttggctgttttctcaatgcatatattttcctgggggacaaatctaagttttcatctgatgctctgccttcagaggggaaccattccttaatgacctatttaattgtattatcattgttgtttaattcatcacatatttactgagcttcttttgttggtggtggtgccatcagacacagtggtccaggagctgcaatgcgttgctgatgaggatggtcacacatagctctgccctcatggagcgtcccagggtgaaatgagacctcccctgagaaccgactcccagggtaggggaaatcagtctgcaggcaaagaggaattcaaatttagcctgaagcacaggttttctgtgcttctaggcaccggctgcattccaaccgtagtgccataaaaatacaggaaggaagggaaacgtgttcacaggttggttagagatgtggaaaccaacaatcagctctctcttatccgtaagaaactagaatctactgctggcttcagtccctcagacctgctgctcaacagagtgccctttcaaacctgggttagactctgtgctaatggcttttttcatgaacctcagacagccggaaagtatattctttgaggattatgatcgactaggatgctcgggaatctttaaagagaagcactatcttggctatatttgccctcagttgttttaaggccagtgaggagactgagcatttcagaggtgaagcatttagaggatggcctctgaaagcatacggctcagtaaacaactgacccatcctttgtcaccgtttttgtccagcggctgtcaccataggggctcctctggtgtggaggagagagaattagaggcagcaggcctgggttctaggtctgcctcattgtgaaccagcttcaggaccttgggtgagtcacttttctgccctggcccctggcttcctcttctataaactgaaggtgttggcttagcaggattttaaagtttcttccaccttaaaaactctgattcctgcacttgcattcaaagaaatgactctattactcatttgaatagtttcagaatcactgtatagtcaactctggactagaaatgggggcctgcagttgaggacaggatggaaagaggtttggggttcagggtgggctgtgagggctaggattcttgattcctcatgatttgcaattggttgttggtgttaccatggaaggttctcaaccatggctgcttttaaaaattttgatgctcagaccacccctggagaccagtgaatttcaaatttctacaggccggcctggggaaatccatgttttttaactttcctaggtgattccggtatgtggccgggattgagaatcacagccatagatgcttatgtaaagctgtgttcagtgttacaggcatctgttctgggtggaaagtgatagtggttggtcaaaaaaaaagcgtgcacacacacacacacacacacacacacacacatacacagagaacagctctaggttctggaagtgtgttgatttggtcaccacaagtgctggtggtgagtagttgccctgaggtttggagttccagttccctcctatctctgggtcagtggtttctcaacatctttgaagtagtgaaaccatctgtagttggttatttctgctcagaaactcacagtacaaagtggggggtggtgcaggggggtggagctggaatggattaaacaggcccttacaaatgcccacacttttttcatgaaactaagttagaggccttagccaactccagcataccttagtgtcagttctttggcattgccccggtggattctaggggctgtgaaggctgtaggggtgtgtgttactccctgctgctttggtgagagagtgtccctgtctttggctgagagcatcctgtcctgccacttcatcagcagtagcatctaaacagcccttgaagggaatcagtatctacagcctaagaaatctgatgggacacatctctctgcattaaaatattaacagaaaaggtcaaactgggaaggggcagctaagttggaatatctcattcaggtaaagggatgggcttgtggatccttaattggtgtgaaatgcgccctaggaggggagactatatcagtgctgaaagcccttgagggctttcacagatgaagggggatggtatgagaagctttacaaataacaaggtttgagatgcagttgtagacacatgccagatgtaggttgctattttctcagctcaatgaggaatctgtcaaggcactcttagaaatggaaaatatagttcctgccctcaggaactatagtgtcacgtgatagcagtgaagaccttctatgtcctggccacacagtgaggatcagaagacagagcatggagagtggaatgggacacatggatcaaggaacgtggacctgagcaagcaaaagcaagtcactcgggtcccactatcacattgcatatcttctccttttttttttttttttctgagacggagtttcgctcttgttgcccaggctggagtgcagtggtgcgatctcagctcactacaacctccacctcccaggttcaagcgattctcgtgcctcagactcccaagtagctggtattacaggcgcctgccaccacacctggctaatttttagtagagatggggtttcactatgttggccagattggtcttgaactcctgacttcaggtgatctgcccacctcagcctcccagagtgctggggttacaggcatgagccacagcaccagcctcttctcctttctaacgtgatgtcagtgtctctgggaagcagccttagttggcacctcactggcagcaagaatgacttcatgttcttgctcccatgaaaattctctgctttcaggaatacactttcctctaggttttttctttgtctgcaagtgggggggtgttctttgccagatccctgctttgatgattaccatctgcccacctgagtttcctgcatagtttcagttggaaactcttttctctttggaccctaagataccgtgtaataggattgttcttggtttcagtaggcacctggcaccctctcagctgtggctgcatttcaggtatggatgggagtgattatctgtgcatcagaaaactcaagattgtcatgtgagcaagttgtgtgatcatcagtaaatgcagagctggctttgttaggccctggttgtggccaaggctttcctttcccggcgggtgattattccagatttcatggtcactagctgagtgtaatcaggagcagataagaaagccctgtatagagcaaagtatgcatttcttaaggtggtgggggaggtggcagaggcattatatagacgtgtgtgtttgtgcatgtgtttaaaaaaagacttatattttctgggcagcagaacttaagtttccagtaaacatctcctccctttttactttaccttttaattttgtgtttatggtctctgtgctttgaaattgtttttgctgtgatgccagccctgcctgaaatgggtggagcaagccaagccctttggaagccatggtttagatcagagttcttgtactgacatggcccagctgattgacagctcagatgtgatcactccgtctcaactagaagaataaaaataaaaaccttgagctggagcggagaggggtcacacatttgttagtttatcccctactctcacctttatcgcaggaggagtgataaagtgctgctgtgtgtaattctggtctggggttggttttctgtagtcccaaacctgggactaattctccctggagcccgtggcccagaagatgggtgcacagtagggttacttgatgctaaacggctttcccgatagacttgggatctcactgttcttgtcttagctttacttgttgggttggaggaggtgaggtgggtgggcaggggcctagggaagcccactatagaaacactgggacagagaatccagcccaggctaggtgagagcatctgccagtgtgaaaacacgtggaagcgggggaggcaggcgagaaaagctgtgggagaaaacctcacaaatgcagcaaagctgcccagggcccaagcggtggggcggtagcgagggaaacacagtggtgtttggctgctgcttcacaccacttttaattcagcgctgctaggaaggctatttcagaatgctcccgagtgggagggggcagctgctctagggtgggaaggggatgctaaggccgggtgcggtggctcacgcctgtaatcccagcactttgggagccgaggtgggcgaatcacgaggtcaggagttcgagaccagcccgaccaatatggtgaaaccctgcctctactaaaaatacaaaaatgagccaggtgtggtggcgggtgcctgtagtcccagctactcaggaggctgaggcaggagaatcacttgaacccaggaggcagaggttgcagtgagctgagatcacgccactgcacttgagcctgggcaacagagccagactctgtcttaaaaaaaagggggtgctggagagcatgtggggtggatagggctgactagagacctttgtcagggtgacctttctccagagagcccagtaggctcagaaggaaggtccctcagcaccctggcccacacagttccagggagaccccaaataaagcatttgcacaaacagtcctgagtggagcacacctagccgccttctcttgcaaagtgggcctttaaaaaaggggtgtatggctgcttagttctgaagaggccaggctaggagaccccagagggacacccagaaatcccagatatacctcctccatctgctctgcctgccagatgacccttgctactttactgttttttctttgagcctcttggtgatcttgaatagcagaaaaatgagccaaatttccttcaatctatgccagtcttcgtcctcagcctcccggtggggtgatgagtcacaccagtgggaaagtgcactgtatacttggtcatgtgcagagcaccttcccattggtttatctttacaactgccctgggtggagacatggcaaggtggtcctatccctattttgcaggtgatcaggcacaacttacagttagcgcaggaacagggactgaggccagccctcagttctttgacagagttctttgtctacactgtgttgcctcagaaaaaaatgcccatggggagtgtgtgtgcgtgggcatgtgtgctctcctcgtgtccctcagaaaagaatgaattcttttccaactgatgtcactgggaaagggggacaccactactttcctgcgtactgcactttacagtttacaaagcactttcccacacgtcatttcgtttcatctccctgacagtccctggaagtgggtgctagtctggatgagcaggcgcagacttggagaggctgagggacttggcccagggcatatagctaggaagcggccaggcagtaagtgggtagcaccactgcatgttgggggtggggaagcatgagctggatggagcattcggtggtctaaccagtggccagcagtagtgttggggtttgctgccctcacctctgaagccacacaggctcctgcttcctgaggtcaccctctcctggagggctgcccccgcatgggagtgtggacaagtgtgcacgagggggaggcacacccaggccgagtggaacaccaccctaagggggtggtgacaggtggcactgggagtggctggagtcggggttcaccttactcagggtcagggcttcccattttgcaggactgagaggtggactctgaaggaatgcagtgcttagaatcttggtgcctctcctggggtggtgggaagagcagggagtctcgagtccgattttgccaaaaatcccaactttcctgctgagtagctcatgagacaggcatttcacctctctgaacttcaacttgggggtactcagatttccttcagaggctgtgaaagagtcccctgccacaagttactcctctgttcagaagtgacttgactgatcatctagcccaaccccatcattgacagctgggggaaactgagctcctgagcggggcagtgacttgcgcaagtcatttgttgggaagaatggggcaggatgatgatgatgtccacttcttggggacgatggggcagggtggtaaacacttctcaatgcttgcttatgggctctgatgtgaaccactcactataggctgaatcctggttttccaagtgtttagaggctgagctgttgtcccctgggattttggaaggtagactcacatttcactgaaagccctagatgcttctccttactgcagttcccctccccagcactcccatctccctgttttctggggatttaaatcagctttgacttgggtctgaaagtaacccgtgacagcagtaagcctctcgatctgttgtttgcagtgtttcagctaaaatattataaacagaccaccaaactgtgtttggtccaaggccaagcccctccctccctacttgaacacttgattacctgctgcagggttgcgtcttgagctccgaggaggaaactgtttatttcagggctgttagagtgcagtgcaggaatccaggagaatttattgtattgttaccatctggtttcatggagtctgtttcttttgattttaattgtgccctctggagagaaagatcctcgaaatggtggaaaaagaagataccaccttcctccctgccctgcccatgccctggcacacacattgctatggtgcatggtgggcatggctgaaccaagtccccttattctttgaacatctttgcgtattattcctgctcccccagccgtctccaggccccagtctcctctggagggatttcccagatggcttccaggccagagcctgacaggagagataggacctgcctccacggtaacaaatggctgaaggcggtttggggtgttgccagtagcctgcccttccgcagtggctaaggatccggtgttgcggtgatacatgatgtgacctcttcaaccagtgagtcactcacccccagataaccacccggtactttcaggggaaaccgttgtatcattgtggctgtggccatggtttctccaaaataaggtgtttttagaaatgaaagtacagggattggtttccttagattcattgtcatggattcatagttccccaacctttttcacgtaaagactcacctctgtttcctcttaaattgtacatttggtgtctgttttatatattaataataactgacactcttctaaagttttttggggaaagaaaacataagtttaccaagctctcaattctagaaggtaatagccttctagaattgtccatttgcataagcatttttatgcttattgctgtaatcagtgtgtcagtcaaacgggaaggaggaactacatcaggtatttagcacaaagggaatttaatacgggaccttggttacacaggtgataaagcagctgagaagccacaatgggaaggtgaggtgacccagaacttggaggaagccgctgcctttaggctggagggacaaagggaacaggtggtgttcccagagcccagggttggggtcaccagtgggcctgtctagagcagttgcagctgcttctaaaattgccgacccaaggtagaaaaggagagaggggagaaacactgtggcctctccctccctcctacccactacttgctgtgagagcctcctattatttaaaccctgctggaggcctcctgatctggagcctggaaagtcagggctcagccccagggaggacacagcagagcacaggaagatgagggatggatcagagggcaaactggacttggaccagcacagggtgcaagcctgatgctctaattttatattttatcagcattttcttatatgtggctttcataattacacatattttatcaagtagatgaaccgcatttaaccattccccagctgttaggtgaacactttaaattactataaatcagcagttctcaaagtgtggccctgggccagcagcgtcagcatcaccagggaacttactaggaatgcagagtctcaggccccgcccccaggcctcttggatcagaaaccctgagggcggtcccagcagtctgaattttgtacactctccgagggctgctgatgtgcatttgagcttgacaatcatgattataggcaatgatgcaccgtgtggaagctgggggcaggatactgaggagggtgctgggggtaggagtggtggagggagtttgtccaggggaatgtggtgtagcggaaaaggcacaggactggtagggctgtgcccctttaggcccaagcctgcccttgctcttaacctcttaatgggtttcttctttcttctgttaaacagctaaaaatatcaaatcatggggttgctgtgacggttaaatgtaataacaggcacgatgttccatatatgttgggtcttctggagctttggggaaggaggtgtggcaataacagccagcttctgcatcatggaaaatggcccccatgcccatccctgagttgtgtggtctgaaaatcaatgatgaacacttaggaggcttgtagcctgctttgagtcaacaggaagactggacttgagagtttggaatctatagtctaacttcccttcctcaccctgtctttgtaaatggtgctcatctaaccctacagttactatcttttcactcatgtctagccacttgttagaggggaaggaaccctggtgtcaggacaggactcctggctccctgagcttgctgtgtattccggggcatatccttaacctctctgagatgtacttttcttatctgtaaaacctctatgttgatgcaaatcaggtgcgatgatggacgcaaaaactgccttgaacaccttagcgggcctgtgaatataaagccttcaggatccacacctctgccagggcccacaccagcctcgccacctcggtgagcctctcattccactgccagtgcaggggtgcataatcaggatttgccagtggaggtaggaagggtggctggattgtgactgtcacgctcctggcatcagatgatactggtagcaagctagggtcgtctgtgcactttgctctctctcagtcttcccagcagccctgtcaagcggggagtctagcaagaagtggccaaggcgcagatcatttaagaggaaggatgtgagcaaactggatcccaaggggacagacagaggcccactttgcctcagagtccagagagctgctgctgctaagaagggaaagaggaactgggtcggggtgcctgctgacttgcagcgctgtgttggcatgcgaggtagcactggttgggaggcggttacctgaaggaagcaaaggcagctggtggttcctatcttcttgcctctggcagcacctaaaagaagcctcttgggccaatgagaggatggactgtcccccacctgcagagttctgtgaagtggtgcggacgtctttgttgatctcatttggtgcctccccctgttgatggctgaggaagccaaggctctgagaaggcacatggtttacccgaggggacacaggcaaggaatctgaacccggattgcattttctgttttagggctctttgtgtgaccacggtgcttcccaggcccacacttccagtgttccaggcccttgaccaccaatcctgtggaggggtcctcagggcaggcagtgggaccacctgaggcctgcgtggggtggcctgtggtgtgagggacccaggaagtcagcctgcacctcggcgagtcagaagatgtggccatccaccaaccatcagatgttcccctacgcttagggctgtgaccagaagtggcatcaagatgggaggcgaagcttctgggaccagagaaccagctgctcctgttcatcctgcttttgggtgaatagctgatgctctgggcccctcatcccaccatcccaccccgtggctcctcctgagcagggctgagggcatttacctggctgccttctaaagcagacttggcacgagacaatcttattcaaactctgctcaaaattgctaccctgaggagagggctgtgaccaggcaggacggggtgtgataacatggaacgcagggcctgctggagcaggccctgatgagtgtaaataactgtgttagaggcaggacctgagcttttcactccataaatatatattacttctaatgtggccagggccgagctgaagatcataattatgtgagatctgctttacaggcatttagggaaatgcgtggggctgcactgatgtaggcaaagatgtggccacatacatttaacgtgtctcagaggagcctttgctttaaccctttaatcagacccttccagggtgctcctgacttgatgttccagagcgtttggagtcaagagttgcactcttttttcttgcattaaatgcacttgagttttaacccagtctctgggcggatggcagggctgcatgagggggtctccgtggatgtggataagtccagagaagtcagctgagctgactgggcaggtcttgggtaagtcacgccacttccctgagcctcagtttctccagcagtaaaatgttacctgtctgttagggttgtaagattgagtcaacatatgtacaaggcattgcttagtgtttaccaccttgctgtgagctggtaaatggttggttggtcccttcctctccccttggtgttaagcatatcaaaagatggctgcgtgctcacctcccctgctttactgggtggacaaaggagctgtcacacagtgtggcagccttagaaaggttaaagaaggccagtgaagtcttctggctcatctggtcctgaggtgggtgagcattaaacccagatcctttttgtgtttcagtattggatcctttggccgtcatatctgagacccagggcctcagagtgtggggtcctaacctaatttggctttgggtgaactggccagcaaatggaaggatggctgtggaagtgtgtcttgagcctgtccttacacaggtgtggctgtcatcaaggccatcttcatgggcacgtgacgagtacagtcacatagagttcatgctcaggagggccctatgcttggtttaatgctctgctgtcaccagcttgaaatcctttttttttttgttattgttgcccaagctggagtgcaatggctcaatatcggctctctgtaacctctgcctgcgggttcaagtgattctcctgcttcagcctcccgagtagctgggattacaggcacctgccaccacacccagctaatttttgtatttcttttagtagacgtggggtttcaccatgttggcgaggctggtctcgaactcctgacctcaggtgatccagccttgggctcccaaagtgctgggattacaggtgtaaaccactgcatccggcccatcttgaaattcttaataattttctctttgacctagtgttttggagcatgagcatggatagaggagatgtgggcagcatgtgcccattgagccttctgccccattcacatgtagcatttgagcacagacttctgccggacctacaatgtgggggagttgagtgagagtcaaagtgagtgtgagatgtcacatctgcgactgagtagcaggggccctgacagtcctgatgctttccatctaactggaacttgtcttggttgtagaaagaaggcgatgacattctaagaaacatcaacgaccaaagaaccccatcatatcctttattactcacgtcacttccctgacaccaaccacttatattgaaaatgatgacggaagaagggaaaggaaagatagggcacccatattgccttttcctttcagatcttccttactcctcaggcagcataaagagtgaggtagaatggacacatagcgagaagtgaagtaaaaacgattgagttagctttatggatgtttctctggttctggtacatcacaaaatgcacatccaagtcctaaaatacaattcatgtaatgttggtgattccacatactagttaaaggctttttatatttgcagttaaaactggcatcacacaatataaataggagtggtaaaattcatgctaattcatgtaatttaaaattttaatgttgctttacttagaataatattaaatagcaaattaaaaataccatgacacatcaagagagagactgtggaggaaagagaaaaagctttctattttagtaccatgattgatactttttttttttttgccttttgcacaaagggttccatattttcattttgcactgggccccacaaattatgcagccaaccctgactggcatcctggggctggaggtctcaggctggtcttgcacgtgcagcctctagatccctggtctgctcacattgtctcctgggttgcggagctaagaagcatcatataggcaagtgagcatgtgtgcttgctctgaagattccaagcttccaggtggtggtggctctgttgatagagataaaaagttgaggaatttcagaggctacaaacatactcttgttgaaggtgctttgggggtctcctgagcatttacttttgtgaatttttgggcagcctagtatagaggtgatccagcagtaagctgagagagaggccctagtttgactcttaactcaggcatggtctccttgggtgagtcatttcttcatcaggcagtcctcagtcttttggttgcagtgtagttgttaaaaatgtgggtacttggaggctgaattcttgggtcaaatcttatctccatctctctgtcctttttttgtggttttttttgtttgtttgttttttgtttttgtaggggacaggttcttcctccaccactcaggctggaaggcagtggtatgatattggcacactgcagccttgacctcccagctcaagcgatcttcccacctcagcctcctgagtagcttgggactacaggcacacatctctatgctgggctaattttcatgttttttttgttgttgttttttgttgttgttttttgtagaaacagagtttcactatgttgccccaggctagtctcaaacttgtgagctcaggctatctgcctgcctcagcctcccaaagtgccgggattacaggtgtgagccactgcgcccggccttatctccatctcttaactagttgtttgatgttgggcaggttgttcaagcctcctggagccttggtttacccatctataaaatgggtataatggtaattatcttatagcatggtcatgagcgtgaaatgagagcagggggaggagtaatcattgtgtctggtccatgggactgaatcaatgctagcaatggtcatgatggtgaagaatgaggggaggaggaagaaacaattcctgtgggtgctaggaccaaaagtagtatcctctaggaatcctggccttcaaggtctaacttccaagattctgtgagtacgattctagggagcctctgcctcagacttctaagtagttcttcaggctgtgctctagaagttactggaatgaaagaaaaattgtagtgtttgaaggtcttcaaggatcctggtcctctcacactgtcactcttagtcacatgacctttgactgtccattccctactaagccttggtttacgcatctgtcaaatggagcattcgtgggtgtgcctgccttagaggatgagacccagctgagatgacatatggagaaatcgtttataaacttaagtactggtgttaggaagagctaacacggtgagtcttcagtgtttctttaagtgctgctcactactgtcctgagagactccaagaagcagttactttgtttgggcctcagttcatcatctgtgagatgagaggattgggctttgtgcctaaactgcccccccaccccaccacccaagacagattaaaaaagaaggaaggagggagggagggagggagggagggagagagcgagcgagcaagcaagcaagcaagccagcaggatttggaatcgtcccctaattggaaccacaatcgcaggtttcagggactcaggaaagggtgcagcccagcttgtggttgagaaatgaatgtcagatgttaggaagaaaaaggcctatctcaacatagcaggggtttcttactgcccctgcctcctcagccccggtagcctgtcactccctggcgaacagcttggcagcacagaggcaaaccacagagtacatttgaggcccagatctgcttatttcgagggtggggccgcgtttttctcctgccacagtgagctaattaaagaaaacaagcttcgggagttgggagagaactgtccacaggacacttggggaggcttgctttggttgtggaggcctccacagcccccggaaggcaggtggaagtgggcatggagggtcctacgcatccccagcgggggtctgagggcccactgttgctcagctgggggatttggggacggtgggagggcatacatggatgggagggtggactccgttcctgagggggccagtgtggaggagggtcaggcagcccatggagatgggacagtgttctgaaatgcttcacaaatgtggacttttgccccaaactgtggacagagcgtatgtcctgagcgaggatcaactctgtgagtacccatgataattctcctttctgtggttgccgccctgttgattcatgtgtcagccttagagaaagtggctgtgacttctgcattcctgggaatacactgacatgagaagaagtagccgctcttgttcacagtcacagggctggaaagtgggataaggactaaggacttctgtctctggattcagcatgctgattatggggaaaagcagacatcaattcctcatgtcttgtaagcatcactgtcctccaaagttggagcccagctcagacagctgcatagtattttatagagaaggtgtgttgttgaaatgttgattatgcaaattgaattgtgttttaagactactgggaaaaccatttaaaggaatcctgttgtaagtcattttgaaaaatggagaattacaccacctccccaaggattttctgttttggtaaatttcatgtggcaagattacttgaagaagggttccagtgttttgctagcttataatggttactgcataaggaaggtttactcgccagaggtccgcatacattggagaactgggggaatatgtaatacttgtgcagaaatgttttgattcatgtactcagaagatgggatctggatgacacctccagcctattgattcccaagtaaggtgtgatgacaccaccaccagcgaggtgtgctatgaggaatttttgttgatgatgaaaagtgaatgctaactgattgcacaccacgtgccccataccttacatagattatcttatttaattgttgctaataatagtactacagtctgtgaatgatttacttagcaattaattcaaaagcatattccactctacaatggaatattttttgagccaagaaatgaagtacgtggccgggcgcagtggcttgcgcctgtaatcccagcactttgggagaccaaggtgggtgggtcatttgaggtcaggagttcaagaccatcctgaccaacatggtgaaaccccatctctactaaaaatacaaaattagccgggcatggtgccacatgcctgtaatcccagctacttgggaggctgaggcaggagaattgcttgaacccaggaggcagaggttgcagtgagccgagatcgcacccttgcactccagcctgggcaacaagagcgaaactccatctaaaaaaaaaaaaaaaaaaaaggaatgaagtatgtgccacaacatgggtgaatcttgaaaacattgtgctgagttgaagaattcagacatcaaaagccacatatcacatgattccattcccatgcagtatccccataggcaaattcacagagacagaaagcagattagtagttgccagggatggaggagaggggaatggggagtgactgcttcatggatacagggtttccttgagggatgttctggaacaaaatagttgcggtggttgtacaatattgtgaatgaactcaatgccaccaaattatacacattaaaatggctaacatggtagatttttgctgcatgtattaatatattaatgtattaataaatgtattaattacaatattaatatattgtgatatactgtgatatattgtgataaatatatcaatatattgtgataaacatataaattgattttaatatatattaaaatcaaatgtattcctctaatggtgtccatgtcactgacttagtttctgataggtttgtattgggtaggaaagaaaggaatgggacatttacgtgtacactgaggcagaagaaagaatgggactttccaatccaggctctacctttatgaggaaccagagacccagagagtgctagtgacttgctcaagggcacagagcagcgtaccagagttgagctttggcttctagcctcctcactttctattggggaagtcacagtggaaaagggggttttggctcctttatgtctttgggtatgttctgggtcactgaggatcagctctattccacctggcattttgtgctttccatgggtgctcaggaaactgtctgtctcaccctgaggtgaggctcaggaggctctggggctttgtagtagaaatagaaatatcccaagtcctgggttgtgtccttgtggatgtgtctagaacaattcctgttgtgctactcgctttgggcagttagcgaaagggactaattgtgtgcaaatacatacgtttggtgtttgttgggagacttgccatgtgacactgcttcttcttttcttctctttttgactatgaacacctgacactacaggaaataagaaactttccagtacctaatttatgcttactctactttcaaaccctgttggccccagcacagggtaaatgaaactgtagcttatagtaatatttacgtatgggagtcaatgagctgtttaaatacttggatgtcagaaaaaggtttcaaatttagcaagccccctgactctcccaccctctggcatgtactgggtaggcctgcctgctctctgaggtcgagctcttgtatcctgtcctggtcggtgccagtatagcaatgatgatgacagtgatgatgatgccactggaacaggctgagctgtaattgaattaaatatctgtgtaatccctaggagaagctgaataaggtttgaggatcttggaagttcagttatactctcagtaactgaggtgagatccgtaggcaaggaatgacaagatcgagattgattagctacatgaccttaggaaagtgacctaaaggttgttcacattcagagtcctcatctttgaatgtgaatgatatttctggcctctcctatcttatggagttggtgtaagcatctgcatgagatgatggacgttaaagtgctttgttagctgttgagactcttactgaaatgaaacccaaggatgggtgccactgaaagaaacaagaatgaatgcaaactagtttgtgttgggagttgtacttgacacagctgaatttgcctttgtctttaggagagccttagctgtgggaagcagggcttggaatgcgctgatatttatttcttccatcaaatcggattatgaggcacctgatctgtttaaggctgtgtgagtagaaccaggtcctgccttccggaagttcatggttaaattgtgttttcatgggtcacctggaaggcgagcttgttcagaatgaggataattgacccagtgaatccttcctgcctcgaggcccaccatgttattcagatcagtcttgggggaaatgctgtgaaagtgtgtgtgtgtgtgtgtgtgcggtgtgtgtgtgcatgctcgcgtgcatgagtttgtgttgagagaaagaaaaaagccaggagagtaggatgagtcagatttaaccactgttttttcccttttgaaacttgttatgttcatacacatacagcagtcatgcacttgctcagaaatgtgtgaaaaccacttaaaatgtgtgaaatgcagccctttagaaagtgtgccttccaccacattcttttgagcagtggagtggatttgtgagtgttcatatctgtcctcatctgtgggaattgtatgtccaaggtgctaattcagggccatactgggatgacctgtgtgtatagacttgtcctgggtgagatgggagcaagaccatccaatgtatgatggggaattctgttaaacaggtagaattctgaacctcttggtggtcctggctggtcagttgcagggagtgacgttgaatggactgggaagatctggatataccatgtttctgtaggcatgatacgtggtcccttagcttggtatttaaagttctttggaagtgaccgctttctggatttacctctgtgcagcccctctgctcctcccaggtgaggctcatcatagctcctcttcaatgtgctttgtccacaactgctgccatgttttagctccccattacgtttcctgggatgctctcctagactcctctgtacctttcttctttcaaacccaaaacaggtcccatctccttagtcttaactgtctatgaatggtctgttgcctcacttcccagctctggtatgtagtacgtgctcagtacacatttttgaatgcattaatttggctcttttctgtgaaggcagcttgtctgtgtgtcattcatctgcccaaatttgattgtcaacttcctttgtatggagctgtactgttctttttgttgtttttcttaactccttgcccctgcctcccatcaccccagtggaagagttatagtcaaggtagtgtagtcaaggtcgtgcaaaagctacacacttgaacctgttccgtgtggtttcacacaaggcacatggcctccttgggactcacttcacatcactcgacaaggggatagcaggacccaccttgactgtattgaagactgcatgatgatcaggagagagtgagggatgagaaagagtttggaaaacagcagaacacgatgcaaacatgagttattcatggttttgtgtccaggctaactgtgccctgacattaaggctgggtgggtctggcccagggcttctggggtaggcgctgtgctggtgtgtgctactgacctggagtccaggatccctgagtcccactcaccctccctgggctgcagtttcctcagcccagctaccctttccagctgtgactgctggttgtggagctgaatgtgtgtggggtgtgggcctgtgtgtggactccccacccctgtgcggttttcctaagcacatagcacaacaaggagctggaacagagctgcaacaatgaggagggtttcctccaactgtcagtgcttctggatccaccgtttcggctttgacattaccgtgagtgaccaccctggacctctttctttgtgccaaactcgttgctggattgccataaacacttacttggattgattagagaggctatttgccgtattgaaggtggcagaattatttcaccttttccagaggtgttgacgttcaagggtagttggtggtgactgtacagaagggagacaggaagcctggaggaaggaaaggggtgcgtagccgagaaagtgcacaacgggccctatttttaaaagtgcctgcctctgctggttttgttgtggcagcgctcaaaggcaggaagacagataagatcggatttcaggattttcgtctgccccccatctccgcccccaacttttgacaaccaagaacttttccccaccaggagtgggtatatttcaacttctgtaatccctgcgtctcgcacaatgcttggtattacaaggtgctcactgagtgtttgaatgaatgaatgccttcccagttctcatcacagctatagggtgtcactgtatacatcaagtcatggttagccgcaggtttgatcggggaagagacactaatcaatgtatctgattctagaagaagatggagcttctaggaagggcctgccctcaggctgtcctctgtgttccccggcattctgcattttgcagtcacccctcattatccctgagtccaggaacacctgagattggaaaggattccagccccatagggcctttatcgtggcccccagtaagtgataaatattcgtactaatttggggcagtgtcctttttccagctgttttcccatgagtgccctctgttccgtcaggtggccgaagacggataactttggcaaagggcttggcacaaatggccaagtttacactggatcactatactccgtgttatcttgtttccccgatggtcattgccacacaagaaagtacttcctctgtgggctttgcccaccctcttctcttgacagagacctctgggcctagataaatgtataaactgcattgcaggaatgaagccgtttccattaagaactggggtctatgtcctgggatccagttcttctcccccttttagtactgaaagctgcttcccatctgaaagctgtctggggacagacaccgtgcagctgcgtgcagacttctttcagagtttgatcttgcaggcttcccagtggctctgctcttccttgtctgcttcctgggggtctctcagtatcaaagccacctgtggctccatctcacctccctgaacaggaggcactgtttgtcaggaggccttgccacctttggccctttctttccaaagaaagatccctggcctggagtttttgtctcagctctgttgtgtgaccttaggcaagtcagttgacttctctgagcctcagtttactccttagtaaacaaaaaggttggatgaggcgctctccaaagttcttgccctctgtgtccttcctctgcgttctacagggagggagtagctgcctctgtttggtggtggggactcaggcaggatgggtagggaggggtaggggaacaagatcatggcgcacctccacggccacagtggaaaccttgaaccttgagctgtatgcggtgagtccaggatgctgagaagatgccgggctgttgggtaagcagagcccctacgggaagcaaagagtattattcagccctgtggaatgctgaggcagggctgagcttgggcagggtggctgagagaattgtggctctagctgtgggcagaaattcatggccttgaagaatggctactgtatataccagtgataaatattagtcactctggcagcagaatgagtttcctgtgctgcatttttggcacttccagaaaagggaaagcctttctctctgacagggcacaggagggagaaacaggaatgtgtctcttaccctgatgccctggctggagatcccgtggggttttcaacctgcctgaagcaacgcagggcctgctaatgcctcctgttgccctaggtcaggccagggcccattgttgacatctgtgctgtgctgcctctgaaggtcttgcttgagcatgtcctgaatggaaggcttcatctgcattcattccccggccctccctgccgtctgcacagcctcctccaggcctccccttcccagtgaaaagcaccaccatccagacctcaggaagcaatcattttagcctcttctccttctccctcaccatccaggacatcactgagccctgtcagttctgcccccagaatatctaagttcatccaatgccccatttccactgctgcttcctcacccaaatcaggatgtttctggccccgtctccctcctacctggtctccctgcctgtaccctcctctccactgggcccattctccaccggcagccagcatgatctctaagaaatgtacatctgtcatctgtcatatctgctgaaaattgttcagggcttcctgctgccttgagaatgagggtctgaatcccaaacaagggttcaaatctcaacctctcaggcctaccctgaccttacgtatctttcctcagggcctgtgcacatgctgttccttcttcctggaatgcttgtccccatagttttcagctggcgaatgtgagtcaggtctccccttaaatgtcatctaagagagccctttctaattcctccccttcatcttaactctatccccaatacactctctcacagagactgttcttttccttctgagaccctactccagcttgtagttctaaatctgtgattatgcactgtctgtcttcctcttgaggtcaggggccatttcttttgttctctgctatgctcaggacccagatcaaaggagctcagtaactatttacaggcgtacatcatatgtggaggacacttatgctgtgatggccccacacacagcttcctttggggtctgtcccctgctctccgttacccgcgtggtagccactgagcactggctcttcctggcttcactctctggcatcaaaacttatcagtcctacatctcagtcttttgcaaggtgacacttatctgattacctaattcacacgaaggtgttaatggtggtaatggcatagtatttattaccccaggggacccagaacggtggtatcaaaacatatcattccccagtggtttaaaactctggtagctttccagggagtccaagtggagtccagtctccttagctgagttcacagggccccgtctgcacgacttggcttctgtcggcttccctagccctgacttcccaagccttagtcatcaccctctctcccacccagggctcagcacagtacctggaacagtcaagccctcaataaatgtttactgagtgcattaaaaaaaaaaaaaagattttaatgagtcatgctttaactgaagattttagtgtagtcagtcattgggccttggatgccaaaggaatgacaaatggtgggaatttcaggcacagtgactgtgatagccccaaggaaaccaagagagaagtagctttatctgggtggaggggagtgggcctttcagagcctcgaaatcttcccacctgctgcgccactcccaccacataagcaccccacccttcttcccagggtgagatttctcagctctgctttctggggtgccagacaaggggagagccttgttgccatgccctcctgccctcctgccctcctgatgcagtctgtggtcacctgcaggcagagacagatgaagtccgtcattcggctgcgagtaatttctgatgggagaggggcttcccccggcccttcccgcctctctgagccttgccacggtcacttggtttgcccagcctaagtcactgcctgtcgctgtggttattgcatggacagggcctccctctgtccctccacttcccttccctgccccatactgttgccctcacccaccccaaagcctcacccttcccttccatagggatatggcctgatagaggaggagccatttgattttgactattgttgaaattgagtggggaattttgggtttgttttaggttttggaagggaggattatctgaggcttgaggcttctgtgatactgacatctggtgtggaaagtcatcctccctcacctaggtgactgggcctccaggtcatctccccgagcagcctccctggatctgctctcctctcccccccacccccccaccacctcccgcgctgtgcccagggtgatctttctaaaggacagatcttgcttcagcacctccctggttagaacccttccgtccagtggttcctagtgcttcggggataactcgccttgtcccttggggtctgcacagcgtcctccatctcctctcacttggccttgccctcgggggctccggtaagaagctttccaacctggcagctgcagactctgtgcggttgtattattgctgtaaatgggcagggattacgcatttgtggagtgactgatttcaagtacaactgccaccatgggagaggtctgtgaaaatcactggaattgaaaatgaccatgctttgcccaaaaaggttgagaatccccactctgatgatactagaagcctgcttgcctccccaccctgtgccaagccatttcttgcctccttgctttgcccataccagcctggaatgtcccaagcctattcaacttacttcctccaaaacgtagtcccatcttgatctccaggaagcagccttcagatgccccctcctcctggccactgcaaatgtgtccccccagctgctgagcatgcctaggtctgacacacaccacgatatgttgaaatcattggtttctgggttattcttctcacagtcccaggcagtgagccctcaaggacaggggctccatgggactggtctctgggtcggaggccaggacccaggtcactaagggcatgtcactcatctggaccacagctccctgccttgtggtgtggactctgttctctgcactgggctcgttctaaaacggagcatttggtccttgcagcctgccttgtggtttatgacttagtagattgaaaatgacagttgtgctctattttcatttggaaagaaaaaaaaaagtggaaaaccagagattgcactgatctggaggtagagagaaaactgtggagatcaaagaagatattatgtattatgaatgttacacagatcaaggcatgtttgaaataggcttaattttcctcaagttggcttttgtctcacaattgagttcttgttgacgaagaccagttattattcgtcttcgtgtctctggagtctagcacctagcacggtgcctgataaagcatggtcacttcacaaatacttgtcgaagaatgcatgggatgaatatgcatttgggtatttttaatgcttgatgattagaacattctcatggcttgttaacttgtaagacataattttcattgtaagttctttgtgtgtgcaaatgctttttgtgtggaatgcttgccatgcactgaaaaatgctttgtgatagcagttttgaaaaattgagtcattttgccctgattgaagctgggtgaccttgtgcaagtcactttaaccctctgggacttgtggccctcatctgtaaaatgggtagaaggtcagagtggacctcgtggcctgagaggctagtaccccatgctgcatgtaagtcttacatcctcctctttggtgattggatactgaccctctccccaggggttcctgcacagagctggaattctctctggtgtctttgcattctagtgggtggaatgccttgtttctcagtagcaatgagaaatgttaatgtgaggttatgaaagcaagccaagagccatggaataattaaaacacacacgcacacaaagaaggaaaagcgagagggggaaacacacttaatggacaagggatgagtaaaacccaatggactgagaaaaccccagagctgaacttcacatgaccccgcgtgctgcctgcagttgcgacacccgcgtgccccttacgctccgccggcctctcagtgatgtcagtgggccatgggccccacaggaagcaggggctgccatcagcctggtggagcgtgccagcccgctcctcctccacggcccacttcccacccacccgggtctccagataacatgaagccatagctcccaggctcgtcagcgggggaaaccaactcagtgcttctcagaaaatagaaccccagcccattagtgatgtccacgcaggcaagagatgaccaagaagaatgtttgccttttaggagttctctgcctgaaaccagcaggtttcctttagggatagggtgactgtgcttgctgaacacctctaggtcgtcagtgaatgaaataattcattctgtgcttgagtgtctaagacccagggggtttaggaataattaggatactggctgtacccttggagttctgtgctgcttgggggatacgactcaaactcacagacatctgtggctcaaatcaaggcatatagatgcagtgactcttggaacattcgagggagaatcaccacctctgctggtggaggaaaggccaggaactgcccacctagttttcccatgaccccagcctgtagcgggatatgtcagaagatttggatttagaggaacttgggtttgacaaaatagaagtgtatgtatataaacagagttgggagtgatgggggataggatgctgacagcaccttggtagtccctccccctacgtgacagtattgacttcatagtgttgttgtgaggcttgaagaagatacaagagggaagaggagcgttccttgccgtgcagatgcaaatgctcattgttacttgttctgcctctctgtgtctgtgacatccagccctgtgtgggctaccctggttgcaaagtgggcctcctgccgttgagcagctatggtccagtgggcaggtacaccacagtcatggaagcctagttaaatcattacataatagttagctctgtatgaccaatcttttctttaaagaaattcttccttttggaataatcgtagatacacagaaaaactgtacacagataatacagaaagttccagtgtacccctgacccagatgtccgtaatgttaacatcttgtattaccatggtacacatgtcaaaactcagaaacaacattggtacattactagtaacacaagtccagactttattcagtaaaccttttgaaaaataatagctttattggcatataattcatacaccataaatctgctcttttaagggatatgatttagtggtttttagtgtattaatggagttgtacaaccatcatcactatctaattttagaacattttcaacaccacaaaaagaaacctcatacccattaacagtcacttcctgcccatcccccttagccctggcaacttagtctactttctggttctctggatttgcctcttttggacatttcatgtagatgaaatcatacaatttgtggacttttgtgtttgacttctttcacttaacatattttcagggttcatccatttgtagcatgtgtcagtacttcattcctttttatggccaaatagtattccagtgtatggatataccacattttgtttgtcctttcttcagttgatagacatttgggttgttttcacttcttggctattgtaaataatgctgctacgaatatttgtgtacaagctttttttgtggaaatgtgttttcatttatcttgagtagatacctagaagtagaattatggggtcatttggtagctttgtttacctttttgagaaactgccaaattgttttccaaagtggttgtgtggttgtaccattttacagtctcaccaccaatgtatgagggttccagttctccccatccttgtcaacacttgttattgtctgttttattttagccattctagtggatgtgaggtggtatctcattatagttttgatttgcatttccctattggctaatgatattgatcatctctccttgtgctttttggcatttgtgttttttgtttgtttgtttttgagattgagtcttgctgggatgtccaggctggagtgcaatggtgccatctcggctcactgcagcctctgcttcctgggttcaagtgattctcctgcctcagcctcctgagtcactgggattacgggtgtgtgccaccacacctggctaatttttgtatttttagtagagacagggtttcaccatgatggccaggttggtcttgaactcctgacctcagatgatccacctgcctcagcctcccaaagtgttgggattacgggcatagccaccgcacctggccttccatttgtatatcttgtttggaggaacatctacaaatcctttagccatttctttttttttctttccttttttttttttgagacagagttttgctcttgttgcccaggctggagtgcaatggcgccatctcagctcactgcaacctccgccacctaggttcaagcaattctcctgccttagcctcccaagtagctgggattacaggcgcccgccaccactcctggctaattttttgtatttttttttttttttagtagagatgaggtttcaccgtgttggtcaagctggtcttgaactcctgacctcaggtgatccacacgccttggcctcccaaagtgctgggatgataggcgtgagccaccacacccggctagccatttctaattgggttgtctttctactgttgaattataagagttccttatatattctggatataaattcctttatcagatacatggtttgcaaatattttcttccattttatttctttcaattctgtgggttgttttttcactctcttgatggtgttttttgaagcacaaaagtttttaattctgatgaagctaaatttgttttactttcgtcacttttgctttttgtgttgtatctaagaaactgttgcttaatccagggtcacaaaaatttactcccttgcattcttctaagagttttataattttagctcttatatttaggtctttgatccatcttgacctgatttttgtataagatgtgaggtaggggttcaacttcattcttttgcatgtgaatatccagatgtccatgcactgtttgttgagaagaatgtgctttccccagtgaattgtcttggcacccttgtagaaaatcatttgactgtaaatgtaaaggtttctttttggactcttaagattctcttttattgatccatacatctatcctcatgacagtcttgactactatagctttgtagtattaatcaacttttaaaatatatatatatgtgtatatatatatatatatatttttttgagacagagtcttgctctgtcacccaggctggagtgcagtagtgcgatcttggctcactgcaaactctgcctcccgggttcacgtcattctcctgcctcagcagcctcccgagtagctgggactacaggcgcctgccaccacgcccggccaattttttttttgtatttttagtagagacgaggtttcaccgtgttagccaggatggtctcgatctcttgacctcgtgatccacccatgtgggcctcccaaagtgctgggattacaggcataagccactgcgcccggccttaaaatatatttttcaaaatctacattgttcaaaaaaagaatctgtggtaactctcagaaatccaataattacaatagtaaatacaagtaaagatagacaaggaaattaggggagaagacaagaaaataggaaaataagatgacataagagttaatgttagtacaacaactaatatgttgtaaggtttgtgagattgttggaagtagcctgcacatttggccttgagctttctagcagccaagggtaaaatggaaatgtgactaatgacaagattaacacagatgtctgaaagattgtttaaaaaaatgtccccacctccaatattttcagggactgaaatataagcatatttctcccatagatcctaggaacctgagcttctcacgcacaggatcatttcatttgtgttagttctttccctttagacgaatagctctttgaggacagtaactgtgtcttatttccctcacatctccctgtagtgcttaggacaaagcatgggagatgcttacaaaatcttgattgaattctttttcaaattgggaatgtttattacattctttggcagcatttctgccaccaggttgaggttagttgggaccaatttggcggtggagaagtggcaggggctgccctcctggatgcattttagaagtgttttcttgcatcatgcttcctgagtgctggctaagcagtggaaacattgggcaggtggggttgtgtgcccttgccctgagagatggccgtcactttggagtgaaggtaagcagcattgcttcactcatgtggaacccacccgccttcccacctcctcagcgctggagggtcctctctctcgcccactccctctgacatgcctctgagactgcctgcccgatggaaatatccagcatgtatgagggaggtcctggccaaaactgaacagcttctcatggaattgggcccctcatcacctacggttatgtgtggcgcacagatggccactctgcaaagaggcccacccagatagctccctcaccgggggcaaggaacaagccaccttcaactgattacatgtcatattgggtggacctcttcgtcccacacccaataaagggctttaccatttttcagtagcatcctttcttaagagaaacaaaaaatagatttgaataccagtctttaaaggggtagttgtcattacttcgcagttgacagatggggaaatggaggttcagggtgcgttacctgcctgctctaagtcatatggtgagtgggttgcgaagacctgactccaacccagagaatcttgactttgacttcatcctcccctccttccacctgccagtacccagtctttatctaaatttagggggcttgagaggccattctttctattttgggtaccttcaaacaggtaagcacagttttctttgaagttacctctgcctccatgtgggagagtatcaacaaacagttcccccttccccctccaaaagcactctctgcacagtcacccctaggccaggagcagccttgtaatatgccacacatgttgttactgcctgtggcttttcacacctcctgtctcaaatattggagcttttttggctacagccctgtgatgaaggcagtgtgggtgctgttgaccctatcttacccatatggacactacatcatctagggtcaccctgttggttgggatctggagtaagcccagaggccaggattctgacttctggtccagtgctctgccctaggccttgagcaaatgtgtatcaagttgcactgacaatctttgaattcctggaactcatgccatgagcacttccaggagcaccttagtgcttcattacaaagatgatgagacgtaggaaagtctttttttttttcccacggaagcagaatctcacccacacccgcagattttgttgtgtcccttcagcactgagctgtgttctcagaacagaacaggtagaatagagtcaaaatgcaaacagaatggcctccctccacagtctgctttgatggaaatgtgatgccaagcaaacagaaaagttgttttggctccatctctgaggtcatttagttgctatttccatctactttgaatccacatctgctgtgtgctcagagccgtgctggttgccaaagaatccaacaagaaaaaggcatggccccctttggggcgcttgggtcctctcgcagtgccccaagcccaggtgagagacatgccctctgggccgtgattccctcatcagtaaagcaaggaagataatgtctggttaaccaccctcctggagtcatggcaaggctgatacagattcagtggcattaactcatttgttcattcagcacattttactggcaacttatgctgtgctgggctctggatatagtagtgagcaaagaggaagcactcacaagggtaacactgcaaatgctaggagtcatgcatgagaagtccagggagcctgattccatttgagcaaggggtggtggtctgggaaggttcccccaaggaaaagacataggagccaagaccaaagggtgggtaggagtaatcagaagagcatgtctctcatctctggacttctgtagagagacttctgtaaccactgtaccctctggaagtgggtacagaagtccagagatgagagagatgtttaacaacagagagaaatccacccgaaggactttttacatctctctaacatctcctgttcagtttatctcagctggcctttgctgagcaccagttagttgccttgtgcatccttgggtgatggattatggagatggcagtggttgacactgtctgagagcagctcccagataaaccagcgcactgtggttgatgggctgcctccaggtagagagtgaggccctccaagcacatcctggccatccacatcttcacatttgcagtgcctagcacacagtggacaaaagggatatactggacacgttgtcctaggatgcagattcctaccaggccttcaaggcttgtagaaatcttccctaaaactgatcatgtggcctccggtaaggaatctaagcttttgaatcttggatccatctcgggcacagggataacggtggcgcccatctcacggggtgtgtggacgttgtctcaataatgactgacgtgctgagcaagtacctggctggagaagcgtgtggtaaaggggagcagctgtgattattatgggtatcattcctagtggttctgcaattagtcttgacagtaagtgctgcaggacttcagacaaggagaggctacaggtgtggaagtgctcctcaaagcctgtgggacctaaatgggcacagtgaaggagagtcttaggtggaagcaagaaaactgagcatcaggaagggagcaagacccttggtgatgggggtatctgttctgcatggaggatagatgacttctcagccattgggaaaccagctaaccagctttctgcttgatggttgtagtaaaatcccatgattagtgacaatggcatgccaggtttgaagagcaaaggtcaggaggtgagaaagcagataaatgcaatgtttatcttgaaagaagttgtcaactacttggaaatccccaagcttacttcctccaggaagccattctggactacttcacccagttctcatagctcccgggccctccatcttcccagcactgaaacacacactgaaaagggcatttttctaaatatgtctctgcctccccttgtggagggatgtggctccttgagatctggggtcacggctggcgtgtttcgtggagtagctagaaagagtaataatcctttttgaatgcacagcatttacagaggcctcacaggctgaaaatggtaattaggatacacaattgggtcttttgacctcaaatccaggcattttcccaccttgtgggcctcactcaaatgatgaccccaggttctgcctgtgatgaatgagcaggcatggttttgttctgttaggatatgacggtagaagagagctgtttgtcagaaccagcagtggcttcagatcttgaaagtccaactccttcattttacagaggaggaaacctgtgccccaaagcaggtccccccaagttccagcccagtgccaccccactgcacagagcagctgtctccttttgatcatgaggaagccaccaggtccctggtggagttcagcagatgtgccgggtgggcgactctggtgggtgtgaggatgtttcctttcctgctgggaagtcctccaagctcttgtgaaagagatgtggtttgtcgagcatggattttcaaactttctttatagagagctgttgttagcttaaaaatgcctggaaacatgatcaagtgtaatgttttaatgataacatagaagcacatagtactaagcacatgtaatgagaatgtacagaactctctagtaagagtctgaaatttggccgggtgcagtggctcatgcctgtaatcccagcactttgggaggccgaggcgggtggatcacctgaggtcaggagttcaagaccagcctggccaacgtggcaaaaccccgtctctgcccaaaatacaaaaattagccgggcgtggtgacgggtgcctgtaatcccagctactcaggaggctaagacaggagaattgcttgaaccttggaggtggaggttgcagtgggctgagatcgcaccgttgcattccagcctgggcaacagagtgagacaatgtctcaaaaaataaaaaagagagagtctgaaattcattctttcaacatgcttgtgttgggtgctgcctggcacagcaattggtgcccactaactcacagcgtcggggaagataggcacggaacaagtcatctggtgtggtccctgcagtgggggagcccagtgagggcctgtccagcccagctgagaggagactgagagaaggctaggtggcataagtaaagatatggatagcgctttcctcttcagagtgtttattaccagggttagataaagcagatctcatgtattttctgctactaagtagaagttcttgttttgtttgatttctggtgggctttgatattttccaaaaagataataactcattgtagagtaagatcaggactggggccagcagacttgggtccaaaggtgtgtcatttttataccagactagaatcgggtgaggggagatgtaaagagatcactattgtcacggaaggcgctggaaggagctctgcttagaaaaaatgcctttctctaggaggttttcatccagcatgggaacacaaaacaccagtttaaaatagctaggtaaggcttcacagtctctcaatgtgatgtgggtgtcctgagtcgtgaacatcccattgtgcaggataaaatgctggtttctgagctgtctttcaagacacaacccaaatgctgtctttgccatggtgccttccttgggaacccaagccaggtgaggtctgccttttctctgatgttgcctaacttttcctctttgtgtcccttgagctcagggacatgcatcccctgttgtacctagcacagaatcatgcacaagcaggtgcttgttaactgttggtgtgtaccaacaaacatttacggagcacctattagcaggagcacaggccaaggagctggatagatgagcgtggagtttgggggagaggtctgagctgagatatacatttgtgagtcatcattgtatggatgaggccgggctggggaggatatgagcgtagaatgagaaggtccagacctgcacctgaagaacagccccatttagggaatgcagggagagacagaggaaaagcaagatggtgcacagtgacattgaaggtgagtgacgagaccctgcagcaagaggaaaggagcagcagtgctagatgttgcagagaacccagaatggtaaggcctgaaaaccatgtgttttagattctgtaacctggaggccactaggtgaccttagcaagggcagtcatgatggagtgttggggctgaagcccattgcagggaggcccatagtcaatgggaggtgggcagtagacacagagagctgggttattcttgccacacagctgtgctggggccatggcgggggtgggggtgccacagagtgggagccagagagggacctgggtaagggctgaccgtgggtggggagcgcatggagtgctttcagaggccaagtgagtggaactgtctatgaagcagatggatggaaccctggctgaattatctcagacttgccaaagacattcataaaattcagacccgcacacactcgggaatgggaaaaatgaattattttgtaagaagcttatagtccaaaggtagaattgcccaagagagcttctgaaaggaaaaagtcatagcaagttgatatttttaaagtgaaataacataggttggatttttctagtaacttcaaggggtaaagactttgaattttttttttggagacagagtctcgctttgtcacccaagctggagtgcagtggtgcgatcacagctcactgcagccttgacctcccaggctcaagcaatcctcctgcctcagcccctcaggtagctgggattataggcacacgctaccacgcctggctattttttgtatattttgtggaggtggggtttcaccgtgttgcccaggctggtctcaaactcctgagctcaagcgatctgcccaccttggcctcccaaagtgctgggattaaaggcgtgagccactgtccctggccaagactctgggtttagtaagcctcttgcaactcactaggagtggatttctaggacctccccactttcttgcttgttgtttcttttgctagccgtaagtccctggagtacactgggtactttatgggaaaaagaggaacagtgtgggacagactttgccctgggctgcttaacgtgatgtggggaacagaggtgataagagcctgtggcagctcaggcagccctgccatgacctggagttggggaggggtatcaaggataacaagtcttatacacatgccatgctgtttctttggatcaatagatggataatttttaaaaccccctgtatgtatcaaactcactttggagatgtaaggcatggcctctgtcctggtgacagtatctgagtgggaggcctggtaaaatgtctgtgtttaggatgatgaacgccataatctaagactgctaagtgctgtggggtggtctagaagggcagatgggctagctgcgaggagggcagaggcactgtgcaatggtgttgcctgggaacactccgtggagagtgtgggaatctcaccctggccctaccaggtaagaaattgggcctgggaaattgggaagggaatttttcaagcttcatggctgctccaggacttgaactaagactttcctttagagcaagcttgtccaccctctggcccgtgggccgcatgtagcccaggagagctttgaatgcagcccaacacaaattcataaactttctgaaaacattgtaagattttttttttgcgattattttttagctcatcagctatcgttagttagcgtattttatgtgtggcccaagatgacgactcttccatcgtggcccagggaagccaaaacaccggacacccctgcttagagaaagtgcgttttctgttataaaaggaccttgaatccccatctcatatgttgggactttgtcttgcatgttttcaggcagggcatgattgtatctgtaacataataatatgtaagaatgtgtacttcttagcctttgcagagaggcgggaggcctgtttcctgcagcccccgccctgtcctggctgaggggtgggaggcagcttgctggccagccccgctgagtcaccctccggcgtggagcccagtggggatttccacgcggccccagtgttctcttctcctcgtttcctgttgggctgtgacgcaggctggctgccagcgggtgccggtgggcactcctgacacaggccactgccagccggccttgtgggtcctgagggcatcgtgggtggctctccccccacgagtgactgtgcctggcagggtgtgccccacatgtcagttgcactccgttctgggtgggcagctcccagaggccccggggagggctgcagatgggcggggggtggctgcctgggaggacgggaggttttgttgaagagagagcttgctcttggggcagtttgtactgggcgtttagggttataaaaacctagatttgctgaaaacggctctcttttatcttctgacaagaacatttgtgaagaaaacaaaacagaccttcagccatttagtctatacaccgagagaatggtttctacagtatgcctgatttctctgggtctttctaacacatccatgtatgtgcttgtcagcttctagtgcctccatttcttgatatgaggaaattttgcttaaaaaaaaatctctactgataggacctctgcatattcatgcatgtttttcctccagaactttgtgtcccaccactgtgctaggcagtttacaaatgccatctgatttcattcctgccactacagtctaaggctatattgtccgatacctatccaccaccctcatgtggctatttaaatgttgggtcattaaaattaaatacaattacaaatgctgtccctcagtcacaccagccgcatttcaagtgcacgggtaggctagtggccatcagatcagctcatatagagcagcacgttttcatcaccaccaaaaattctattgggtagcactggtctaaggtccggacatatgtccccattttgtagatgaggaagctgagtcctacagaggttaagttgaccacttagaagaatgaacagatgaaaccttttcattttacacatgaggaaactgaaggttatactcccctttccttcttagaaaagagaaattgatctgtaggcttcagggactcttcagttagcctgggggtactgtgcgggtcagctcttttgctgttccccccagaccctgtcagctgtgggtggtggctggtttctcttggtttcctcaccagagtttgggaatgagcaagtcaggactgctttccgtacggtaatcctttggcccatttcctatcgggggatttatggagctggtgatctcttgggttttttggccatttgttagagccaaaagaggtcacaggaaatgatatactagtttcattgcccaaaatactgaggtccagagaggtgaggggatgctgagggtcttgcatctagctaagagctgagctggctcttaaacttgttttcaagccaggacttacctgactttcttaggaaagtaatcactccatagacaaggataggtttttttcacagagcaatgatgttccctgtggtccctatgtagggtggtaaggaatagggctttgggatcctacagaccagggttcaaatcctggccccaccacttgtaagttatgggacttcagacaaggacttaaacattctaagtcctcagtttcttcatctgtaaaacagggataaaatatctcagtgaatttgttttaaatacttgcgtccgggcatggtggctcatgcctgtaatcccagtactttgggaggctgaggtgggaggatcgcttgaggccagaagtttgagaccagactggccagcataacaagaacataacaagatctcatctctacaaaaaattaaaaatattagctgggcatggtggtgtgagcctgtggtctcagctactcgggaggctgcagtgtaaggttgcttgagccaggagttaaagtctgcagtgaactcgccactgtactctagcctgggcaacagagtgagaccctgtctcaaaaaaaaaaaaaaaaaaaaaaatcagccaggcgcagtggctcacacctgtaatcccagcactttgggaggccgaggcgggtggatcacctgaggtcaggagtttgagaccagcctagctaaaacatggtgaaattccgtttctactgaaaatacaaaaaattagtcaggtgtggtggcacacgcccgtaatcccagctactcgggaggctaaggcaggagaatcgcttgaacccaggaggaggagtttgcagtgagccaagattgtgccatcgcactccagcttgggcaacaagagcaaaactccgtctcaaaaaaaaggaaaaaagaattctaacatgtttgagattgactgcaattcctagcatattacaagtgttagtaaatagtagccattaatattatgagcttatcatcaccttcagccagcattctaattttacagtatagaatccagtacataggaggcactcagatagacgggatgccccaaaattgggagacggacaaacttattttgaaatagtctttttttgacatttccaaagaatatactcaatgtttttctgcaaccctttgccttctttttaggtgaaggacctctacatttaaagcagtgggttcaactgctaacctgaaaagctataataaaacatcccagagtatccaaaaagcctggaaacaaagggaaaatagtgtgtcctgctttccaactttcggatatgctgtagaatagactgaaacaaatcactggaaaataggttgttgtcgattttatttagaagcttttgttcctttggattttcgtctcttatttttagacagagtctccctctgtcacccaggctggagtgccgtggtgcaatgatagcttactgcagcctcaaactcctgggctcaaatgatcctctagccttgacctcctgattagctgggactacagaagcaggccaccacgtctggctaatttttgtatttttctgttgagaagaggtcttgctatcatgggcaggctggtcttgaactcctggcctcaagtgatcctcccgcctcagcttcctgaagtggtaagattacaggcatatgccaccacacccagcttttttgttcctttgaaagaaggcattgctaatgattgccctgaggtgtctagatgacccggccagccatccacctctgcagtttacacagcttgttgatctccacagtgagaattaacttcacaacctgggtccaagaggctggaggattgtcagtctttagaaaaaaaaaaatctattatctttagagaagatggacttgttgaggaagaagagtagacaaatactttctggaaatattttcaaagggaattagaaaaagaaaaagattttggttgtcctttggtgaatgagaatattcatcagcagaatgcctcattaccacgtcacacagctgaccaaggcctcatctgagactgtgtttgaatagaaattaaacagggctgacagtgaagtttctgcttttaattagctttcaaaggtacacctctacctgtgatgttgaaacatcttgaaaaacctctctgctctgtgcctgaatgaggggcatctagagggcttggaagagaagatgtggcacagggcagccggggagaggctggtggccagaagatggacctgagcttggtgaatttacctggcatctgagcctggcctgaacaattcagaaacctcatttcatcagtcttggagtcagggctcctgtctcttagcaaaaagctaaagcatacatcaagcatatttattgacaagcgtaaccactgtgaggttataaccagggtgctctgtctgcttatgggcaccccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctctgtcctcattgttactggctgagccagatgtcagtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacacactccctgagtccttagggaattgcgtagtttttttcttttcttttctgggttcatcttaccagcagtcgtgtttgagaatgtgcacagctcaccttcgttcagccctttacagtttacctccatagccttctttgcgtcttggcaccatcttgcgaggtgtcaggccaggtgttaggatgctctgtttacagatgaggagattgaggcatgagttgtgattgctcacaattgcctcctgagtggtggggccatgctggggcactgtgcccagactctagacttccaggggtccgggacctcctgctgccagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacctgtaccacccactgagatggttttgattttctattctgcgtttaaggcccatcttcaccccataaatgccagctccccaaggacagagccctttcctgtcttgtccacaccatgttccagggccctggacggtggttggcacacagtaggcccttggtaaatgtttgtcggatgagtatgtctcttcctcagctctgtggttagctgggagagctccgacagtagagtctggcaggtctggttcaagcatccctttggtgtaacatggtgtgaatggtggggcctcactgaattgtggagtggggggcagtgtgtctccctacgacctcctggtgaggagaagatagtcaccacccacacaggcacactcttgaatattccaggacgaggtgggcactcattagagggcagctcttacggccactgcctggtatgttttggcgtgagcagtagggtcatcgtggtggtcagtttttccactgccatcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccaggtgttttgtttttctgtctcctccctctgtttctgcagtgcctccccctgtaaaaaaggaaaccaagaggctgacaggttaagtgacaggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagccttggccagacgtggatatggttatgcacggactccgttttgtggtttgtcatttctgacttgctgggaaatcctttgttgggggtggggatgggaagtagagcatctctggggctggagtttttctaagatgtgtaagatttagaggctgtcatactgcaaacagggagagcgggctgtctgcttggcttcatggtcagtggagaacagcctggacttggagtaagaacagctaggttcagatccctgcttttactcctgaccacttagtaaccttggccgagtccctcaacctttttgcctcagcttccttatctgtaaaacatggggttcttgaaggattaaaagagctggtgtgtgtaaaacccaggaacatagttcctggtgtatagtgacttataatttcgaaaaccttaagattttattcataagattttttttttcaaggccaacttaagatttctaagagtttgtttttcaaagagctggggtcttgctttgtcgcccaggctggagtgcagtggtatgatcatagctcactgcagcctcaaacctctgggctcaagagatcgtcccacctcagactcctaagtagctgggactgcaggtgcacgccaccacacccagctagtttttaaatatattttttagtagagtgaacctcgccattttgccaagcctggtctggaactcctggcctcaagcgatcctcccacctctgcctccaaaagtgccaggattacaggcctgagccaccacgctcagccttctaaaagtattttggtgtgcaccattagcactgtgtcttaaaggcgatgtgcaccttgagcacagagtgttgagtgcgtggtggatggatgtcatttgcgttttacagatgcggcaacagaaactcaggcccagccacttacccgaggccacatagtcccaggtagagttggaatttggaataaagcctgctgactccaatcctagatgccttccacactcctgtccccctacctctacaccaggcgtccccaacccctgggacccctgggaagtgatgtgcacttagcacctcactatgggaaacataaagcaggaactaacaggactcctctctcaagaaggaatttcagtctacttggggaaagaataatagccaagcagtaactcaggtttgtttagccttctagagcagtgttgccggatatcactgtagtgtgagctacagtgtatggtagcccccacttgttcttggttttgccttatgaggtttcagtcagctacagtctggaaataggtgaatatagtacagtcagatgtgttgagagaaagagaccacatttatataacttttatgatagtatattgttataattgttaatttcattattagttattgttgttaatctcttactgtgcctaatttataaattaaactttgtcttgggtgtacatgcacaggaaaaaacacagtgtctatagagtttggtactgtctctggtttcaggcatccactggtggtcttggaacgtattcccctcggataattgcaattacttctaaaatctaaaatcttctggccatgttaaaatgtaaagagagggtgaaattaattttaaatactatatcttgtttaatacagtgtatcccaaaccatcatcactttagcatatactcaaatataaagattgttaacgagctatattacattcttctttatcatactgagtctgaagttgatgtgtcctttatacttgtggcacatctcagtttgcactgtccacatttcaagtgctgccatgtggctggtggccaccatattggacaccacagctacaggatttcttcgttaggtcagttgatgtcacctgcattttggagtggagtcattgagctcactggctgagttacacagctagtgaggagccgggtgggaccagagcttggtcttcttcccattaaggaagaagggaaacttgcatttgctgaatgtctactatgtcccaagtgctgtgctagatactctacctttgtcattccatttagttctcacagcagccttgcatggtggatgaatatcatgtgcattttacagatgaggcaacagaaactcagagaggcccagcaacttacccaaggccacgtagtcccaggtagagttagaatttggaatagggcctgctgactccggtactaggtgccttccactcacctgacctccttctcttacaccaggggtccccaaccccggggccgtggactgatacccgtgtgcggcctgttaggaaccgggtctcgtagtagtaggtgagtggtgggcaagtgagcattacggccagagctccgcctcctgtcagataagcggctgcattagattctcataggagcgtgaaccctattgtgaactgcatattggagggatctaggttgcacactccatatcagaatctaatgcctgatgatctgaggtggaacagtttcgtcctgaaacatcccccccaaccctcatctctggtgccaaaaagattggggaccactgccctacacagagaaagagaatttgcacgtagcaacttaggcaaagtattcaaggaaagtgccaggggacaggaaggacaccatgggctggtggcctgttcagtaacagcttcagggtatcagttcagaaggcctaggcctgctttggttggggtggtgtatgtgtaaaagcagcattctgtctaatcacaggttctgcctgaaaggcagacacttttaacccttcggtggacagggttggtgatagctagtggggggtatgaggtgggggtgaggaggtggtggtgggcagcaattgcagaggccagagatcttggctgtgttctacctgccacgctgggaatgctaagtacttctcaagccttcaagcaactgagactttctgctcggggaatccccaaggatttggggaggctggaattgagcaagctcttgaatgcatgcatggattcatgcagtcactcactccacaaatattcacgtgctttgggccagaatgatttcggcaggaatatcttgtcctacatgctattgccatgttctctgaggacccgcggcttcgcatgtgtaaatctccctccagagtactcggcagattcccgaagctgactgaggctcagggagtgtcagtcccttgccacaggtcacatagtactgaatggaagatatgggacctcagaaccaagaggctttgactcatttgtccctctttctgtctgttttgccatcagccaggagatagtcgttgagttgtttctatttgccaggcatcgagctgtgttctcgggtttcattgttgttgttttcattttgagtgtgtttgttttgttttacttttaggagcaatcacagtgctcctgttgctgaatggtggctgatgtctgttgcatgccaagcactgcgcagggtgctggtcacagtttgctccagggattcctcccagtcccgctgtaaagaggaggaaactgatgctcagagacttggacctttctgaacatcatgaagctagggatttcagtcccagcctctctctcgagagccctaacttagccactatacctcactgcctctctgtgaccagggttgagtcctggtcctcaaatgaagcccgatttgccagaaccttcttttgaggccttacctggtcttcagttttaccacgtgttaattgggggcagggcagccagtccatcctcttctgcagaaatcaccctgtccaggagatgggtgcttcttcaggacactacctggctaagaacactgcattaacaggagatagagatccagtgtgtgtgaaccttgtgaaaacatctctgtctgttcctccaatctcccccttctgtcttatcatgcagggcaagctcaggttgttgtcctgtctctgttgggaggacccttgagtggtatctcctatgcccaagcagacctgcagagaaccctgtccaaactgatggtcatctgagacatggaacttcatgataggaaggtgtcttggaggataactagcaagtctttcactttatagagggggaaactgagtcctcagcgatcagccacatagattctgtgttgtagagacctgaggatgtgtctcatctccttatctgaacagcaagttcccatgctgcgaacgtctcaccctgaccctcaccgtattttttaggaagtgaatggggctttgagaaggacaacctcactgttttgcccatttctgagatggaaaatcaaggaacattgccccatctccaccccgggaatctatatgcccctcccataggcaagatggaagctagaccagaatgtgcagcttgtgcttcttgcgggaatggtgaggacagatgagggcagggagacagcattcctaaacccagccttttgacccaagaggcagggactccaaggctgtagaatgggaggaattgtgggaggaaaagcactgggcagaaggtctcagtcaaatgcacctgcagttattagctatgtgacttgggcataatgccacctgtgagcccccattttcctcactaggacagtgaactcaccaataggtttgagttgttgccctcccagaactgttgcatgaattgaatgaggtgccttgcttaactgtactgaatactggggaagcctgcttaaatggatgacaggctttttatcattagcaagctgccgcactccccactcatcactccaaggcagaccattgcattttctttcattctgataaactccttgagttgaacagaaatcagactccccgtaacttctgctccacagtttaaaacagcccaccatgaagccttatgtccttcaggacattctgccctgttcacttggatttctctcctccctgcaaagcatcatcagcttcctcctctgacccatgttttgcacttccttgcttgtcactcctctttaaacacttgtccaaactgtttgtggcccgtcctgtattacgcccagggcagatgcagtagcccagcccaagcagcagagaccatggcctccctgatgtggggtctgtgcctcttctccaggcaagtggctgtgacagtctaactttatggaagggtgaactcaatgacattggctgaactgctggtgaacacgggaaaagcccttctggacctcttatctctctctcctggccagaggaaaaccatgtcccatttgtcctgtttgagcactatcaggcctatagccataatcttttacaccgtaacataactttgccaatgccaatattatatgccctttttttttttctagaaaaacttaattgggattttaaatgcatttgggggatgggctgcgtttctgtttgcctctaaaaacaatgagaaggcaaacaaagtatgatcctatcgccagaaaaatggagccaaatctgaaattaatttacaaagtcattagtattttccatttgtgacccccaaaatgaatgtaggtgtagttccttgcaattaactgcaaattaggaaagggttgggaggatgtttcagggaccaacacacagaactgtagcagaagcagatgggggaatggaaccaagaattgccttggttttcactcaaggccgtggtttgggagagtagtgccgactcaaatattccccagaagagagcactttttcaacagtctgaaaagtggcagggacctttggaatgatctgttttaaccttttcattttctgaatgaggcaactgagagattcaggaagggtaagcgacttgcctaaagtcacatagccaggaaggtcagaaccaggaccagagctctgcttctgactccctggccagtgctccagctgccactgcccccctctctcctgggtgcttgtctgcttgtgcctttaatgttcagcacttgagatattttcacgtttagcaccttcacgtttagcagtactcctcattagaggaaaatgggatgatgtgggcagagtcacccacagagtcactccaggtttcagatgtgctggtgcttaccgagtgccacagggagaaagtggtggtttctcccttcccttaagaaacctggttatttccaaggctcaacccctgcaacgccccaccaagccagtcacccaccactgcacattgagaatctgctgctctgtgaatgaaattggcctggggttaatgagtggtgaatgtgtgtcagtgtttggtatttgcagcaggagctcttctgcgattccctaagctcagatgaacggggcctttaagatgccatccagccatcggagagatgcaggaaaggccttttgaaatgctgtttcccctgacctatttgaggtgaggccctgtgatgtcatttccccagtggtgtgtgtgagagagcaagcagcactaagaaaagccactgctgagagttcacagtccttgcttcagtgttgtcttacgctcggggtgccttaaagggcttacagcgaccctacctccagcttctccagctccctttccttggcaaacacttgacccatcccagccccttgggctttctttcctcctcctctgctaccacatactgtgggtgttgggaaattactaaaggcgcgactctggctctcaaagactctgaagtccaggatcgagaagaactgtgtttacacggagttgtcaaggatcattctgccaatgataacctattatcgtgcaactctgtgccaggtcctgctctgggagctttatgtgtgctgttgcccctcacactcacggcagaggtgagacagaatgctgagagatttctgcagacaaggaatctgaggtttaaagaggcaatgtttgatgagccactgaggggtggggctgggattggaaccgaagctggctgcccttcagcccccagggtcctgctggggagatgtacccagggggtcctgtgctgggagagtggaagcaggggtgtcactgggggctttgtcctgggagctgggcaggtgctagggacagagctggcctggttttggagccacaggagagaagatggccgggaagagctgtgtttggaaggttcctttctgtgccaggggtcagcaatctgggttctagcactgagaggggcaaaacgtgggtttgtaggggagagagggtgacccccagtgagggtaagaaagataagctccagtgagctcttctcaccctgggtcccagcctgtaccaaaaatccaggggcagcccccgggcccagcctgcccccttcacagtcccctgactgcttgaggctgtgggccagtggctttgccccttggaagcttggtttcctcatctgggacagaaaggggtcaaaacaccctttttcattgttaagattagataatttgagagccaaaacttcttgcagggtgcctggtaccaagtaggccctctctaaataaataaatgatagttttcattttcccttccacttaattgtttttttttaaaaaaaacttttcttccctgtaataacaaatttcagaagacaagttaatacattgctgtgtatactctcaggccaagaatttcctcagtgtttacataccagagcagtactttgaactttgattttctcctctgcctctgtgctggttcagacaccctctctaagatgccagaagcattgccctgccttggcctgttggtggtggggtatgtgtgtgtgttttcatcgtattataaaaacgtgaaacatttgaattacgggcaagtggtattctaccagatttaataaacgttaatattttccatattcacatcaggtatttgtaacatctctttctttactaaaaataaaaaccttctgctgaagacctcctgttactccaaccccttcccccttcttctcgctcccgtttcacaggtgtttactctcttttaaattggtgtgtgtccttcccagctagaattttgtagtgtattatttgtaaagccaaataaccccactgcaatgtgtttgaaccaccaaagcaaatgatcaccttttgggaaaagaaggctgaatatccaaggccagatcagtgattcaagatcacagaacaaacctaactgctctcaaattgaaatctcaaaattataaattcattgcctttgacttaaaacttggaactttcaaccctgcataattgcagatacattaaagattgtgccatcttgagctcccagggtcatctgaacctttcatgtgaggaaacacatcccagagtcagtcattcttttttttttttttttcttttcgagttggagtcttgctctgtcacccaggctggagtgcagtggtgcaatctcggctcactgcaacctccgccttccggattcaagcaattctgcttcagcctcctgagtagctggtattacaggcgtgcaccaccacacctggctaatttttgtattttttagtagagacagggtttcgccatgttggccaggctggtctcgaactcctgacctcaggtgatctgcccacctcagcctcccaaagtactgggattataggcatgagccactgcacccggcccagagtcagttattcttagagcaggtgttttggcttttgtctttaatgcttccctccccactttaacataactgtaatatataattattgtggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcctggtggtctacccaccatgccagttcatcaggctggggtctgacctctttctggtgtctggtgctgatctaggcaaggtgacaagtgctcaacagaggagtcctggttccttcaaggaagctgggaagtgtaagacggagcaggctgcgtttgtggtttttgccaaggcttgacttttgaccacttttctgaaaaaggacaagggtgtttttttgttttgtcattttttttcccagtagatgttcctatttggttcacagatataaacacttgaaccaggtgatatcagcactgcaagttgatttagtaccacagccattttctgtgtaccaatatgaagctgttccttcataagttcttccttttcgcttttttaaactgaaattattttcattaggatcactaccttcccatgtgcattttaccacaaaatttggttctgattctgttggcttgcttgctgttagtactcatgttagcttctgccattctttccaccattgtcctgggtaaaattttgcatatctgagttgttggattctttcatcagtttttggttagtgactttcatggtctgcagttttagttgctttcagttttattttgtgttgaagttttttctatgaggtttgattttttcagggtcagtttttaaatgtagcaaggagtgtgctttttcagtttgcttattattttcaacaaatgtttttggtgggtaattttacctttgttgatcaccagctttgtttggggtgcatcatttctctcaagccgaattttctctggtaatctggccagaaggcccatagggtcagaatggcaggtcaaaatgtcttggtgctttcttgaagagtttgaaacaagcttgcaaagtactgtcctccctttggatttcttctgtctgggtgttgccagggctcttctgttagcgacagagaaaataggaggtactagaattcggacttctaggaagggctgtattgtccttatcatcagaatccctccctcccgtccctgtgacctcccaacttcacaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctctgggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatttgcggaagagggttccagagtgtggggagagcgtgctggggaggggagctatttgttcctttccagtcatcgctgtactgagcggttccctgggacagttgaacccaggggaactgaattcatctgtgtaagtaaacatccatctccccttaaaggaaaagcccctgctcagcctctctgggcagctggaatgctgctctgtgggtctgggcatttgttccttctttctttcttcctttgatttcttgctgtctccttcaattaggcctgtgactgttttcacatggctatttgtatatacaagccatgccaggcatcataatttgtgtttgtctagatcaataagagcagctttaaccaaaaagtccagctgagaatttataaatacccctcacctcctcccctccctggaagatgtgaaaacaccatcccattaaccctccaaagcagttggttgacttgatcagggaagatatgaaatataatttctttgaatgtgctttctctttactcttttagtggaatttgatcagtgtttaaggaactgtagccgattcccagcccacttcaaagcaaaagcccttcactgtgcctatttgcaaaattacctttgagagactgaagtgtcggaaatgcatttagacacagattgtgccttatattagctctccgttgccccataaaatgggcttgggcatatctgaggcagctaccaaaggaaacttaaaaacagattctggcggcagcgattcttgtgttctgtgctcactgtggaaaagaagggggctagagggatttaagtttacgtggatcttgaggattttaagaaccagatttcttctctttgctcacattaggggaaaaaaaataaacctcagatgccccgtgatatctcgttgcgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccaacttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcatcctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcaggcaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaataatgacaccaggtcaacacatgcgaacccaactgtcctgaacaaacgggggtttgtggttgcgctacaaaacccaggcttcagtctcttcgagttctgttttgatttggaaggagtgacgccttcccctttggaagcttaggctagggttgcaagctgaggtgttcacagggacagacagagtgtgggaaatggggccaggtgtaaggaaacggagcagaacttggggttcattcatagtctaaagggggcattggcaagtcggcatcagacagtagcaacttgttgccagatcttctgagtttttttcaagagaagccaaaaatcaagatttacacacaaaatctcccagtttgtaaaagttggcaaccatttaaaaattttaaaaacgctctgcaggccaagcacaacatctgtgggcagtgggcagctgcctgtttttgacctccagcccagaccgatcaattgatggctgtcttctgggtctcccaattccggcaacgggaagtttcttaaggaagttgcctgggctgaccgcaagtgaggtggggaagtggaaagggagcttgacttggcttcgattgatcatttgcacaataaatatttattgagcacctgttatgttcaacgtactatctgtgttgtgccatgtttcctagtctacattttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaacatttactgtacctccatggtttgcgtggaattgtactagaaacactcaaccccggggctttgttggcaataaactaggtctttctgcagaacttttgaggacaaatcaccaatgggttggaaagcatttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaagtaacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtgattctctaatgccagcttgaaattcggtgacccaccttgggatgctttgcctgtcaaggtttttcaatgatgaatagttgttatgagcatgtcagccagaatggtacttttcaagtcattcagtaatggatctgtatgattattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagcccaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcactgtcgcctgggctagagtgcatagtgtgatctcggctcctgccgccacacacagatcataatgtgatctgcaacctccgcctcctgggttcacatgattctcctgcctcagcctcctgagtagctgggagtacagcctgctttggcctcccagagtgctgggattactggtatgagccactgtgccctgccttttttttttttctttaatgtttgtattgaggtgtaatatgcaataaaaggcacatatttaatgtgtacaatttgatgagtttgatatttgtatatgcccatgaaaccatcaccagtcaagataatgaacatgtccatcactcctctaaaactttcctcctgcctctttgcaatttcaccatcttgtttgcctgctgcccccatccctaggcatccactgatctgctgttattatacattagtttgcatttcctaaaattttatataaatggaatcatactatatgtatgacttttgtctgattttttttaatgcagcataattattttcagattcatccatctttttgcatgttttagtagtgactttttgtggttgggtgatatttctttttgtggatataaagggagggttgttgatcttcagggattatttattttcattttaaaagtttctcctgaagtagtattttgtttttgaaaatgtgctttgaaagaaatttgtttagaattcatttggccctaaaatccacgtaattaatgatttaatgagttaaatagtgatttaactatataaatatagtttgctaccatgtttgctatgtgccaggcttgatggtgcttgtagggcacagaagaggttcctgtcctagccagtggttgatgtgttcaggagggcctatcagtagtgcactagtgcaccatatcctacatgtgatagagctgccgtgttcttagacacaaagacagctgttatgctgtctttgcaaaaatgttgaggtcttgctttccacaggcttgtggcctgatgcacgtttccagttttgcacaatgtcacagcagatatgccttccacgcccttggtttttcacagccaggcatggggctggaatctcagagctgcggttgctgtggttctctgattcctgctcagaggattgcgtgatgggggctggagtgcaggcaggaagttagccttgtggattccctcatcctcacaaagccaggcgcacagggaggggttgggggtagggggttgccatgggaatttcttccccagccagagagccagggtggagtgtgttgctggggagttggaaatgtaccctcttttccatatccattgttcagtcacgttctcctgaaagaagtcttcttactgtgtgtaagaaaaatcagtaagcctctgataaatagtcaaagactgtcagaaaagggaccttggaaatatctggtccagcctgcccattttataggtgaggaagctgaggctcagcaagcaggagtgactcaggaataagcactcatagcacagctgggacttgggaaacccaggcactgctttagaccttcattttcacaatccacgaaggggggagtttgaagaaggcttggcaaaatttgatagacctgggaaagagattgttaatctctcattctgtgctcaaggatgctgtgccatttaaaaaacaaaaacaaaaaacagaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgacctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaagcgtgcagtctgcccacaggaagtgattcatggtgctccgattcgggcagacctgactgcaggaggcgggaggctgggaaccaggtctgggaaaagagggcagagagaggatacccagacctaatggcttctgctctgtggaagaaagtgaaaaacagaatgactaagagtcctgtaataagaattgtttgttttgtgaagttgaactaatagtgaggtttgccggcagataagacttgagaaattgcagttgtcaggggaggggacttttccatgtcctgctttttttttttttttttttttattaagagagcaaagctatttctcagtcttttttttttttttttttttttttttgagatggagtctctctctgtcgcccaggctagagtgcagtggcacaatctcggctcactgcaacctccacctcccaggttcaagtgattctcttgcctcagcctccccagtagctgggattacaggtgcccaccaccatgcctggctaatttttttgtatttttagtagagacggggtttcaccatgttggccaggttggtcttggaactcctgacctcaggtgatctgcccaccttggctacccagagtgctgggattacagacgtgagccaccacgccaggccttatatctcagtcttaagacattcatatattagtggaaggcccagatttgtgtttcagttctaccttgccacctctaagcctgttttcttttctttggagaagagggtctaagatgagaccattatctcacagtctccaatagctctttctccccattttcccttttatttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcacccaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgtaatatatgattatacatagtaacaatcatatattacataataattgtaaactatgtaataataatattgtaatatatgattgctagatatttgaagctatataatatattattgttaagtataatcatcttacagtggtttaggacactagaactgatttttcctctttagctgtaattttgagacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagcgagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccctttcttccagtagtcacagaccaacccagatctttgtagcatcttttatttgtgacttgaaagttctatgatcctgctgacactcaagaaaaagcaatccccatcaacttggtgcttggagaaaaaagtttgtgaagaccaaagctattaaatagaaaagccctaaacactctcctcctcctcctccttcaatatttaaccgtcttctttgcatgggggaagggaggggctctcaccacagccaaaagagaatctctgctgatttaaacccagtgtgctttgtagtcatagagaactgagtttggagtgtaacatctaggttcaagcccaggcactgttccttgctgggtgactttgggcaagtcactcagcatcaaaaatttttcatctgtaaaatgggagtgatgagatactcagcctgcaggatccctttatccagtgagttactgagtgagaagtgctgggtaaacgcttgctctgaggtgtaaattgcttctgtttggccaggtgcagtggctcacgcctgtaatccaagcactttgggaggctggggcaggtggatcacctgaggtcaggcgtttgagaccagcctggccaatattgtgaaaccccgtctctactaaacatgcaaaaattagccaggcgtggtggtgcatgcctgtaatcccagctacgcagaaggctgaggcaggagaatcacctgaactggaggttgcagtgagccaagatcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagccccctagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgggaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagggtgtagtatattcagtgtacatcctgagttctgtttgtaactctttgattccaagcttcagaaaattacaattataggctaattttttatactactactaatcgtaatataatcaaattatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagttattaatgtgctacttggggctacttcaaaaaatgaatattagaggagtatttgggggtaagttcacattttatgcaaattgactctaaggcctctaggtaggttgtccttctgaaatggttaagtcttatccagcttcaagatctgggcataggggtatgccccatttagaattagggaaaagaatctgagtcatgcagcctagcttcactttatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctgcctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgttgttactattactactcaatgggcaagttgaaaaagaaagtttgtctgaaagtgactagaaagttcggtattaagagcatgtgtgtgtattcaataaaataggtttcaactgaagtgtgataatgttaacaaatttactctttgttcacttctatggcccagttaactggcacagttcttgggatatggtaggtattcaataactatgctgtgattgatgaatggtcacttttaataatggtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagtatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttactttgccggccactatcatagtaagcaggcagtaatagttacatgacaatactgacaatagattcctgccactttctggaatatctttctgggtagtgtctgttcaaatcatatatctctttttttaaaaaaattggattgttaatactgagtgttcttactaatatttcattaaaaaaatttttttaatccctctgggggaaaagaatttttttttttttgagacagattctcactctgtcacccaggctggagtgctctggtgcaatcacagctcactgcagcctcaacctgctgggttcaagcaatcctcccatctcagcctcccgagttgctgggactataggcatgggtcaccacgcccagctaatttttatattttttgtagagatggggtttcaccatgttggccaggctggtcttgaattcctgggatcaagtgatccacctgccttggcttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatgacaaatgatgatatatgtatatacctatgaaaccaccatagcagtaagagaatatacataacctttacccccaaaaaagtttccaagtgcaccttggtaattgctccctccaatccctactccctccctgtaactccctctgtccccaggcaatgactgatccctgctttctgtcactagattaagattagtgtgccttttactttagtttaaattaccttataattttacacgaacagaatcatgcctggcttctttcacgcagcatcattaatttagattcattcatagcgttgcatgtatcagtagttgatccttttttgttactgagttgtatttctttgtatggatatgttatggctcattcatctgttaatacatgtggagtagttttcaatttggggctattacattcatgcacaagtctttggacataggcttttatttctcttgggtaaatactttgaagtggaatggtggatcatatggtaggcttatggttttttagctttttaagaaacttccaaatgtttgagggatgaatatcccaattacccagatttgatcattacacattgtatgcttgtatcaaaatatcgcaagtaccctataaatatgtatagctactgtgtatcccccaaaataaaatattttagaaaggaacttccaagctgttttccaaaatagttgtaccattttacatttgcaccagcagtggaagggagttccagttgttccacatccttgccaatacatggcatgatcaggctttttaattgtagccattctaataagtatgtagtcctatctcattgtagttttaatttgtgcttctctaatgatcaacattgtcaagcatcttttcatatgcttgttgtcttcatatctttctgggtagtgtctgttcaaatcatgtatctcttttttaaaagattgaattgttggctgggcgcagtggctcacgcctgtaatcccagtactttgggaggccgaggcaggcggatcacgaggtcaggagttcgagaccatcctggttaacacatgaaaccccgtctctactaaaaatacgaaaaattagccgggcgcggtgccaggcgcctgtagtcccagttgctcgggaggctgaggcaggagaatggcgtgaccccaggaggtggagcttgcagtaagccaaggttgtgccactgcactccagcctgggcgacagagcgagactccatctcaaaaaaaaaaaaaaaaaaaaaaaaaaaaaaaaaaaaaaaaaagaagattgaattgttaatattgagttttcagagttctagaaacaggtctattatcaaatatacgctttgcaaatattttctcttagttagtgcttgcctttttattcctttaacagtgtctttcaaagaccagaggcttaaatcttgatgcggtctgattttttttttattattattaagtgctttttggtgtggtatctgagaaatcattgtctatcccaaaaagtcacaaagattttctcctgttttcttctagacattttagagtttaagtttcacttcagtttgtttttgtatagggttacaatgtgtagtttgaagattatcttttttacatatccagttgttacatcaccatttgttgaagactgtccttgctccactaaattgtctttggacctttgttgaagccagtcgtccatatatatgtaactatttctggactctgttaggttccattgatccgtttgtcagtccttgtgccattaccatactgccttgattattgtagctcccttgtttttaaaagtttaattaatatccaagtgattcatgtatgattaatattactactaaggcaagagggccacccacttctatcacctagatggagcttacctccacagccccattctcccccgctgctggcatgagcttttctccaaggccttctcttgcagaggaggctatgatgtccagctggcccttttttgggagttttgtcaaacaccgaagagcaaatacggccacttccctaatctgtgggcacccagtggctttgcaggagaaggagaacagctgaataattctctattcccactcaccacttcccactctcccttttactcctgttcaacctccagctcaccctacttatccagggctgggtttggggagtatctgctgtgatagagaataataacgctaatttgtgggtgtttatgaagcactttcaaatggaaaccaagcttcaggaggtcggggggcagaataccccattttatagatgagaaaactgagtgtcctaggaagctcatgagctgcccagtgtctcccagctaggagagtagaaccctcctttaccccaggtcttatggctccacatccgccagtcctccttttatacctcagggacgagtcccaggctgtcttctcgatctgcctggtaattactgtttttcagctgtagggcttccttgttctggggccccaagggaggaaggtaattacatccttcaagatgcccttagtcagcagctccaggtcagttcctgtgaccaagcccagctatgacctttgtctgtcctttccccttcccaggccagtggcttggagagtgtgattggatccctctgtttctctctttggttggtgctgttggtggcatctggccagcccttccttcacagagtgcccatgaattctctgtattcaggcaaatgggtgccctcggtcataagaaggcacagagggaaagcttgcaaatgtctcactgccagccctgccagctattagaaaaattatggcactgactggcagggtcctaggatgggcctccttgaagaaaaagcagtcctgcctcttaatagggtacctgtgactcatgagcatccatctcatctgctccccacttctatccctgctacccgcaatctgttggtcacacgtagccagagttccacagggcctgtctctttcacacgtatgcacagcccacttacacatctcagaggctacatactgcttttagaaaacaggagaagcctttatcatggcctttggggccctgcagagtacccctgcctgcctccccggcctcgtctcaagccagctctctctcatgatcccctctccagtccttctggccttcattctgttcttccgacctcaccatgttttccactttccacagggcctttgtgtgtgcctttccctctgcttgtactgcccttctcccgcacccctttgcctggttagttcttacttaccctttaggccttcaggtcaaccatcacctcctctgagatgccctgtccagtccttcagcaaagtggggtgccatggtcatacactcttggggttccttgttattttcgttcaggacactttcattgtgtgtaattgtaggtttctgtgatgatgatgatgatgatgatgatgatgatgatgatgatgatttgaaacggagtcttgctctgtcgcccaggctggagtgcagtggcacaatcttggctcactgcaacctccccctcccaggttcaagtgattctcctgcctcagcctcctgagtagctgggattacaggcgcccgccaccatgcctggctgatttttgtacttttagtagagacagggtttcaccatgttggccaggctggttttgaactcctggcctcaagcgatccacccgcctcggcctcccaaagtggttttggtgattatttgattaatgccggtcttgcccagtggaatggagggtccctgcagacagggaccactttgctggccttttctcatagtgaagtctctttccttaccactgtatccttagtgtcacacataataggtgctcattaaatatgtgttaaataagggactccattttagtggcacctcctcacctgtctaataccagacactatctgaagttttacgtccctccagaagccttctgcctcccagccttgcctgtagctgacaatgcttttgccgccccaagctccccagtcctttcctgtaagccacccagactctcatcatccagatcacctggggatttcacaaagggaaagattctgatttagtaggttggggtaggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaacaccctgtatcaaaagtaaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgccactccctgaagagcagtacaaagttggggaacccaccggggactggtgggtgaggcccgctctgccagctgggagtcctcacggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcagtcctgtggccccaatctctgccccctggccgtcccccgctcaccccctctttgcgcacagctctggcctgagggcccctgactcagaaccgcatccctgttgggagaggacccatgacctcagctcccccctcactagtgatgcttttcttggcatagaggagcagcgtgacccttccgcccggccttggtgcagtcatttattttggaagcggaaatagcaacactgtttctctcaccgcccttgaggcccggactggtgttcagtcccaatagactgggggtctgcagaggcggggagtgagctgagggccaggcagcaagtgcggagagctggctctgtaaattcgcctgggcatcaggcctcggtgaggggctccaacctgggtgggaattgaagtgactttgagttttcactctgcagggagaaatgggctttgccgtcaaagactgcaaatgtttttagaagcccctcatttacatgcaaataacgtgtgaatcaccagcactttcagactccaggaaagctgtgcttggcagcacttgggctagtcacttttgcttgctggggcagtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccgtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaagaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcctgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcgccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctgaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttctttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtgaagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaaccagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 1990 - DNA, 69480 bp, Homo sapiens
  source 1..69480: mol_type = genomic DNA
aaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacacactccctgagtccttagggaattgcgtagtttttttcttttcttttctgggttcatcttaccagcagtcgtgtttgagaatgtgcacagctcaccttcgttcagccctttacagtttacctccatagccttctttgcgtcttggcaccatcttgcgaggtgtcaggccaggtgttaggatgctctgtttacagatgaggagattgaggcatgagttgtgattgctcacaattgcctcctgagtggtggggccatgctggggcactgtgcccagactctagacttccaggggtccgggacctcctgctgccagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacctgtaccacccactgagatggttttgattttctattctgcgtttaaggcccatcttcaccccataaatgccagctccccaaggacagagccctttcctgtcttgtccacaccatgttccagggccctggacggtggttggcacacagtaggcccttggtaaatgtttgtcggatgagtatgtctcttcctcagctctgtggttagctgggagagctccgacagtagagtctggcaggtctggttcaagcatccctttggtgtaacatggtgtgaatggtggggcctcactgaattgtggagtggggggcagtgtgtctccctacgacctcctggtgaggagaagatagtcaccacccacacaggcacactcttgaatattccaggacgaggtgggcactcattagagggcagctcttacggccactgcctggtatgttttggcgtgagcagtagggtcatcgtggtggtcagtttttccactgccatcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccaggtgttttgtttttctgtctcctccctctgtttctgcagtgcctccccctgtaaaaaaggaaaccaagaggctgacaggttaagtgacaggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagccttggccagacgtggatatggttatgcacggactccgttttgtggtttgtcatttctgacttgctgggaaatcctttgttgggggtggggatgggaagtagagcatctctggggctggagtttttctaagatgtgtaagatttagaggctgtcatactgcaaacagggagagcgggctgtctgcttggcttcatggtcagtggagaacagcctggacttggagtaagaacagctaggttcagatccctgcttttactcctgaccacttagtaaccttggccgagtccctcaacctttttgcctcagcttccttatctgtaaaacatggggttcttgaaggattaaaagagctggtgtgtgtaaaacccaggaacatagttcctggtgtatagtgacttataatttcgaaaaccttaagattttattcataagattttttttttcaaggccaacttaagatttctaagagtttgtttttcaaagagctggggtcttgctttgtcgcccaggctggagtgcagtggtatgatcatagctcactgcagcctcaaacctctgggctcaagagatcgtcccacctcagactcctaagtagctgggactgcaggtgcacgccaccacacccagctagtttttaaatatattttttagtagagtgaacctcgccattttgccaagcctggtctggaactcctggcctcaagcgatcctcccacctctgcctccaaaagtgccaggattacaggcctgagccaccacgctcagccttctaaaagtattttggtgtgcaccattagcactgtgtcttaaaggcgatgtgcaccttgagcacagagtgttgagtgcgtggtggatggatgtcatttgcgttttacagatgcggcaacagaaactcaggcccagccacttacccgaggccacatagtcccaggtagagttggaatttggaataaagcctgctgactccaatcctagatgccttccacactcctgtccccctacctctacaccaggcgtccccaacccctgggacccctgggaagtgatgtgcacttagcacctcactatgggaaacataaagcaggaactaacaggactcctctctcaagaaggaatttcagtctacttggggaaagaataatagccaagcagtaactcaggtttgtttagccttctagagcagtgttgccggatatcactgtagtgtgagctacagtgtatggtagcccccacttgttcttggttttgccttatgaggtttcagtcagctacagtctggaaataggtgaatatagtacagtcagatgtgttgagagaaagagaccacatttatataacttttatgatagtatattgttataattgttaatttcattattagttattgttgttaatctcttactgtgcctaatttataaattaaactttgtcttgggtgtacatgcacaggaaaaaacacagtgtctatagagtttggtactgtctctggtttcaggcatccactggtggtcttggaacgtattcccctcggataattgcaattacttctaaaatctaaaatcttctggccatgttaaaatgtaaagagagggtgaaattaattttaaatactatatcttgtttaatacagtgtatcccaaaccatcatcactttagcatatactcaaatataaagattgttaacgagctatattacattcttctttatcatactgagtctgaagttgatgtgtcctttatacttgtggcacatctcagtttgcactgtccacatttcaagtgctgccatgtggctggtggccaccatattggacaccacagctacaggatttcttcgttaggtcagttgatgtcacctgcattttggagtggagtcattgagctcactggctgagttacacagctagtgaggagccgggtgggaccagagcttggtcttcttcccattaaggaagaagggaaacttgcatttgctgaatgtctactatgtcccaagtgctgtgctagatactctacctttgtcattccatttagttctcacagcagccttgcatggtggatgaatatcatgtgcattttacagatgaggcaacagaaactcagagaggcccagcaacttacccaaggccacgtagtcccaggtagagttagaatttggaatagggcctgctgactccggtactaggtgccttccactcacctgacctccttctcttacaccaggggtccccaaccccggggccgtggactgatacccgtgtgcggcctgttaggaaccgggtctcgtagtagtaggtgagtggtgggcaagtgagcattacggccagagctccgcctcctgtcagataagcggctgcattagattctcataggagcgtgaaccctattgtgaactgcatattggagggatctaggttgcacactccatatcagaatctaatgcctgatgatctgaggtggaacagtttcgtcctgaaacatcccccccaaccctcatctctggtgccaaaaagattggggaccactgccctacacagagaaagagaatttgcacgtagcaacttaggcaaagtattcaaggaaagtgccaggggacaggaaggacaccatgggctggtggcctgttcagtaacagcttcagggtatcagttcagaaggcctaggcctgctttggttggggtggtgtatgtgtaaaagcagcattctgtctaatcacaggttctgcctgaaaggcagacacttttaacccttcggtggacagggttggtgatagctagtggggggtatgaggtgggggtgaggaggtggtggtgggcagcaattgcagaggccagagatcttggctgtgttctacctgccacgctgggaatgctaagtacttctcaagccttcaagcaactgagactttctgctcggggaatccccaaggatttggggaggctggaattgagcaagctcttgaatgcatgcatggattcatgcagtcactcactccacaaatattcacgtgctttgggccagaatgatttcggcaggaatatcttgtcctacatgctattgccatgttctctgaggacccgcggcttcgcatgtgtaaatctccctccagagtactcggcagattcccgaagctgactgaggctcagggagtgtcagtcccttgccacaggtcacatagtactgaatggaagatatgggacctcagaaccaagaggctttgactcatttgtccctctttctgtctgttttgccatcagccaggagatagtcgttgagttgtttctatttgccaggcatcgagctgtgttctcgggtttcattgttgttgttttcattttgagtgtgtttgttttgttttacttttaggagcaatcacagtgctcctgttgctgaatggtggctgatgtctgttgcatgccaagcactgcgcagggtgctggtcacagtttgctccagggattcctcccagtcccgctgtaaagaggaggaaactgatgctcagagacttggacctttctgaacatcatgaagctagggatttcagtcccagcctctctctcgagagccctaacttagccactatacctcactgcctctctgtgaccagggttgagtcctggtcctcaaatgaagcccgatttgccagaaccttcttttgaggccttacctggtcttcagttttaccacgtgttaattgggggcagggcagccagtccatcctcttctgcagaaatcaccctgtccaggagatgggtgcttcttcaggacactacctggctaagaacactgcattaacaggagatagagatccagtgtgtgtgaaccttgtgaaaacatctctgtctgttcctccaatctcccccttctgtcttatcatgcagggcaagctcaggttgttgtcctgtctctgttgggaggacccttgagtggtatctcctatgcccaagcagacctgcagagaaccctgtccaaactgatggtcatctgagacatggaacttcatgataggaaggtgtcttggaggataactagcaagtctttcactttatagagggggaaactgagtcctcagcgatcagccacatagattctgtgttgtagagacctgaggatgtgtctcatctccttatctgaacagcaagttcccatgctgcgaacgtctcaccctgaccctcaccgtattttttaggaagtgaatggggctttgagaaggacaacctcactgttttgcccatttctgagatggaaaatcaaggaacattgccccatctccaccccgggaatctatatgcccctcccataggcaagatggaagctagaccagaatgtgcagcttgtgcttcttgcgggaatggtgaggacagatgagggcagggagacagcattcctaaacccagccttttgacccaagaggcagggactccaaggctgtagaatgggaggaattgtgggaggaaaagcactgggcagaaggtctcagtcaaatgcacctgcagttattagctatgtgacttgggcataatgccacctgtgagcccccattttcctcactaggacagtgaactcaccaataggtttgagttgttgccctcccagaactgttgcatgaattgaatgaggtgccttgcttaactgtactgaatactggggaagcctgcttaaatggatgacaggctttttatcattagcaagctgccgcactccccactcatcactccaaggcagaccattgcattttctttcattctgataaactccttgagttgaacagaaatcagactccccgtaacttctgctccacagtttaaaacagcccaccatgaagccttatgtccttcaggacattctgccctgttcacttggatttctctcctccctgcaaagcatcatcagcttcctcctctgacccatgttttgcacttccttgcttgtcactcctctttaaacacttgtccaaactgtttgtggcccgtcctgtattacgcccagggcagatgcagtagcccagcccaagcagcagagaccatggcctccctgatgtggggtctgtgcctcttctccaggcaagtggctgtgacagtctaactttatggaagggtgaactcaatgacattggctgaactgctggtgaacacgggaaaagcccttctggacctcttatctctctctcctggccagaggaaaaccatgtcccatttgtcctgtttgagcactatcaggcctatagccataatcttttacaccgtaacataactttgccaatgccaatattatatgccctttttttttttctagaaaaacttaattgggattttaaatgcatttgggggatgggctgcgtttctgtttgcctctaaaaacaatgagaaggcaaacaaagtatgatcctatcgccagaaaaatggagccaaatctgaaattaatttacaaagtcattagtattttccatttgtgacccccaaaatgaatgtaggtgtagttccttgcaattaactgcaaattaggaaagggttgggaggatgtttcagggaccaacacacagaactgtagcagaagcagatgggggaatggaaccaagaattgccttggttttcactcaaggccgtggtttgggagagtagtgccgactcaaatattccccagaagagagcactttttcaacagtctgaaaagtggcagggacctttggaatgatctgttttaaccttttcattttctgaatgaggcaactgagagattcaggaagggtaagcgacttgcctaaagtcacatagccaggaaggtcagaaccaggaccagagctctgcttctgactccctggccagtgctccagctgccactgcccccctctctcctgggtgcttgtctgcttgtgcctttaatgttcagcacttgagatattttcacgtttagcaccttcacgtttagcagtactcctcattagaggaaaatgggatgatgtgggcagagtcacccacagagtcactccaggtttcagatgtgctggtgcttaccgagtgccacagggagaaagtggtggtttctcccttcccttaagaaacctggttatttccaaggctcaacccctgcaacgccccaccaagccagtcacccaccactgcacattgagaatctgctgctctgtgaatgaaattggcctggggttaatgagtggtgaatgtgtgtcagtgtttggtatttgcagcaggagctcttctgcgattccctaagctcagatgaacggggcctttaagatgccatccagccatcggagagatgcaggaaaggccttttgaaatgctgtttcccctgacctatttgaggtgaggccctgtgatgtcatttccccagtggtgtgtgtgagagagcaagcagcactaagaaaagccactgctgagagttcacagtccttgcttcagtgttgtcttacgctcggggtgccttaaagggcttacagcgaccctacctccagcttctccagctccctttccttggcaaacacttgacccatcccagccccttgggctttctttcctcctcctctgctaccacatactgtgggtgttgggaaattactaaaggcgcgactctggctctcaaagactctgaagtccaggatcgagaagaactgtgtttacacggagttgtcaaggatcattctgccaatgataacctattatcgtgcaactctgtgccaggtcctgctctgggagctttatgtgtgctgttgcccctcacactcacggcagaggtgagacagaatgctgagagatttctgcagacaaggaatctgaggtttaaagaggcaatgtttgatgagccactgaggggtggggctgggattggaaccgaagctggctgcccttcagcccccagggtcctgctggggagatgtacccagggggtcctgtgctgggagagtggaagcaggggtgtcactgggggctttgtcctgggagctgggcaggtgctagggacagagctggcctggttttggagccacaggagagaagatggccgggaagagctgtgtttggaaggttcctttctgtgccaggggtcagcaatctgggttctagcactgagaggggcaaaacgtgggtttgtaggggagagagggtgacccccagtgagggtaagaaagataagctccagtgagctcttctcaccctgggtcccagcctgtaccaaaaatccaggggcagcccccgggcccagcctgcccccttcacagtcccctgactgcttgaggctgtgggccagtggctttgccccttggaagcttggtttcctcatctgggacagaaaggggtcaaaacaccctttttcattgttaagattagataatttgagagccaaaacttcttgcagggtgcctggtaccaagtaggccctctctaaataaataaatgatagttttcattttcccttccacttaattgtttttttttaaaaaaaacttttcttccctgtaataacaaatttcagaagacaagttaatacattgctgtgtatactctcaggccaagaatttcctcagtgtttacataccagagcagtactttgaactttgattttctcctctgcctctgtgctggttcagacaccctctctaagatgccagaagcattgccctgccttggcctgttggtggtggggtatgtgtgtgtgttttcatcgtattataaaaacgtgaaacatttgaattacgggcaagtggtattctaccagatttaataaacgttaatattttccatattcacatcaggtatttgtaacatctctttctttactaaaaataaaaaccttctgctgaagacctcctgttactccaaccccttcccccttcttctcgctcccgtttcacaggtgtttactctcttttaaattggtgtgtgtccttcccagctagaattttgtagtgtattatttgtaaagccaaataaccccactgcaatgtgtttgaaccaccaaagcaaatgatcaccttttgggaaaagaaggctgaatatccaaggccagatcagtgattcaagatcacagaacaaacctaactgctctcaaattgaaatctcaaaattataaattcattgcctttgacttaaaacttggaactttcaaccctgcataattgcagatacattaaagattgtgccatcttgagctcccagggtcatctgaacctttcatgtgaggaaacacatcccagagtcagtcattcttttttttttttttttcttttcgagttggagtcttgctctgtcacccaggctggagtgcagtggtgcaatctcggctcactgcaacctccgccttccggattcaagcaattctgcttcagcctcctgagtagctggtattacaggcgtgcaccaccacacctggctaatttttgtattttttagtagagacagggtttcgccatgttggccaggctggtctcgaactcctgacctcaggtgatctgcccacctcagcctcccaaagtactgggattataggcatgagccactgcacccggcccagagtcagttattcttagagcaggtgttttggcttttgtctttaatgcttccctccccactttaacataactgtaatatataattattgtggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcctggtggtctacccaccatgccagttcatcaggctggggtctgacctctttctggtgtctggtgctgatctaggcaaggtgacaagtgctcaacagaggagtcctggttccttcaaggaagctgggaagtgtaagacggagcaggctgcgtttgtggtttttgccaaggcttgacttttgaccacttttctgaaaaaggacaagggtgtttttttgttttgtcattttttttcccagtagatgttcctatttggttcacagatataaacacttgaaccaggtgatatcagcactgcaagttgatttagtaccacagccattttctgtgtaccaatatgaagctgttccttcataagttcttccttttcgcttttttaaactgaaattattttcattaggatcactaccttcccatgtgcattttaccacaaaatttggttctgattctgttggcttgcttgctgttagtactcatgttagcttctgccattctttccaccattgtcctgggtaaaattttgcatatctgagttgttggattctttcatcagtttttggttagtgactttcatggtctgcagttttagttgctttcagttttattttgtgttgaagttttttctatgaggtttgattttttcagggtcagtttttaaatgtagcaaggagtgtgctttttcagtttgcttattattttcaacaaatgtttttggtgggtaattttacctttgttgatcaccagctttgtttggggtgcatcatttctctcaagccgaattttctctggtaatctggccagaaggcccatagggtcagaatggcaggtcaaaatgtcttggtgctttcttgaagagtttgaaacaagcttgcaaagtactgtcctccctttggatttcttctgtctgggtgttgccagggctcttctgttagcgacagagaaaataggaggtactagaattcggacttctaggaagggctgtattgtccttatcatcagaatccctccctcccgtccctgtgacctcccaacttcacaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctctgggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatttgcggaagagggttccagagtgtggggagagcgtgctggggaggggagctatttgttcctttccagtcatcgctgtactgagcggttccctgggacagttgaacccaggggaactgaattcatctgtgtaagtaaacatccatctccccttaaaggaaaagcccctgctcagcctctctgggcagctggaatgctgctctgtgggtctgggcatttgttccttctttctttcttcctttgatttcttgctgtctccttcaattaggcctgtgactgttttcacatggctatttgtatatacaagccatgccaggcatcataatttgtgtttgtctagatcaataagagcagctttaaccaaaaagtccagctgagaatttataaatacccctcacctcctcccctccctggaagatgtgaaaacaccatcccattaaccctccaaagcagttggttgacttgatcagggaagatatgaaatataatttctttgaatgtgctttctctttactcttttagtggaatttgatcagtgtttaaggaactgtagccgattcccagcccacttcaaagcaaaagcccttcactgtgcctatttgcaaaattacctttgagagactgaagtgtcggaaatgcatttagacacagattgtgccttatattagctctccgttgccccataaaatgggcttgggcatatctgaggcagctaccaaaggaaacttaaaaacagattctggcggcagcgattcttgtgttctgtgctcactgtggaaaagaagggggctagagggatttaagtttacgtggatcttgaggattttaagaaccagatttcttctctttgctcacattaggggaaaaaaaataaacctcagatgccccgtgatatctcgttgcgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccaacttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcatcctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcaggcaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaataatgacaccaggtcaacacatgcgaacccaactgtcctgaacaaacgggggtttgtggttgcgctacaaaacccaggcttcagtctcttcgagttctgttttgatttggaaggagtgacgccttcccctttggaagcttaggctagggttgcaagctgaggtgttcacagggacagacagagtgtgggaaatggggccaggtgtaaggaaacggagcagaacttggggttcattcatagtctaaagggggcattggcaagtcggcatcagacagtagcaacttgttgccagatcttctgagtttttttcaagagaagccaaaaatcaagatttacacacaaaatctcccagtttgtaaaagttggcaaccatttaaaaattttaaaaacgctctgcaggccaagcacaacatctgtgggcagtgggcagctgcctgtttttgacctccagcccagaccgatcaattgatggctgtcttctgggtctcccaattccggcaacgggaagtttcttaaggaagttgcctgggctgaccgcaagtgaggtggggaagtggaaagggagcttgacttggcttcgattgatcatttgcacaataaatatttattgagcacctgttatgttcaacgtactatctgtgttgtgccatgtttcctagtctacattttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaacatttactgtacctccatggtttgcgtggaattgtactagaaacactcaaccccggggctttgttggcaataaactaggtctttctgcagaacttttgaggacaaatcaccaatgggttggaaagcatttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaagtaacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtgattctctaatgccagcttgaaattcggtgacccaccttgggatgctttgcctgtcaaggtttttcaatgatgaatagttgttatgagcatgtcagccagaatggtacttttcaagtcattcagtaatggatctgtatgattattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagcccaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcactgtcgcctgggctagagtgcatagtgtgatctcggctcctgccgccacacacagatcataatgtgatctgcaacctccgcctcctgggttcacatgattctcctgcctcagcctcctgagtagctgggagtacagcctgctttggcctcccagagtgctgggattactggtatgagccactgtgccctgccttttttttttttctttaatgtttgtattgaggtgtaatatgcaataaaaggcacatatttaatgtgtacaatttgatgagtttgatatttgtatatgcccatgaaaccatcaccagtcaagataatgaacatgtccatcactcctctaaaactttcctcctgcctctttgcaatttcaccatcttgtttgcctgctgcccccatccctaggcatccactgatctgctgttattatacattagtttgcatttcctaaaattttatataaatggaatcatactatatgtatgacttttgtctgattttttttaatgcagcataattattttcagattcatccatctttttgcatgttttagtagtgactttttgtggttgggtgatatttctttttgtggatataaagggagggttgttgatcttcagggattatttattttcattttaaaagtttctcctgaagtagtattttgtttttgaaaatgtgctttgaaagaaatttgtttagaattcatttggccctaaaatccacgtaattaatgatttaatgagttaaatagtgatttaactatataaatatagtttgctaccatgtttgctatgtgccaggcttgatggtgcttgtagggcacagaagaggttcctgtcctagccagtggttgatgtgttcaggagggcctatcagtagtgcactagtgcaccatatcctacatgtgatagagctgccgtgttcttagacacaaagacagctgttatgctgtctttgcaaaaatgttgaggtcttgctttccacaggcttgtggcctgatgcacgtttccagttttgcacaatgtcacagcagatatgccttccacgcccttggtttttcacagccaggcatggggctggaatctcagagctgcggttgctgtggttctctgattcctgctcagaggattgcgtgatgggggctggagtgcaggcaggaagttagccttgtggattccctcatcctcacaaagccaggcgcacagggaggggttgggggtagggggttgccatgggaatttcttccccagccagagagccagggtggagtgtgttgctggggagttggaaatgtaccctcttttccatatccattgttcagtcacgttctcctgaaagaagtcttcttactgtgtgtaagaaaaatcagtaagcctctgataaatagtcaaagactgtcagaaaagggaccttggaaatatctggtccagcctgcccattttataggtgaggaagctgaggctcagcaagcaggagtgactcaggaataagcactcatagcacagctgggacttgggaaacccaggcactgctttagaccttcattttcacaatccacgaaggggggagtttgaagaaggcttggcaaaatttgatagacctgggaaagagattgttaatctctcattctgtgctcaaggatgctgtgccatttaaaaaacaaaaacaaaaaacagaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgacctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaagcgtgcagtctgcccacaggaagtgattcatggtgctccgattcgggcagacctgactgcaggaggcgggaggctgggaaccaggtctgggaaaagagggcagagagaggatacccagacctaatggcttctgctctgtggaagaaagtgaaaaacagaatgactaagagtcctgtaataagaattgtttgttttgtgaagttgaactaatagtgaggtttgccggcagataagacttgagaaattgcagttgtcaggggaggggacttttccatgtcctgctttttttttttttttttttttattaagagagcaaagctatttctcagtcttttttttttttttttttttttttttgagatggagtctctctctgtcgcccaggctagagtgcagtggcacaatctcggctcactgcaacctccacctcccaggttcaagtgattctcttgcctcagcctccccagtagctgggattacaggtgcccaccaccatgcctggctaatttttttgtatttttagtagagacggggtttcaccatgttggccaggttggtcttggaactcctgacctcaggtgatctgcccaccttggctacccagagtgctgggattacagacgtgagccaccacgccaggccttatatctcagtcttaagacattcatatattagtggaaggcccagatttgtgtttcagttctaccttgccacctctaagcctgttttcttttctttggagaagagggtctaagatgagaccattatctcacagtctccaatagctctttctccccattttcccttttatttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcacccaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgtaatatatgattatacatagtaacaatcatatattacataataattgtaaactatgtaataataatattgtaatatatgattgctagatatttgaagctatataatatattattgttaagtataatcatcttacagtggtttaggacactagaactgatttttcctctttagctgtaattttgagacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagcgagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccctttcttccagtagtcacagaccaacccagatctttgtagcatcttttatttgtgacttgaaagttctatgatcctgctgacactcaagaaaaagcaatccccatcaacttggtgcttggagaaaaaagtttgtgaagaccaaagctattaaatagaaaagccctaaacactctcctcctcctcctccttcaatatttaaccgtcttctttgcatgggggaagggaggggctctcaccacagccaaaagagaatctctgctgatttaaacccagtgtgctttgtagtcatagagaactgagtttggagtgtaacatctaggttcaagcccaggcactgttccttgctgggtgactttgggcaagtcactcagcatcaaaaatttttcatctgtaaaatgggagtgatgagatactcagcctgcaggatccctttatccagtgagttactgagtgagaagtgctgggtaaacgcttgctctgaggtgtaaattgcttctgtttggccaggtgcagtggctcacgcctgtaatccaagcactttgggaggctggggcaggtggatcacctgaggtcaggcgtttgagaccagcctggccaatattgtgaaaccccgtctctactaaacatgcaaaaattagccaggcgtggtggtgcatgcctgtaatcccagctacgcagaaggctgaggcaggagaatcacctgaactggaggttgcagtgagccaagatcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagccccctagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgggaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagggtgtagtatattcagtgtacatcctgagttctgtttgtaactctttgattccaagcttcagaaaattacaattataggctaattttttatactactactaatcgtaatataatcaaattatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagttattaatgtgctacttggggctacttcaaaaaatgaatattagaggagtatttgggggtaagttcacattttatgcaaattgactctaaggcctctaggtaggttgtccttctgaaatggttaagtcttatccagcttcaagatctgggcataggggtatgccccatttagaattagggaaaagaatctgagtcatgcagcctagcttcactttatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctgcctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgttgttactattactactcaatgggcaagttgaaaaagaaagtttgtctgaaagtgactagaaagttcggtattaagagcatgtgtgtgtattcaataaaataggtttcaactgaagtgtgataatgttaacaaatttactctttgttcacttctatggcccagttaactggcacagttcttgggatatggtaggtattcaataactatgctgtgattgatgaatggtcacttttaataatggtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagtatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttactttgccggccactatcatagtaagcaggcagtaatagttacatgacaatactgacaatagattcctgccactttctggaatatctttctgggtagtgtctgttcaaatcatatatctctttttttaaaaaaattggattgttaatactgagtgttcttactaatatttcattaaaaaaatttttttaatccctctgggggaaaagaatttttttttttttgagacagattctcactctgtcacccaggctggagtgctctggtgcaatcacagctcactgcagcctcaacctgctgggttcaagcaatcctcccatctcagcctcccgagttgctgggactataggcatgggtcaccacgcccagctaatttttatattttttgtagagatggggtttcaccatgttggccaggctggtcttgaattcctgggatcaagtgatccacctgccttggcttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatgacaaatgatgatatatgtatatacctatgaaaccaccatagcagtaagagaatatacataacctttacccccaaaaaagtttccaagtgcaccttggtaattgctccctccaatccctactccctccctgtaactccctctgtccccaggcaatgactgatccctgctttctgtcactagattaagattagtgtgccttttactttagtttaaattaccttataattttacacgaacagaatcatgcctggcttctttcacgcagcatcattaatttagattcattcatagcgttgcatgtatcagtagttgatccttttttgttactgagttgtatttctttgtatggatatgttatggctcattcatctgttaatacatgtggagtagttttcaatttggggctattacattcatgcacaagtctttggacataggcttttatttctcttgggtaaatactttgaagtggaatggtggatcatatggtaggcttatggttttttagctttttaagaaacttccaaatgtttgagggatgaatatcccaattacccagatttgatcattacacattgtatgcttgtatcaaaatatcgcaagtaccctataaatatgtatagctactgtgtatcccccaaaataaaatattttagaaaggaacttccaagctgttttccaaaatagttgtaccattttacatttgcaccagcagtggaagggagttccagttgttccacatccttgccaatacatggcatgatcaggctttttaattgtagccattctaataagtatgtagtcctatctcattgtagttttaatttgtgcttctctaatgatcaacattgtcaagcatcttttcatatgcttgttgtcttcatatctttctgggtagtgtctgttcaaatcatgtatctcttttttaaaagattgaattgttggctgggcgcagtggctcacgcctgtaatcccagtactttgggaggccgaggcaggcggatcacgaggtcaggagttcgagaccatcctggttaacacatgaaaccccgtctctactaaaaatacgaaaaattagccgggcgcggtgccaggcgcctgtagtcccagttgctcgggaggctgaggcaggagaatggcgtgaccccaggaggtggagcttgcagtaagccaaggttgtgccactgcactccagcctgggcgacagagcgagactccatctcaaaaaaaaaaaaaaaaaaaaaaaaaaaaaaaaaaaaaaaaaagaagattgaattgttaatattgagttttcagagttctagaaacaggtctattatcaaatatacgctttgcaaatattttctcttagttagtgcttgcctttttattcctttaacagtgtctttcaaagaccagaggcttaaatcttgatgcggtctgattttttttttattattattaagtgctttttggtgtggtatctgagaaatcattgtctatcccaaaaagtcacaaagattttctcctgttttcttctagacattttagagtttaagtttcacttcagtttgtttttgtatagggttacaatgtgtagtttgaagattatcttttttacatatccagttgttacatcaccatttgttgaagactgtccttgctccactaaattgtctttggacctttgttgaagccagtcgtccatatatatgtaactatttctggactctgttaggttccattgatccgtttgtcagtccttgtgccattaccatactgccttgattattgtagctcccttgtttttaaaagtttaattaatatccaagtgattcatgtatgattaatattactactaaggcaagagggccacccacttctatcacctagatggagcttacctccacagccccattctcccccgctgctggcatgagcttttctccaaggccttctcttgcagaggaggctatgatgtccagctggcccttttttgggagttttgtcaaacaccgaagagcaaatacggccacttccctaatctgtgggcacccagtggctttgcaggagaaggagaacagctgaataattctctattcccactcaccacttcccactctcccttttactcctgttcaacctccagctcaccctacttatccagggctgggtttggggagtatctgctgtgatagagaataataacgctaatttgtgggtgtttatgaagcactttcaaatggaaaccaagcttcaggaggtcggggggcagaataccccattttatagatgagaaaactgagtgtcctaggaagctcatgagctgcccagtgtctcccagctaggagagtagaaccctcctttaccccaggtcttatggctccacatccgccagtcctccttttatacctcagggacgagtcccaggctgtcttctcgatctgcctggtaattactgtttttcagctgtagggcttccttgttctggggccccaagggaggaaggtaattacatccttcaagatgcccttagtcagcagctccaggtcagttcctgtgaccaagcccagctatgacctttgtctgtcctttccccttcccaggccagtggcttggagagtgtgattggatccctctgtttctctctttggttggtgctgttggtggcatctggccagcccttccttcacagagtgcccatgaattctctgtattcaggcaaatgggtgccctcggtcataagaaggcacagagggaaagcttgcaaatgtctcactgccagccctgccagctattagaaaaattatggcactgactggcagggtcctaggatgggcctccttgaagaaaaagcagtcctgcctcttaatagggtacctgtgactcatgagcatccatctcatctgctccccacttctatccctgctacccgcaatctgttggtcacacgtagccagagttccacagggcctgtctctttcacacgtatgcacagcccacttacacatctcagaggctacatactgcttttagaaaacaggagaagcctttatcatggcctttggggccctgcagagtacccctgcctgcctccccggcctcgtctcaagccagctctctctcatgatcccctctccagtccttctggccttcattctgttcttccgacctcaccatgttttccactttccacagggcctttgtgtgtgcctttccctctgcttgtactgcccttctcccgcacccctttgcctggttagttcttacttaccctttaggccttcaggtcaaccatcacctcctctgagatgccctgtccagtccttcagcaaagtggggtgccatggtcatacactcttggggttccttgttattttcgttcaggacactttcattgtgtgtaattgtaggtttctgtgatgatgatgatgatgatgatgatgatgatgatgatgatgatttgaaacggagtcttgctctgtcgcccaggctggagtgcagtggcacaatcttggctcactgcaacctccccctcccaggttcaagtgattctcctgcctcagcctcctgagtagctgggattacaggcgcccgccaccatgcctggctgatttttgtacttttagtagagacagggtttcaccatgttggccaggctggttttgaactcctggcctcaagcgatccacccgcctcggcctcccaaagtggttttggtgattatttgattaatgccggtcttgcccagtggaatggagggtccctgcagacagggaccactttgctggccttttctcatagtgaagtctctttccttaccactgtatccttagtgtcacacataataggtgctcattaaatatgtgttaaataagggactccattttagtggcacctcctcacctgtctaataccagacactatctgaagttttacgtccctccagaagccttctgcctcccagccttgcctgtagctgacaatgcttttgccgccccaagctccccagtcctttcctgtaagccacccagactctcatcatccagatcacctggggatttcacaaagggaaagattctgatttagtaggttggggtaggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaacaccctgtatcaaaagtaaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgccactccctgaagagcagtacaaagttggggaacccaccggggactggtgggtgaggcccgctctgccagctgggagtcctcacggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcagtcctgtggccccaatctctgccccctggccgtcccccgctcaccccctctttgcgcacagctctggcctgagggcccctgactcagaaccgcatccctgttgggagaggacccatgacctcagctcccccctcactagtgatgcttttcttggcatagaggagcagcgtgacccttccgcccggccttggtgcagtcatttattttggaagcggaaatagcaacactgtttctctcaccgcccttgaggcccggactggtgttcagtcccaatagactgggggtctgcagaggcggggagtgagctgagggccaggcagcaagtgcggagagctggctctgtaaattcgcctgggcatcaggcctcggtgaggggctccaacctgggtgggaattgaagtgactttgagttttcactctgcagggagaaatgggctttgccgtcaaagactgcaaatgtttttagaagcccctcatttacatgcaaataacgtgtgaatcaccagcactttcagactccaggaaagctgtgcttggcagcacttgggctagtcacttttgcttgctggggcagtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccgtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaagaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcctgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcgccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctgaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttctttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtgaagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaaccagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 1991 - DNA, 57175 bp, Homo sapiens
  source 1..57175: mol_type = genomic DNA
acaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctctgggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatttgcggaagagggttccagagtgtggggagagcgtgctggggaggggagctatttgttcctttccagtcatcgctgtactgagcggttccctgggacagttgaacccaggggaactgaattcatctgtgtaagtaaacatccatctccccttaaaggaaaagcccctgctcagcctctctgggcagctggaatgctgctctgtgggtctgggcatttgttccttctttctttcttcctttgatttcttgctgtctccttcaattaggcctgtgactgttttcacatggctatttgtatatacaagccatgccaggcatcataatttgtgtttgtctagatcaataagagcagctttaaccaaaaagtccagctgagaatttataaatacccctcacctcctcccctccctggaagatgtgaaaacaccatcccattaaccctccaaagcagttggttgacttgatcagggaagatatgaaatataatttctttgaatgtgctttctctttactcttttagtggaatttgatcagtgtttaaggaactgtagccgattcccagcccacttcaaagcaaaagcccttcactgtgcctatttgcaaaattacctttgagagactgaagtgtcggaaatgcatttagacacagattgtgccttatattagctctccgttgccccataaaatgggcttgggcatatctgaggcagctaccaaaggaaacttaaaaacagattctggcggcagcgattcttgtgttctgtgctcactgtggaaaagaagggggctagagggatttaagtttacgtggatcttgaggattttaagaaccagatttcttctctttgctcacattaggggaaaaaaaataaacctcagatgccccgtgatatctcgttgcgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccaacttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcatcctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcaggcaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaataatgacaccaggtcaacacatgcgaacccaactgtcctgaacaaacgggggtttgtggttgcgctacaaaacccaggcttcagtctcttcgagttctgttttgatttggaaggagtgacgccttcccctttggaagcttaggctagggttgcaagctgaggtgttcacagggacagacagagtgtgggaaatggggccaggtgtaaggaaacggagcagaacttggggttcattcatagtctaaagggggcattggcaagtcggcatcagacagtagcaacttgttgccagatcttctgagtttttttcaagagaagccaaaaatcaagatttacacacaaaatctcccagtttgtaaaagttggcaaccatttaaaaattttaaaaacgctctgcaggccaagcacaacatctgtgggcagtgggcagctgcctgtttttgacctccagcccagaccgatcaattgatggctgtcttctgggtctcccaattccggcaacgggaagtttcttaaggaagttgcctgggctgaccgcaagtgaggtggggaagtggaaagggagcttgacttggcttcgattgatcatttgcacaataaatatttattgagcacctgttatgttcaacgtactatctgtgttgtgccatgtttcctagtctacattttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaacatttactgtacctccatggtttgcgtggaattgtactagaaacactcaaccccggggctttgttggcaataaactaggtctttctgcagaacttttgaggacaaatcaccaatgggttggaaagcatttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaagtaacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtgattctctaatgccagcttgaaattcggtgacccaccttgggatgctttgcctgtcaaggtttttcaatgatgaatagttgttatgagcatgtcagccagaatggtacttttcaagtcattcagtaatggatctgtatgattattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagcccaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcactgtcgcctgggctagagtgcatagtgtgatctcggctcctgccgccacacacagatcataatgtgatctgcaacctccgcctcctgggttcacatgattctcctgcctcagcctcctgagtagctgggagtacagcctgctttggcctcccagagtgctgggattactggtatgagccactgtgccctgccttttttttttttctttaatgtttgtattgaggtgtaatatgcaataaaaggcacatatttaatgtgtacaatttgatgagtttgatatttgtatatgcccatgaaaccatcaccagtcaagataatgaacatgtccatcactcctctaaaactttcctcctgcctctttgcaatttcaccatcttgtttgcctgctgcccccatccctaggcatccactgatctgctgttattatacattagtttgcatttcctaaaattttatataaatggaatcatactatatgtatgacttttgtctgattttttttaatgcagcataattattttcagattcatccatctttttgcatgttttagtagtgactttttgtggttgggtgatatttctttttgtggatataaagggagggttgttgatcttcagggattatttattttcattttaaaagtttctcctgaagtagtattttgtttttgaaaatgtgctttgaaagaaatttgtttagaattcatttggccctaaaatccacgtaattaatgatttaatgagttaaatagtgatttaactatataaatatagtttgctaccatgtttgctatgtgccaggcttgatggtgcttgtagggcacagaagaggttcctgtcctagccagtggttgatgtgttcaggagggcctatcagtagtgcactagtgcaccatatcctacatgtgatagagctgccgtgttcttagacacaaagacagctgttatgctgtctttgcaaaaatgttgaggtcttgctttccacaggcttgtggcctgatgcacgtttccagttttgcacaatgtcacagcagatatgccttccacgcccttggtttttcacagccaggcatggggctggaatctcagagctgcggttgctgtggttctctgattcctgctcagaggattgcgtgatgggggctggagtgcaggcaggaagttagccttgtggattccctcatcctcacaaagccaggcgcacagggaggggttgggggtagggggttgccatgggaatttcttccccagccagagagccagggtggagtgtgttgctggggagttggaaatgtaccctcttttccatatccattgttcagtcacgttctcctgaaagaagtcttcttactgtgtgtaagaaaaatcagtaagcctctgataaatagtcaaagactgtcagaaaagggaccttggaaatatctggtccagcctgcccattttataggtgaggaagctgaggctcagcaagcaggagtgactcaggaataagcactcatagcacagctgggacttgggaaacccaggcactgctttagaccttcattttcacaatccacgaaggggggagtttgaagaaggcttggcaaaatttgatagacctgggaaagagattgttaatctctcattctgtgctcaaggatgctgtgccatttaaaaaacaaaaacaaaaaacagaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgacctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaagcgtgcagtctgcccacaggaagtgattcatggtgctccgattcgggcagacctgactgcaggaggcgggaggctgggaaccaggtctgggaaaagagggcagagagaggatacccagacctaatggcttctgctctgtggaagaaagtgaaaaacagaatgactaagagtcctgtaataagaattgtttgttttgtgaagttgaactaatagtgaggtttgccggcagataagacttgagaaattgcagttgtcaggggaggggacttttccatgtcctgctttttttttttttttttttttattaagagagcaaagctatttctcagtcttttttttttttttttttttttttttgagatggagtctctctctgtcgcccaggctagagtgcagtggcacaatctcggctcactgcaacctccacctcccaggttcaagtgattctcttgcctcagcctccccagtagctgggattacaggtgcccaccaccatgcctggctaatttttttgtatttttagtagagacggggtttcaccatgttggccaggttggtcttggaactcctgacctcaggtgatctgcccaccttggctacccagagtgctgggattacagacgtgagccaccacgccaggccttatatctcagtcttaagacattcatatattagtggaaggcccagatttgtgtttcagttctaccttgccacctctaagcctgttttcttttctttggagaagagggtctaagatgagaccattatctcacagtctccaatagctctttctccccattttcccttttatttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcacccaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgtaatatatgattatacatagtaacaatcatatattacataataattgtaaactatgtaataataatattgtaatatatgattgctagatatttgaagctatataatatattattgttaagtataatcatcttacagtggtttaggacactagaactgatttttcctctttagctgtaattttgagacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagcgagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccctttcttccagtagtcacagaccaacccagatctttgtagcatcttttatttgtgacttgaaagttctatgatcctgctgacactcaagaaaaagcaatccccatcaacttggtgcttggagaaaaaagtttgtgaagaccaaagctattaaatagaaaagccctaaacactctcctcctcctcctccttcaatatttaaccgtcttctttgcatgggggaagggaggggctctcaccacagccaaaagagaatctctgctgatttaaacccagtgtgctttgtagtcatagagaactgagtttggagtgtaacatctaggttcaagcccaggcactgttccttgctgggtgactttgggcaagtcactcagcatcaaaaatttttcatctgtaaaatgggagtgatgagatactcagcctgcaggatccctttatccagtgagttactgagtgagaagtgctgggtaaacgcttgctctgaggtgtaaattgcttctgtttggccaggtgcagtggctcacgcctgtaatccaagcactttgggaggctggggcaggtggatcacctgaggtcaggcgtttgagaccagcctggccaatattgtgaaaccccgtctctactaaacatgcaaaaattagccaggcgtggtggtgcatgcctgtaatcccagctacgcagaaggctgaggcaggagaatcacctgaactggaggttgcagtgagccaagatcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagccccctagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgggaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagggtgtagtatattcagtgtacatcctgagttctgtttgtaactctttgattccaagcttcagaaaattacaattataggctaattttttatactactactaatcgtaatataatcaaattatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagttattaatgtgctacttggggctacttcaaaaaatgaatattagaggagtatttgggggtaagttcacattttatgcaaattgactctaaggcctctaggtaggttgtccttctgaaatggttaagtcttatccagcttcaagatctgggcataggggtatgccccatttagaattagggaaaagaatctgagtcatgcagcctagcttcactttatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctgcctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgttgttactattactactcaatgggcaagttgaaaaagaaagtttgtctgaaagtgactagaaagttcggtattaagagcatgtgtgtgtattcaataaaataggtttcaactgaagtgtgataatgttaacaaatttactctttgttcacttctatggcccagttaactggcacagttcttgggatatggtaggtattcaataactatgctgtgattgatgaatggtcacttttaataatggtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagtatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttactttgccggccactatcatagtaagcaggcagtaatagttacatgacaatactgacaatagattcctgccactttctggaatatctttctgggtagtgtctgttcaaatcatatatctctttttttaaaaaaattggattgttaatactgagtgttcttactaatatttcattaaaaaaatttttttaatccctctgggggaaaagaatttttttttttttgagacagattctcactctgtcacccaggctggagtgctctggtgcaatcacagctcactgcagcctcaacctgctgggttcaagcaatcctcccatctcagcctcccgagttgctgggactataggcatgggtcaccacgcccagctaatttttatattttttgtagagatggggtttcaccatgttggccaggctggtcttgaattcctgggatcaagtgatccacctgccttggcttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatgacaaatgatgatatatgtatatacctatgaaaccaccatagcagtaagagaatatacataacctttacccccaaaaaagtttccaagtgcaccttggtaattgctccctccaatccctactccctccctgtaactccctctgtccccaggcaatgactgatccctgctttctgtcactagattaagattagtgtgccttttactttagtttaaattaccttataattttacacgaacagaatcatgcctggcttctttcacgcagcatcattaatttagattcattcatagcgttgcatgtatcagtagttgatccttttttgttactgagttgtatttctttgtatggatatgttatggctcattcatctgttaatacatgtggagtagttttcaatttggggctattacattcatgcacaagtctttggacataggcttttatttctcttgggtaaatactttgaagtggaatggtggatcatatggtaggcttatggttttttagctttttaagaaacttccaaatgtttgagggatgaatatcccaattacccagatttgatcattacacattgtatgcttgtatcaaaatatcgcaagtaccctataaatatgtatagctactgtgtatcccccaaaataaaatattttagaaaggaacttccaagctgttttccaaaatagttgtaccattttacatttgcaccagcagtggaagggagttccagttgttccacatccttgccaatacatggcatgatcaggctttttaattgtagccattctaataagtatgtagtcctatctcattgtagttttaatttgtgcttctctaatgatcaacattgtcaagcatcttttcatatgcttgttgtcttcatatctttctgggtagtgtctgttcaaatcatgtatctcttttttaaaagattgaattgttggctgggcgcagtggctcacgcctgtaatcccagtactttgggaggccgaggcaggcggatcacgaggtcaggagttcgagaccatcctggttaacacatgaaaccccgtctctactaaaaatacgaaaaattagccgggcgcggtgccaggcgcctgtagtcccagttgctcgggaggctgaggcaggagaatggcgtgaccccaggaggtggagcttgcagtaagccaaggttgtgccactgcactccagcctgggcgacagagcgagactccatctcaaaaaaaaaaaaaaaaaaaaaaaaaaaaaaaaaaaaaaaaaagaagattgaattgttaatattgagttttcagagttctagaaacaggtctattatcaaatatacgctttgcaaatattttctcttagttagtgcttgcctttttattcctttaacagtgtctttcaaagaccagaggcttaaatcttgatgcggtctgattttttttttattattattaagtgctttttggtgtggtatctgagaaatcattgtctatcccaaaaagtcacaaagattttctcctgttttcttctagacattttagagtttaagtttcacttcagtttgtttttgtatagggttacaatgtgtagtttgaagattatcttttttacatatccagttgttacatcaccatttgttgaagactgtccttgctccactaaattgtctttggacctttgttgaagccagtcgtccatatatatgtaactatttctggactctgttaggttccattgatccgtttgtcagtccttgtgccattaccatactgccttgattattgtagctcccttgtttttaaaagtttaattaatatccaagtgattcatgtatgattaatattactactaaggcaagagggccacccacttctatcacctagatggagcttacctccacagccccattctcccccgctgctggcatgagcttttctccaaggccttctcttgcagaggaggctatgatgtccagctggcccttttttgggagttttgtcaaacaccgaagagcaaatacggccacttccctaatctgtgggcacccagtggctttgcaggagaaggagaacagctgaataattctctattcccactcaccacttcccactctcccttttactcctgttcaacctccagctcaccctacttatccagggctgggtttggggagtatctgctgtgatagagaataataacgctaatttgtgggtgtttatgaagcactttcaaatggaaaccaagcttcaggaggtcggggggcagaataccccattttatagatgagaaaactgagtgtcctaggaagctcatgagctgcccagtgtctcccagctaggagagtagaaccctcctttaccccaggtcttatggctccacatccgccagtcctccttttatacctcagggacgagtcccaggctgtcttctcgatctgcctggtaattactgtttttcagctgtagggcttccttgttctggggccccaagggaggaaggtaattacatccttcaagatgcccttagtcagcagctccaggtcagttcctgtgaccaagcccagctatgacctttgtctgtcctttccccttcccaggccagtggcttggagagtgtgattggatccctctgtttctctctttggttggtgctgttggtggcatctggccagcccttccttcacagagtgcccatgaattctctgtattcaggcaaatgggtgccctcggtcataagaaggcacagagggaaagcttgcaaatgtctcactgccagccctgccagctattagaaaaattatggcactgactggcagggtcctaggatgggcctccttgaagaaaaagcagtcctgcctcttaatagggtacctgtgactcatgagcatccatctcatctgctccccacttctatccctgctacccgcaatctgttggtcacacgtagccagagttccacagggcctgtctctttcacacgtatgcacagcccacttacacatctcagaggctacatactgcttttagaaaacaggagaagcctttatcatggcctttggggccctgcagagtacccctgcctgcctccccggcctcgtctcaagccagctctctctcatgatcccctctccagtccttctggccttcattctgttcttccgacctcaccatgttttccactttccacagggcctttgtgtgtgcctttccctctgcttgtactgcccttctcccgcacccctttgcctggttagttcttacttaccctttaggccttcaggtcaaccatcacctcctctgagatgccctgtccagtccttcagcaaagtggggtgccatggtcatacactcttggggttccttgttattttcgttcaggacactttcattgtgtgtaattgtaggtttctgtgatgatgatgatgatgatgatgatgatgatgatgatgatgatttgaaacggagtcttgctctgtcgcccaggctggagtgcagtggcacaatcttggctcactgcaacctccccctcccaggttcaagtgattctcctgcctcagcctcctgagtagctgggattacaggcgcccgccaccatgcctggctgatttttgtacttttagtagagacagggtttcaccatgttggccaggctggttttgaactcctggcctcaagcgatccacccgcctcggcctcccaaagtggttttggtgattatttgattaatgccggtcttgcccagtggaatggagggtccctgcagacagggaccactttgctggccttttctcatagtgaagtctctttccttaccactgtatccttagtgtcacacataataggtgctcattaaatatgtgttaaataagggactccattttagtggcacctcctcacctgtctaataccagacactatctgaagttttacgtccctccagaagccttctgcctcccagccttgcctgtagctgacaatgcttttgccgccccaagctccccagtcctttcctgtaagccacccagactctcatcatccagatcacctggggatttcacaaagggaaagattctgatttagtaggttggggtaggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaacaccctgtatcaaaagtaaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgccactccctgaagagcagtacaaagttggggaacccaccggggactggtgggtgaggcccgctctgccagctgggagtcctcacggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcagtcctgtggccccaatctctgccccctggccgtcccccgctcaccccctctttgcgcacagctctggcctgagggcccctgactcagaaccgcatccctgttgggagaggacccatgacctcagctcccccctcactagtgatgcttttcttggcatagaggagcagcgtgacccttccgcccggccttggtgcagtcatttattttggaagcggaaatagcaacactgtttctctcaccgcccttgaggcccggactggtgttcagtcccaatagactgggggtctgcagaggcggggagtgagctgagggccaggcagcaagtgcggagagctggctctgtaaattcgcctgggcatcaggcctcggtgaggggctccaacctgggtgggaattgaagtgactttgagttttcactctgcagggagaaatgggctttgccgtcaaagactgcaaatgtttttagaagcccctcatttacatgcaaataacgtgtgaatcaccagcactttcagactccaggaaagctgtgcttggcagcacttgggctagtcacttttgcttgctggggcagtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccgtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaagaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcctgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcgccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctgaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttctttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtgaagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaaccagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 1992 - DNA, 29041 bp, Homo sapiens
  source 1..29041: mol_type = genomic DNA
cttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccgtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaagaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcctgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcgccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctgaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttctttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtgaagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaaccagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 1993 - DNA, 54829 bp, Homo sapiens
  source 1..54829: mol_type = genomic DNA
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggtaaccgcgccatgtcccctccccttcccccggccgggcccgcgcaccccgcctgtggcttccccgccccggggcgggctcccgacgacggcggcggcggcggcggcggctgggagcgcgcggaatcctctgggagggcgaccgcggcggcctgacgagccgggccgggcgggccggctgaatgccgggcggcggtgcctcgcgtccctcgggcccccagctccgcttgcagctcgtgggagaatcaagttaaactcggacgggactcctgccgcggccgccgctcctctttgttgttctcagtagtttcacggtcgccccggctgagcgcgttgggtcggctggaatgtgttgccttagggtctaagtgaaagttgtaaattgtttgtctaaatttattttctccagccaatttctgttttgtctttgtcccctactttctcttcctagtcttgtcatgccagtttacgcttctggctttgatatgtttactttttgagtactgagagtgacagcggtatgcaggacacattcttagcacctaactgaacccctccttgcccccaataaaacatgcttcctaataaaagacacagctgatcttactgttagcactgcatgtactgacagtgaaattggtgtagggtggagggcggtggctccatcacttgtcccaaactgctgttaggatttctcaaactagattttcaaagacacaagtgtgtttagttaacctgaaaggtttatttgctggtgcagaggctttaaaaagccctgttgaagattgatagctgtttcccttcaaaaacctaagtacgtttgtttttatttaaaaaaacacatttatttcccaattagtttcttaatgcatttagtttttgcaccgtagtttaaggtggaattgccagttatttaggaataataaacacaacaggataatagcggaattaccctgaattgactttctgcaaacatataatcttagctaatttttgttagtaacctttgacttttgccagaattagcatccttctagtcttagtagcagcttggttactcgggtgttttaagaagtaggttcactcctttttgctggcaaaaaccatttagtatcaaaaaaaaaaaaatgcgtaatttcgtaattagatttagaacaaggcatttgaataatttttatggtggatttcataaattacttttgccataccctgcagagactagataatatatatttcagttgaaatctaggaagttctaaaatgtaacttttttttaatgctaaggacttactctctctatattggaaagttctgatatgattagtacataatattccaaactgtaaaatgattaacatttaaaaatacggtttttaaaattagtgtttcttccataatgctgtcatgattttgtttacttaaatgggtttgttacagaacaaatgtaatagagatggaccaagcatttgtaattcggagtagctttaggtctaaagacgatggtgaattatgtaggtttaagttgttggaattaaaactaaaagcttcttttgataaaagtcgttataacattttgtgactctattaatagaagtggctttttctttgctttccaggtttttgggcgagttttaaagaagtattgcatcttcgttttttttatttttgaagtgggagtgtatgtttctgtttaggtcactgccttcattgtaaatcttgagtttagaaaaaaccaaactgcaaatctgtttttcagacttaatgaaaatttgtgccgagaaagtcactttgaaatattttggaataagttttacatgaatgattgatcttttatgatagctttgctgtttgaagcaattctccctctactaggaagcagcaaatcttacttttaaaaacctctgcttcactttcttaagctacattttagtcgagcgattgtgtgtgaattctttttctgtattccccttcagtttttctttctccccgcaaattaaggagcgagaattaacctaatttatgctgcccagtcacactccagctctcccacttggaagcagtttttttctgattgagccagtgttatagtaacatcattagacactattctaattgaggtgtgagttactgaggcctctgctagggaggttaaccctacagaatctgtagggttcattatatttaaactgcatatttcggcttgtctaaatttttgcctattttggtgaaaacatgttgttttgtcgatgtttaaacttagttcattttgtccctctctagttcatgactaaccatttttttcatttttaatccagcgatttttttagagtggttctttaagcatcttgtattagccatttcaatggtcattatatatgtttggatttctcttattttgttgaactagaagactgtgtggttacgccccaaaatttttttttgtcttaaagccatgatgaatggggtgactctgaggtgaccattaatcgcgtataaaagtaacctgactaaaatgttttcattgttttctacagttaaaggacttacaccagcataacacagcatttttttttttttttttttttgagatggaggctcgctctgttgtccaggctggagtgcagaggcgcgatctccactcactgcaaaccccgccttccgggttcaagcgattctcctgcgtcagcctcctgagtagctgggattacaggcatgtgccaccacgcttggctaatttttgtgtttttagtagagacgaggtttcgccatgttggccagactggtcttgaacaactgacctcaggtgatccgcccgccttggcctcccaaagtgctgggattacaggcgtgagccactgcgcctgtcctataacagcatttaatacagttttgtaaaattatcacattttgggctttttgttcaacagttgatgaagtctcaattgttttaaaatgagaaattcaaacagttcacaaatatatctagatatattcatttgagctacttgtagaatgatgctgtttgcatatatcaagcatatgcttgatcataagtcagatttagaatttttggattttgttttctctttctaaaatgtgtaattttggtaatgggaaatttgactgaattccagtttctcaggaacaaggtattttaggttgtgtcaccttaacactattacctggtgtaattggcatccgggaacatttgtttttaactatgagagtgaatgaaaactagggtagtgcttacatatgtaaaactaagatggtaggtagtcggattcttacaatttataaggttctcataatctaagccttgatgagttgctactgcaaattatattatagatcagataagtaccaaagaccagttgtaaagagggtctgttaacattttaatcagtttaaaattggcggtaacagtaaagaccgttcagcccaaagactgtatttcattatttatattccaaatgagaattttttgcagtttggaaaacttgtaaatgtgttgaattcatctttttattgcttttttactcccaatgtttagggcaacggtcttttcttctctcctgtctccctccctccctccctttctccctttttcttctttttcttctttttctttttttttttctgagacggagtttcgctcttgtcacccaggctagagtgcaatggtacgatttcggctcactgcaacctccacttgctgggttcaagcgattcccctgcctcagcctcccgagtagctgagattacaggcgtgcgccaccatgccaagctaatttttttgtattattagtagaggacggggtttcaccattttgggcaaggctagtcttgaactcctgacctcaggtgatccacccgcctcagcctcccaaggtgctgggattataggcatgagccaccgcgcccagcctttttttcctttttctttccatcttgctcagtgccccagcctggagtacagtgctgcaatcatagctcactgcagcctctaccacccaggctcaagcaatcccacttcagctgctgcggtagctgggactacaggcacacaccatcacacctgtctaattttttgaaaaatttttgtagagatgggggtctctctctgttgcccaggctggtcttgaactcttgggttcaagtgatcgtcccacctcgacctcccaaagtgctgggattaaaggcatgagccaccacgcctggcaagtagttttcaatcttggctgtacttttagatcccttgaggagctttacaaaatactgatacctgaattctagccccagaaattatgatttggttggtctagggtgcagccaggttagccctccgcagtgattgagtcattagggtcctctgactttttcttttgaactgtttcacttgtgttagctttacattctttaatacagtgttacacacatgtacagtgtagccatctcacacatctaacttaacgggtcttttgaaagtattgccacatttgctttgcttctgtgtctgtctctttcttttctctcccccttcctgtcacctattcctttctcctctgtttctttcttcactttcagtttatttgaactgtctggtagtaagttttaggaagctgtatttcccatgatgagaagttagtatatcatcactattttaaataggaagttgattttcttttaaagtatattctcaaatgcttacttgtactccttttggagactaattactttaagtccccaagttagcatctgaactccctgtgggcttggtctggtggctcacatctataatctcagcacttcaggaggctaaggcaagaggatcacttgagcccaggatttcaaggccagcctgggcaacaaagtgagacctcatctctaaaataaataaataaataaataaatataactcccaatgcaaattgtcttcttagggcgttaatctacttggtaaaccttacattttcaagcccccaattaactagtcacttaactggtttctgagaggcaggttgcattgggctttttctgtcagggcttaattaatacactgtgagacatttgctcagctaggccagctagctagtacttctgtagagatcatctagggcatgttcagctctccatttacatcacctgaagtagttcccaagtgctgggctatggagtagtttcatctctgtctctggaagagctatttaaaaaaataaaaatattttttcccatctgattgcaacacacatgctgcttcagaatgggaatggagtggaggaggcatgggaatctgtgttatttttaaaaagtgcctcttgattctaaaggttttgtttattttggtatgcttatccttactgctttatttatctattttttagagacaggttgcccaggatggagtgcagtaacatcatcatagccctctataaccttcaacttctgggttcaagagatcttgcctcagcctccagagtagctaggactacaggccggcaccaccacgcctggctgatttttttaaaactgttttgtagaaatgggggggcgggggtcttgctttgttgcccaggctagccaaatcttatttatgatttaaaactaggaatgctaccgaatatatatttttatagtaaggtattatttctgtatgttaatatggatgaatgtatgctactcaggtcttttcaagtcaaaatgtatttctaaatataagatgaattaaggatatttgtcagtgatattcactagtgaattctagagcatatgttatcagtagatgggcagtccttgtaaaaattgaataatctagtgaaaggatgaccggaaataatatttaatggggtaagctaagccaggaatcattgtacataaacacattaggtgtgtcttacatcataaatatgcctactaaaactagttgaaggaagaatgtgtatagatgctgaaataatgaaggggctggctaattgtaaggaaaaatgatacaacttctatataattagtctttttaatcagttgcatatactcatgatacttaatttgtaaagtaaagattgtagactagatcaatgctttgtaaaactaacagtacctcagacttccagagtgttttttaaaggtacagccccacccttgattctagttagtggagctggcctaacctgcgggggattttgatacatccccctttgaaggaataagctagatgacttgaaactctgcttcagttaaaagttttatgaaatgaggccgggtgcggtgactcacgcctgtaatctcagcactttgggaggccaaggggggtgcggattacctgaggtcaggagtttgagaccagcctgaccaacatggtgaaaccccgtctctactaaaaatacaaaaattcattgggcatggtggcacatgcctgtaatcccagctactcacatgcctgtaatcccagcttcttgggaggctgaggcaagagaattgcttgagcctgggagacagaggttgcagtgagctgagattgtgccactgcactccagcctagctgacagagcgagactgtctcaaaaaaacaaaaaaagttttataaaatgtatttttcagttatcagttattaaaattcagtttggtttccaccatcttttaaaacagtggttcccaaagtatggtccacagactcctggagatccctaggatccttatatttaaggggttcacaaaatcaaaattattttcataatgaaactgagacgttatttgccctttcactgtgaggacatttgtatgggtggtgaaggagcagtggtgggtaaactgctggcactttaaaatgactctaggcagttataccaaacatatgagtcctcattgtgttctttatagtcaaacacacataagcatttgaaaaaatgccggtttcacttaataatccccttgctgcagcagtaaaaaggtttaattttaaaaaaatctctaccttggagtatgtctttttaatagtgtgattaaatgggaagtatgcataaagcatttctgcacattgaagtacagtgttcttttctaggaaaagcacttgtgttattgagctgcaagctgaactagctgctttttagtgggacaccatttttatttttatttaacaggatgacagataagctcagatagctatttagatttgagtatttggcaggtaattccttggaaatgaataaagtgagctggccacttcgaggagaacatttatagccagtgctaaaatctgatgtttcaagtgaaaatcagatttttgggaaactcctgtcactatgacttgccagtttcttaatacttaaagacttttctgatgagatgggtggtgatattaaggaatgtgattaaaaaaaatatgttgggctgggcacgatgatgcacacccatatttctagcactgtgggaggcggaggtgggagaattgcttttggccaagagttcgagaccctgtttctacaataacatataaaaattaggtgtagtggcatgtagttctagctgctcaggagggtgaggtgagaagattgcttcagccagggagttcaaggctggattaagctaggatcgcaccactgcactcgggcctaggctacagagcgagactgtgggggggggggcagtatgaggaagtgtgtcaacactgggaagatctgtgtaactcattgaaccaatattttcccaaatgaccaattcatgttacaaaatcgtgcatgggtaggcgatccgttcaaagtacaacatagacaaatggatttttatatacaccagagccaaaaagttcactgatacagtgaattccacattgcaactaacctttcagaattgccacttgagttttggtgttgaataaaagatgaatatccattgttttctgagaaggctgttaaaatactcctctcttccaattagctgtccatgtgagacacgttttcttcatgtactttaaacaaaacaacatatcatagcagattgaatgcagaagcagatatgggaatccagctgtctcctattaagctaggcattaagagaaatttgtgaagatgtaaaacagtgttactctgattcctgactttgttttagaaaattctgtttttcataagatgtttatattaacgtaatgggtttattattttaaatgaattaataaagcaaataccaaaaattttagtagttttatttatttataatatgataaatatcaatgtatatagcccgcataaaagctatttggtgtctttaataatgaagagtataaataaaggtccaacttggccaacatgacgaaaccctttctctactaaacatacaaaaattagctgggcatggtggtacatgtctgtaatcccagctacttgggaggctgaggcacgagaatcacttgaacctgggaggcggaggttgcagagagctgagaacatgcctctgcagtccagcctgggcaacagactgagactatgtctcagaaaaagaatatgaataaagggatcctgagatcagagagtttgacagctgctgttttaaagtaactatttctatgcattatcgactaaattactgattgattgaattgtttttatggtttgtactatattgctgttatttctaaggacgttagtcattcagtttctgttcagttatcagggaacatgtaagagtcagacttaagtaaaaaggggaattcattggcttggtctggagatagagctgacctcagattgctatatccagggtttcaagcagcatcaccaggactcttgactttgctttctttctgtttctcaggtagtttgcaggctaactatccccagcttcaaggaagcatgaagagggccttcccccccccacccccccacccccccaccccccgtagttccatcggaagtgctagagctatgtcacttgcctgccttgcgttctttttcatcagaaacaacactgtggccagggggtggctctggttagtctgggaattgtcccacctggccagatggggagattctccttggaaaatcagactgctgttttacaaatggagaaatacatgctggtacacaaaaactgatgtccacctatagtactttgttatttcttcttttaacagcctttaatttattaatccaaaaagggtaatttttaaataagatcatttaaactgaaggtggcataccaaaatgacatttaagacacataggtaaacaagaagcatacatctcgatttgtcctttgtcattcatcttaaaagttaaaaaaaaactttttgttgcttttattgctgtataaatgtgctcttggaagttcgccaactgccctcagtttgaagaacctcaacttgctgtctaggatttagtctttagcttgtgctgcagacagttgcactaaccgtgaacacctttttttcctgttggtaaacctaagtttagagtttattcctagtaataacattgatatattaccaggcccagcttttttctcctcccctagttaaatttaagcacttttgcgccgggcatggtggctcatacctgtaatccagcactttgggaggccaaggcgggcagatcatgaggtcaggagatcgagaccatcctggccaacgtggtgaaacttgtctctgctaataatacaaaaattagctgggcatggtgatgcgcccctgtagtcccagctactggggaggctgaggcaggagaatcgcttgaacccaggaggcagaagtggcagtgagccaagatggcaccactgcactccagcctgggccacagtgaaactctgtctcaaaaaaaaaaaaaaattttaagcacttttctcaaatattcccatagtaagtagtttattgatcactgatcaaaacacttacaacttctagaaaatacatgtttgacacatataatacagttaattcaaaagtaaactaacatctgagaaaaaatgtcaacactccttacctaaaatacatgaatttacatgagaacctctctctggccagtattcagcctgtttaattttagagagtatcttaattagtttggttatttggctttctcgtccatttattagtatacctatggtcaacgtcaggtgacagcttacaattaatagcaaggctagaggaaaaacaacaggcagataacaagaatcagctgtctcttcttgctaactctttacctctcataactcttgactgcatctaatacctgtatatgttagtgcctttcagataggcctaacttctcatctcttcaaactcaagatatctaaagctgaatttgttacatacctgcttttaaattttttaatcattgagttatctagaaatgggtcgtcttttatttgtcccccctttttcacccttcatatttcagttggttaaagactccagtcttttctacctagaaatagctcactgatttccccctcccctccttggcccattgcccatgccccagtctaggatcttaccgcttttctggtaattgtttcctaactggttttctatttccttttccaaagctgttctccaggctctcactgaagttttctaatacaaatctaatgctgttttttctcctctttctaccatgaacctactctagacaaagctcttatccgtctctgcttttcctcatcattttccttcagcctggcaaattcttattcgtatgtggtaatccattaatactattctaccaatattctgatggctgtcccctggcacatggtagtattgtgcttctttgtctccctcatccctaccttgaaattaggcatggcccagagtttcttgcattggcactgttgacattttaggctggataatttattttgcgtgttgtccagtgcattgcagggtatttagcagcaaccatggcctttagccaccagatgcccagtagtatccagttgtgaccatatattgcctccagatgttgccaagtgtcccctgagggacaaagttgcccctggttgagaactcctggcatggccttatgactttggccagtcaaacatgagcagaagtggtagcctttaaaagaagatatatgagctgtcctatcccttctcctgccatttaaggacatatgtagaaatggagcctttgtcagtctaatttctgagcgatgacagcagtgcccccagttgatctgtgatgaatgtgtattatatcctaagcagaaaataagcttttgttttaagctactgatcttttgggggttggttgtcactgcagcatagactagccaatcctgactgatacgttgtgccaagacctaggttacctatgaactttccatgctccctcatttatagtcccaaatcactttatacctacttcttttagcatttattacttatgtaataatatgtttgggtcttccagattagtagttctcagtggagtaagtactgctctttaagggatgttgtagaaatttgtggatgggtttggtggattggtggccagggatgccatcctgcaatgtgagagacagcgaataattatcttgcatcccacaagactttcagatgccccagaaattcatgtaggaggaaaatataattagcccagaacctaactctataatatatattcactttgccaggagttaaatttcttttaattcatttttttcttgcctgcctgcctccctccctccttccctccctccctccctccctccctccctctctccctctctctttctctctgttttctttctttttccttcctccctccctgcctccctcccttacttcaggctctgttacccaggctggagtgcagtggcgtgatcttggctcactgcaacctctgcctcccaggctcaagccgtcctcccacctcagccttctgagtagctgggactataggcatgtgccaccatgccccactaattttttgtattttttgtagagaggaggtctcactttgttgccaggctggtcctggcaaccgtgcctttgttgccaggctggtcctgagcttaagtgatccaaccatgtcggcctcttaaagtgctgggattacaggcatgagccactgtacccggacttggttgttttgttttttatttttgagaccaaatcttactctgtcacttgggctggagtgcagtggctcagtcatagctcaccgtagccttggtctcctgggctcaagcagtcctcctgccccagcctcttgttaattcattttcttagttcaagttgtttaagagttcaccatttgggaaaatccatgttactgactgcagtgccattgtgctatttgagttgccagtataacacgtttgtcttggaaggtctgaatttgtagctgtcacatttgtaatgattctgtatataagtgctagcatctaacttctttattatacattctaacttagttggcatgcctgagtatttataggtggaagtacacattatatattaagcttttcctcctttttgttatagttagggcattgttaaattttcaaaatatgtttaagtagtttagaattttgtttcagtaaagctaaggtggtgatataaattatttgttggaaaaaaaatgggatgttggtctgagagagtccagacccactttcttactatgggcttcctgtttttgtatctgtagtgctttgtatatacagtgtttgttgaattggtcaatttatgtttcccacatttcttttatgtacgttgttgcatctaattaccacaataaatttgtgaagttgtcagggcaggtgtttccattttatagatgagagaattgagagagatgttaacattcagtcatgcggctagacctttaattagaatatataattttatttatatcgatattatgctcttgcctaccatacttccataatctagaaccatttaatgtaggaatacatctctttattcctgctagtattattttttatatgcataacttttaattatgtttcaggcacttgtggtcataggaatacaataaagagagagatgagaaagctgtttgtttaagaaagcgaggtcattatcatttgtattcaaagcaacttggtattaaaacaaactttgagataccgttaaggccccagcatagcataaattttagaaatgatgacatttgatggtgagattgtggtgaaatagttaacacttaaacattttaattgcattgtagattcatacacatcttttggaatataatatcagaaaatgacttcaaaagtgtctgcactcttctaatttgttgtaagacaattccacagaataaaaagctatggtcagtccagaaacacttgcctggtatatgtcaggaactgtgcatggtgctgggaatttctaaaatgagagtgttgttgctgttttcttggatttctaatttgtggcaacaatgtgagacagatatgtaatcaaataactaatgtgttacattgtaatttacacatgtaatttacaattaaattgtaatcgtaattgttaaattgtaatttaacgtatctttccttttccctctttcccgattcctttcctttctactgagtctcactctgttgcccaggctggggtgcagtggcacaatcataactcacagcagccttcaactcctgagctcaagcagtcctcctgcctcagcctcctgaggagctgggactacaagcccacactaccatgcctggcgaacctcctacatttttttagacagattttaatagaaaatgcagaaaaatgcgtaatgcattttaggaaaaatcttcttgtaaaactattattatttttttgagatagggtctcactgtgtcacccaggctgtagtgcagtggcacaatcacagctcaccaaggccttgacctcccaaggctcaggtgatcttccagtctcagctccccgcgtagctaggacaacaggcgtgtgccaccacacccagttaatttttttattttgagtaaagatcaggttttgccgtgttgcccaggctggtctcaaactcctgggctcaagcgatccacctgcgtcggcctcccaaagtgctgggattacaggtgtgagccaccgtgcctggccacaattaagcatgttaatatttcaacagtagcttttttactgaacactatgtatcagacacgttatgcagaatttttcctttgagcttctgtataccctccttttaatccagattcagagtaacttcattttctgactactatgaaaactggaattctaattcaaatctcttgactccaaaatctcccatgcaggttatctttggttatttggaaagtgtaccttcagcatgtgtattaatgtgggcaagtgctctaagacatatgaaaaactgcttctctgcatggggtttatgagttgagacagacatttatgtgaaagagataacaacagagggaggagcaagtcttcaatatcaggtgattgatgtacattctgaagaggctcaaaactacaacagtggcagggagaatgggaggagagatagaaaagactgaggtaaagaatcttgtaactgtaacggaatgtagggatagtgaaggaaagaggcacgtcagagatcttttgcaaagcttcccaaggctaggtaattgagtggaattgatactttaacaaaggtcttcagaagaggaagagattttggtagaatgatgagttttattaatcttgtgggaggatactttaaggattcaagtatgcagtaaaagaaaatgaaagcaagataagtctggaatgcaacttcagtgaacaaataaaatacaaacaagcacacaaagtacaggctccagtcctgctttatcttctttattcttaagctaatggccttttcctattctctgtggggtcttgggatcagataagttagttttctacctgttgaatggattctttattaatcttcagtttttgttattttaatttttttgaaaataatttaccctgctgcttttacaggtaaaatcttttgaggaatttagtgatctctttaaagaacagctgtattgagatataatttccataccataaaattcactatttgaaagtgtacaattcagtggtttttactatagtcagagttgtgcaaccatcaccattatcaatttttaggactttttcattataacaaagaaacaccatacccattagcagtcattcctcattccccttcctcccaggccctggcaaccactgatttactttctgtctctgtggatttgcctattctgtatatttcatataaatgggattatataatgtgtgaccttttgtcactgacttctttcacttagcatgtgttttcgaggcttatccatgttataatttgttagtactttattcttttttatggttgaataatatttcgttgtatggaattttatctatgcattcatcagttgatggacatttgagttgtatccattatgaacaacgctgctatgaacattcatgtacaggtttgtgtggacatgggttttcatttccctcaagtagaagtgtgaagagtagaattgctgggtcatatttactctgtttaacattttgtattaataccagactgttttccaaagtacctgtgccattttgtaatcccagcaccaaggagtgagggtccaatttctcggcttcttcaatacttactattgtctttttgatatatccatctcagtaggtatgaagtagcagctcattgtggttttgattttcatttccataatgtctaatgtcgagcatctttcatgtgcttattggccatcgtctttggagaagtgtcctttagaatccttttgttcatttctaaattggggtttttttttttttttaattggtctcttttaacaaaggtgagtgttaactgctaggtagaatttcataccaggcgatggtaaatttttcataaatattagtaatagacttttaggtttaactagtgctgatcctcataagtaatcctttaaaaaagtgctggtaagattttcctttagggtgactagtaaagtcagtaagacttgattgagcatgccactatcataatgagaagacctaactttaatatttttggaatgtcaaaaacagtgacattttaattaagtaattttatttttaaaaattatttttaatggctaatattttgtaagaattttaagtaattttcaactctgagcatcaaattttaattatgtgcattgaatctctgacttaaccagagcaatttcatcttttcccaagtagtcagatctacttcgtaaaatgtgttctgatgtgtgtcttttttttttttcttttttaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggttagtcttataagagtttttctataccctctatggtggcagatttaaaaacttgctacgtttcctttcaagctactacagggtaatttaatttgtgctccatctcttcagatactgtgcatcctgtacaaatatgcattatgggaatttctggaagaatatgcaaaagataaaatcttaaagttttttaatgttctactcagaaaaatgttcaatggagaaaatttggaaaataaaaataaaaagcagaaaacccacacttcgcaagaactacctttagcactttggtattcatttttgtagcctgttgttttcttttttttttttttcctagacggagtcttgctctgtcacccaggctggagtacagtggcgtgatcttggcccactgcaacctccacctcttgggttcaagcaatcctcctgcctcagcctcctaagtagctgggactacaggcaagtgcaaccatgcctggctaatttttgtatttttagtagagatggggtttcaccatgttggtcaggctggtcttgaaccgctgacctcaggtgatccacccgcctcagccttccagaattctggcattacaggcgtgagccactgtgcccagtcgtgttgttttcttttttgatattgtatgtacatttaaacaaccggattacacttagtccttttataatttagaaatctgatatgtttcactgttagcaaatgtttcattggtcacatttttcaggtagaacttcataatacagctcccttgcttaaataaatcttacagaaattttgtcgtagattttaaagttttatttcaagactttacacatagtttctgcaacacagtctttttgcatatttatttattttattttatttttttgagacatggtcttacttttgcccaagctggagtgcagtggtgcaaaacatggctcactgcagccttgacctactgggcttatgcagttctcctgccttagcctcctgagtagctaggactacaggcacataccaccatgcctgggtaattttttattatttgtggagacaagggtcttgccatgttgtccaggctggtcttgaactcctgggctcaagcgatcctcctgccttggcctcccaaagtgataggattacaggtgtgagccaccatgcccagtcactttttacatttttaaaacctgagcacaggccttgaaattataccaaggtttaaattctaggtctgatgtatgacatggccaagttagttattgtgaattttagttttcttatttatgaaatggggattgtaatactgagttggtaggattgtgaggattaaatcagaatatataaaagtgtcttgcataatgtgacacatgaataaatggtcgtttatttttctaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattggtaagtagactttgctttcatcctaagaaacataaagggaaaaggatctcaatagtgtttcaatttttgtaagttaaattataaatttggaagatagcccgcgactttaaataaggttaaagaatcagacatttttaatatacgtatttaaatttgaatttaggaacaaacttatattttgactgctaaaaccgagtattgtagttgatattttgcccctttagaacattgtttttgagaaataagatggaaagcattataaatttgaatacttagttatgtattgttagatagcgtttatgctacttctgaattgaaatggttcatgaacttttgtaatctttggtttaaatttacattctctgtttttaaatggaaaatactttcattgtaatgattaatgtttcatttgttttcccctttaaacaattaagatctctcaggattaacactgcagagtaatggtaggtaatctgtttcttactactttctctttgttttgtcctatcctctctgtttttttgttgacctagaattagtttgtgtgagcggcaggcagtaacattaacaagaaaataacttactgctttggaaatgtagattttgaggttaggggcatttaaaactggatttaaaactggatttaaattggctattgctctttgtatttgaactgcaatttatgaactaaagtactgtaaaaaaatatgatagaggaatgcaccaaaaacaaatataaagaatattttttgagttaagacctatttttgaagaaaatctcacagagccagtttaaatggatgttaaatacccagaatatttggtaatttggaatcacatataacatatcctttaaaaataccagtattctaattttccttcatttcagcctaacatttttatgaatgataatgttgagaatggtttaaaattgcactcttttgtattttttcagtcttgttacattttgagtaaataaatcaaggctactttaaagcatatgcccatcacagcttacctaattgtatttttaaaaagaaaaagtgttttaaggtgagaaaatgaaatgtgaatgggggtgtttttgttttttattgtaatatttgagaatggagttttattaaatctttagctctgttacttagaacttaataaactaaaatttctgtaagaactaattaatttgcagagaaactcttataaagaaccactgtcagccaggcacggtggttcacacctgtaatcccagtactttgggaggcttaagcgggtggatcacctgaggtcaggagtttgacaccagcctggccaacatggtgaaaccctgtctttactaaaaatataaaaaattagccaggcatggtggcgggtgcctgtaatcccagctactcaggaggctgaggcaggagaatcgcttgaacccgggaggtggaggttgcagtgagctgagatcacgccattgcactccagcctgggcaacgagcgaaactgtctcaaaaaaaaaaaaagtggggggaggctgggcacggtggctcactcctgtaatcgcagcactttgggaggccgaggagggcggatcacgaggtcaggagatcgagaccatcctggctaacacagtgaaaccccgtctctactaaaaacatacaaaattagccggacgtggtggtgggtgcctgtagtcccagctacttgggaagctgaggcaggagaatggtgtgaacccgggaggcagaggttgcagtgagccgagatagtggcactgcactccagcctggttgacaaagcgagactctgtctcaaaaaaaaaaaaaaaaggaaccactgtcatcttagaaaggtgtgctcttgttctggagggcagttagtagtagtttagcaccttttttgtttgtagaattttagaggtgggtcagaaatactaggtgaccttaaccaaaatttaggaagagtatgcaattctacttgtttttttttttccacctttctcccatatcactggtaatggaggaagactcactgccttgtggtgcttgttagtgattagtaggtttctgacaagtgtgggtttattattaggagctgttgtggtggtctgggaagggttgctttaagattggtgaaaactctgcttctttgctacgcagacattgatattgtatcacttctttttttttttgaaagtaaacacgtttcatatcttcaccattttccatccatgtttttggagaaaacgtttgtctcagtgggtattaaaggttgggagactgcaatgataagtgtgtctgaatctctctatggggctgtttgtgagggggttcaaattctgagtgctcatcacacacctcccctattctaaaattattgatgcactgttattgatgggattgtacgggttgatagcctttctatagtgactgtagggctgtattcagccttgtagatccccctagtggtggttttgtaaaggctgtcttcagtgtcttatttcctcagaaaacaactggtatttctcacagctccttctagatttggacaaaggaatgatacaagagcaggtaactaaaagttaagaaaatgggacagttccttcatttttgagttaaagtcttgtggtaatcatttccagcctatcttttacctttcatgaaactttctatgaccacgttgacctgtgtattcattttaacaagtatttaataagcatgtattgcctggtactgtgttaggttccagggatgcttagataataaggtatgttttgtctactcaagtgagcttatactctagtggaggagagaaaaagtaaataagagagtgataataccatgagataggtgctgtgtcctggttgctggtgatgataaagaacacagacctaaggtgggcccagtggtttcagcttttttgtcacctatagagaatatattctttgaccctcttagaacattttttttttcttttttgagacggagtttcgctcttgttgcccaggctggagtacaatggtgcgatttcggctcactgcaacctccgcctcccgagttcaagcgattctcctgcctcagcctcctgagtagctgggattacaggtgcccgccaccatgcccagcatttttttttgtttgtatttttagtagagatggggtttcaccatgttggccggctggtctcgaactcctgacctcaggcgatccacccgtctcagcctcccaaagtgctgggattacaggcatgagccactgcacccagccctcttagaacattttataatcactatatatatgtataactactctaaaaatatggttaaataataatagctaacactgggtactcgtgtgtcaggtcagactgagctaaatgatttctgagtattgtgtcatcattctcatgatacttctacatgggaggtgggattatttatactttaacagatgaagggactgctacctggagaggtgaaggaacttgcccaagaataggcaactaggaggagccggagtaatgtgtgcttgctattagatatttaaacaatggaaaaatattacaaaagactgcaaactccatgacagcagggatatttgttttgtttatggatatatcccaagtactagaacagtacctggaacagaagtgctcaagaaatattttttcagtgaatgaatttgttgaatgctagcccataaagagaaatatttaacagtttggtatctgtttttctggactttaaaaaatatatactatatgtttttttaattttatttttttgaataggcaatacatggtccataaatcaaaatactataaaaaggtatacagtgaaaagaagtgctcccacccctgcccccattcccccctacctcaggtaatcactttttttagtttctggtgtttccttccagggtttctatatgcaaaaaatacatacctcctttcttacacaaaacgtatactatgcatactgttctggaccttggttttttacttacagtatatgattttttaaacatgcatatgatcatagtgtacaatagtgctttgtaacttgctttgattctcttggcaaaaatatattgcagacttctatccttgttgatacctttagttttacctgagaaacatttattatggattatctggggttaaagagatctgtagaccagtagaagtttcaaacttacatttgggaagtttagccagcatatttagggcaagaaagatttatgggtcataactgtttaaaagcagaatacagttggtacataaagatgttatgattgctgattaaactgaagagtcatctgaaaagcaaaagcagtgagtaccaagttgaccagttgtatcctcaaatcagctagcaaaaccagtaagttggtaaaaagatcccagtcattataacaacaaaaaaaacctaagatgtccaggaattaattagagatgtcaggatttatatgaagaaaatcattgaactttgttgaagggtgtaatataaggctgaataagtgtagacataccaattttgtgccccaaacaatttttttctttttattatttttataacttggccaatgttgatgagtggttgtgttcagttttttttattgatacataatttgttacgcatccttttgattatctttttgtttccataaaatttctaaagaggaactttggaatgggatttataggtcttcagaatatcatcttcatgacttttgatgcatgaacatacttcttaagaggtttttaagaggttgtacatagaaacttgcacaatggatgattattactgccttaaactagtctcaatttaataaaaagtacccatgtaacttaactgatatttacatgtagtagattttttttcaaaggttgacatagggaaagataagggaaatgatatgctggttcttaatgaaaaagggaatgtctttttgtggtctactaattgactgctttaagaagagaacctactgttagttcagtggattgttaagttctggagtagtgttagtttagaagcaataaaggattggttgctaaaggtaaaaagcaaaccttaaaacaataacctaaaaacaaatgggaaggttctgggcagagaattaacattgttaatgcagttcagtttcagttttctttttgtcatacagcagagctaactatttcctggttggttaatggaaagatgttatgctgtatcagctggaatctagctttgcttatgaaggtgtaatcacataggtgaaagatgttgattactgagttttctcacaccatatattaatcaaatactcttatttgggttgggtttctagagggaaatttcagtttgacttttcatttataatttttccgtttggttctaaacctataggggacattacattcagtacacttcatttttaaagaatatgttgcttaacaataattctagatcctgggattggatatctatcagatcccactcatatctccacagtgtgaaattaacaaaaagatatagttaaatactcagtctctatttagaccgaataattgtttttctcagctggacacattttccagccattcggtttttgcctgccttatgtatttaggtgattattcttctaggtttatcaagaaactgaggagtacctttttaggattgttgctggaggctgttgaaacatagactagcttcaaatttgagagtcagattgattgataaaatatatctcatgctgttaccgctgaataaatgacttttgctggtaaagtagtatgcttttaaaataatatgaaaaaattctgaattaaggttagtaatttacactgtaattgattttaggtgttattatattacttgctaataagatttttttttctgggaatagaagcttataaaaatttaaaatatgtttaattttctatatagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtgagttctagaatcagatgtagtcagcaagttgagttttcctaatcattgcttatttatgtgtagtcacttggggggaaactccaagtaagtaaacattaaaagtaactgtagtatctttcataggtaaacaggtattaaacaggtatgcacaatcacttggaatttaagtaatggctttgattataatattgatttaaattaatgatctgatttatactttactattacatgtagcagtaagtagcctcttaagctcccagatatattttggagaaatatttaaataattaacaagtagttttgatccaagatgtttatgaaggtctgtgttaatggaattgcaacctttcttttaatgcggtgttcttattttggtttttctgggacaatattaccttatagtagttgtctgattttctcactgtgcaaagggatcttgacaaatttgttatatattgctcaagatagacattaattaagtcaattttgatataagctaacttctatatctctttttaaaatatatgtgtaattaaaaaaaaaaagtgtttcagaaagatccttcttttctgccatgtcataggagggagaggggctgctaggttcaggtttttgggggcatgatcatatgacctggttctgttacttattttcacagtaaccaaaggtttgatagtttgctgcttggcaaatgaagtagcttttttttcattttttttttttcaattaatcatagagcattgtcttggcatgtgtatggtgttagttgcatgcagttgctaaaggaatttatgtaaacccacatcagaatagatttttgacagctctgggctaatactgtgttagttgctaccgaaagtaccattattgtatttgctttactatcagattagattcaacatagaaattttgatctttggaataaatgggggactgatttctgtaattgtgagttttcaagtgaagtataccagaatttcccctttaattcattacaccacttcaaagcaacatgtttttggtttgctatctaagagatgacagtctcactataggcagcatattctaaatgggtcatataggttaagcacttgagaacccagttccttaatcacttggtgcttctattatctgtctactttttatttaccaaattaggaatatggttgacaaacagtgggtagtgatagaaaataaaagaaggtacattatagccacttgaacgtagattagtgctagagcacagctacctacttctgtttatattatctggagattgaatttctgtgcctttgtcaatgcttactaaagtgacttcattttgactgtgttgtttcctgaggttgaatcctattcaaagattagaaaaagtgatagaaatgaaatgcagctaattttatcctggtatttattgggtagattttaataatcgaataccgtaaatactgtaagttttagaacttgtgtcaaaatgttcccttatgtggtggcatgcgcctgtagtcccagctgctccgggggctgaggcaggagaaatggcgtgaacccgggaggcggagcttgcagtgagcagagagcgagtcactgcactccagcctgggcgacacagcgagactccatctccaaaaaaaaaaaaaaaaaaaaaaaagagggttcccttaggtctcaaaaagtatattgatgaaaagaagttgaactaaaatagaagatttgaaaggctattttacgtgagctgatttagtcgtattgtttaactttattttacatacttagaattgtataagggaagtattcagtatggataactacagtgagtcactttacaatttatgttcttttgacacctgaatattttaagaatttccttttaaatacctgtaaattaaaataatttatcctgtgtagttaatgacaatttttgtaagttagctaagagtattgcctgtagaattgttaaaaatatgaacaaaaccataattaacctttaaagataacttgcagaatctgggggatgagtaggaagggaggttgctaaaatgtcatttttacagataaataatttggggagtattgaaatattctctttagcttttggttttgtaattcttagctttaaggaaatgtgatatgtaaagaaaagaaaaatattccttttctttgatactttgagcaatggtgacatgttactctcttccatctgattatactcccatttagaaaagaatgaggtgatgccagttataaataattataactttagtgctttccaaataggattaacagtcgagttaattaatgctctttaagaaaccaaatttccactttaaaaaaaaagccttaaaaatgtaggacagtaagcaatatcataggatggtttttgaatagaatacaagccaagagaagcttgattctcttggtatattacatacagagagggcaattaatttcttgtacatctgggaatatgatggtgttcttgaaaagaaatgattcttggtttataaaagctcttgaaaaaatttgaaagtagactgatagtttttttgtttgtttttaaccagtaaatggtatattgattggacagcagagctagatctttttaacttcctcatcttcactatcacatcctatttaaaataattttctgctctgcttttctctgtcaaaccctagcattctgccattactagtatcagtgctgatagtgattaatttttcagttttcaacattttcttgagcctggatttttggggtcctaatcagaaaggtccagagagagaggtggatggagtggccaggatgaactgacatacctctgaagaagttaatatgataggccagacgtacagtggtgttttgctggcatttgaaatatgtttgtgaagaaataagccactacaattagttagacattacctaaaatggaataattttgagcttcctcaagttaaagtttgcctttatagatgactgtaggttttttacctgataggccatgggtgagttacactttttgcccatctttatagttgtgcattatcagataaaattggtccttcatttagtatatgaaatcataagatgacatctatgaatgtaccatgttaatgtcttcttgttcctctaggtcagcctgccagtatactggggggcagccatagtgaaggactgttgcagatagcatcagggcctcagccaggacagcagcagaatggatttactggtcagccagctacttaccatcatagtatgtacatactttaaaaaatcttttaaatagttgagaaaaaagtaggcagcctttataaaagcaaattaacccatgtgggccttaatttttagacagcactaccacctggactggaagtaggactgcaccatacacacctaatttgcctcaccaccaaaacggccatcttcagcaccacccgcctatgccgccccatcccggacattactgtaagctcttgtttttgttgtaagggctattttttttttttttttggtagggctttgttttctgttttttaaaaatgtttttacatcttttattcatcctgtgattttgtttcattaaatagtgcttttcagtattttttgtaaacagtattatttttcatagttatcctacctttttattttagaggagtgatgtttgctaaatacatttatttctctgttgctaatgtttcattaacatcacattgatttccattcatttgtttgtttgctttgtatatgttcttagatctcatctgtgtcttgtatatccacgcataatggattgaaaccctttgagtgctaagttctcaaggtttccctcagcgtagtattcagtgtactttggataatgttgaatctatagataactctgtgctggcatgattgggaggaataccctacagataacatgtagtttcaggtagaataggagcattgttcatatggcttagtaaaatcgagagtataactcttatatacattaaatccctttcttctcattataatattaatagtaccaaagaaaacttagaaaatatagaaaagtataaataagaaaagcaaaattaccctgaatcctgctactcaaaaacagccacttctaatattttgttattttccttccagtcatataaacaggtatatgtaaattgacaggggctcctactctatgtgtattgtatatatcttgcttcttttcagttatgttactattttttccatttcttaagagaatgtaatttttaatggctgcctaggccgtcatagtgttgaagggtgctgggtttggacctttaacaggctgtgtgaccattgacaagttatttcacctcattaagcctcaagagtaataatagtagtatctacctcaaggggtgttcgtaagaagtaaacgtaataatttatgtgaggtgtttagcacagtgttttaacacattaccagttttcaattatgttagctatgattccattaaataaacatccttaattaacataagcacttgtttttagaatagacctaacagtttattattatacattgcattataaattgtactgtattggacgttacatgaataattcatttatgatctgtattaaatgttggatataaaattatgtgtaaattgtgtaataatagcacttggcagatagcactgaaatgttagttattaaatatccacaaaagtattaatagtttaagactatttgcttattgtaaacttttaagttcttagacattgcataagcttgttttaaacaattcctaacctataatagttatatttaagtaagatttactgaaagttttagcattagacaacttttagtaaataaaaatggaatttttgttgtcttttctttagggcctgttcacaatgagcttgcattccagcctcccatttccaatcatcctggtaagtgtatttcaaaattgatttcctgtatttagattgatttagtggtgattgaaacgcacaaacacaggctttaatggaattatggggtcacttctcagatgagtacaatactcatcatgacatgagttaatcaacagtttgagtagtcaatatagtcacacatagactgtctatattttattcagtttaactgtccccaaaagaaaagaactatcttttcagctaaaatgagaattacagaaatgctgacttcagcattgaatacataaatatgcagcagaataaaactaggtttcaaaatagaacagctgtaaaactatagcttaaaaagccaggaaagaatcttaagtacatgccgaaaagaaaaataattcactctattcaggatctctggttaactggaatttagaaactatttgattaaattgtatgcaaaagagtaaatcgctaagtagctttcttcagttcaaagtttgtgtataatttttgaaactgtagaggtaataaaacagaaaacacttgaaaataaaatactgaaagtcccttgtaacacaaacatagattttgaatttttttctcatcctttcgtatctgtttttcttagcataaaaagatgcaaatatattacttcagctaatcaccttaattttttggaaactataaactcaattttcctcctaattaaaagaaaattatgaagaattatatttttatttttacttgtttatttttgagagagggcctggctctgttgcccaaactggagtgcagtggcatgatctcagattactacagccttgacctcctagtctcaagcgatcctctcacctcagcttctagagtagctgggactataggcaagggccaccatgcctggctaatgtttgtattttagtagataacagggtctcaccatgttgcccaggctggtctcgaactcctgggctaaagcagtcctcctgctaataattttatttatttatttatttatttatttttttccgagatgggatctcgctatgttgtccaggctggtttcgaactcctagcctcaagtgatcctcctgtcttagcctcccaaagtgctgggattatagacgtgagccaccacaccaagcttgaaaaattaaaaaaatatatttttaaatgattttatttttgatctttgtgggtacataggagatgtatatatttatggggcacatgagatgttttgatacaggcatataatgcatgataatcacatcatggaagatggggtatacatcccttcaagcatttatcttttgtgttacaatctatactctgttagttattttaaagtgtacaattaaattattggctacagtcaccctgttgtgctgtaaaatattagaccttattcattctaactactttttgtactattaaccatcctcaccttcccccaatcccccactacctttcccagcctctggtaaccatccttctactctctgtctctatgggttcaattgttttgatttttagatcccacagataagaacatgtgatgtttgtctttctttgcctgggttctttcacttaacataatacctccagttctatccatgttgtctcaagtgactgaatcgcattttttttatggctgaatagtactccactgtgtataagtcaagcataaagaattttaagcataccggaataatacaggaagttcccccattgtactcattcctcagtttcagccattatcaagtaatgaccaatcttgtttcattcatactcactctctttcttcattctatattattttgaagcaaatcctatattagttttatatgtaaatatcttagtatatatttccagtaaaggtttttaaaacataaacacagcgcccataatgattaattcaaagggtcttaaattcttaaataggtctacataattttctttgtgtaaatgttctgttattgattatgttggtttaatttttcttctagctgtttaaaaaaatagaagggaacatctttgtgtttataacttttctcatattttagtttaagaaatttgtagaatttctagatcaaaaggccatattacagtgacaccagagtgtgagaaccagggttactgtgctggctagcagtagatgtcatagtttaataaactttttgctgatttaagaggcaaatacttgttctggttagggaaaaggtgatattagtggggcagaagcattcttttaacgatatatatttattatcttctgtaacggattttctgtgttacattgtgtgttgtgattttaaacatttttgtaggtcaaggggtctagccttttcataaactttctttttttgagaaatgtaatatacagaaaagtatgtaacacaagtaagtatatagtctaacatcactaaaaccaatactcatgtaaccactacacagattgagaactaaaacattatggcatcccagaaaccctcctaccccatgaattttgtctctgtcaaaacctctttccttctccccagaggtagctactgtcctgctttttatggatatcactttttttttgctcttttatttattttttaaatttttatttatttattttgagatgaactcttgttctgtcacccaggctagagtgcagtcatgcaattcggctcactgcaacctccacctccaggttcaagccattctcctgcctcagcctcccgagtagctgggattataggcacccgccaccatgcctggctaatttttgtattgttagtagagatagggtttcaccatgttatccaggctggtcttgaactcttggcctcaagtgatctctgccccatcggctcccaaaatgctgggattacaggcatgagccaccatgcctggcccttttaaagtgatgaatacatccctaaacagtctagtaatctggctttacttgttttttttttttttttttttttttgagacggagtctcgctctgtcacccaggctggagtgcagtggcgcgacttggctcactgcaacctctgcctcccgggttcacaccattctgcctcagcctcccaagtagctgggactataggcgcccgccaccacgcccggctaatttttgtatttttagtagagacggggtttcactatgttggtcaggctggtctcgaactcctgacctcttgatctgcccgcctcggcctcccaaagtgctgggattacaggcgtgatctaccgtgcctggccctcattttctttttacctagctttataaatacttgtttaaaacaatttaacatttggactgattgtgtaaagaccacttttaagtgttgttactgttttttgttgtgttttttttggccaccaaaacattgggtaattgttgtcttagacaatctctgtagttttggtttaaccagtgtacctatcagttgtttgctgaagcttcttgtccatagcataatgtgataccttcacattacattttctatagacaatatatatatatttttttaaatttttgagacggggtctcactctgtggcctgggctggagtgcagtggcactctcatggcccactgcagccctgacctcccagacttaggtgattctcccatctcagcctcccgtgtagctgggactacaggtggacacaaccacgcccagccaatttttctatttttcgtagagacgcggtttcaccatgttgcccaggctggccttgacctcctgggctcaagtgatctgcccatcttggcctcccaaagtgctgggattataggcatgagccaccatgcccggctgaaaataatttcataaatacttcaaaactggctttttaagaagacactcagtgaagacacttagtgtatcactggtttttatgttctaagcataatgaaatatatgtaaacaaatatttatctttgtgacaagttcattagagtgacatggcaaaacatttgagtttttaagtttttgaattatccaatcttcatgtgatctgttttgataactcctcattgcattggaaagtattttattgcttggcagcattttgaaaagtaattagggtacatagcttttacaagttgttttcttttaaaaaaattttaagcatcaatcatacttcattttaggttattttttttttttccgtaagatctgggtttcttttttgtcattctaagtaactttgttgaaagtaagattgttgaaagttttattgcttcaaattctagtttaaagttcataaacagcttattgagatacagataaatctttcttttaaatatgtcgaacctatttccaccctggggtctttgctttcgcttcctctttgaaatctgttcagtcttcacatagataaaaggttattcaggtcccatcttttcagatgggatgtcccctaccatccagtctgaagtgttcttcccaatcatctgctgttccataccctgttttattttcttcacagtgttcattgttatctgagttatttcatttgtttgcttatttgtctgcccctgcacctctgtgagaacagggactgtagctgttttgttttctactgtgtatgcagtgcctagaaagatccctagatactctgtagatatctgttaaatgagttaaaacaggaaagccaaataatttttatgtatttgggcttgatgtaataattgttgtttacaaataaaaattagaaatacttgatcagttgtctttgtaaaccagagtagcacctcttttttcccagtgatttaaaattatatattattgttcaaatgagtacactaaatacatctccaaagttaaaattgtggtagttaacatgacctgacttcactaaaaataccttttgctatggcataggtgggacaaatgaccttctacccaagagacagttgagaatctgtgtgtacaacaactgtgtgattagagtataattaaccttaactcagggatgggatagctgacttgcttatgcactttctctcaattagggaatctataaaaatatgtcatgagtcgatgttattcaaggacagttccctggaatacatcttagggtcagtgtgtttttaaaaaataaaagttgagactacatagagaatatgtgtagtcaaatgaaataccatggtaaaataatttattttagattctgattatttctgttctttaaattctcagttgacctggtcctttgaggtaagaaccaaattccagattttaaaaaatgacttttagaacttgaggataagtggtaattggaaattaaaaaaaaaaattagtgttttaagaacagtgctaagtactgagctagaaaatagaagacatggaaattcctaccttttaatgcattatgttattttaatccagttgttttgggtgcattacatttccatctcccctccctttaccctttcttttaggaaaaactgtgttgtggagtgcaagtgaaagccttatatctttctcatgggaggatgttctttcccatttatttcctatagctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggtattgattgtatagtcagatagttactttaaaaaattgagcatagtacattgtcttttattcaaggttatgttttcccatgtacattatatgtgttcttaaatataaataaaggaataaaggtcatgttgaaaactcagaatttgtaagcactccatcttaattgtcggtgtttttgttgtttaacatataatgataaaagatagccttttttatgttagtaggtttctatgtttcgaatagtaagtataccttttgaaattcagtttgaaaattttattttctgtgatcatacatttctacaaattactgaaaggaagtaatattaaatgagaacatgtttctgaaagttttacttataatgttaaaaaaattggtaataaaagggaaatggttaagtaaattatgataaatttttccttttttatacagtcattaaaatgtttaaaagtttatataatgaggctgggtgcggtggctcacacctataatcccagcactttgggaggcggagtcaggcagatcacttgaggtcaggagttcgagaccagcctggccaacatggtgaaaccctgtctctaccaaaaattagccatatgtggtggtgtccacctgtaatcccagctactcaggaggctgagacaggagaattgcttgaacccaggaggtggaggttgcagtgagctgagatcgtgccactgcaccccagcctgggtgacagagtgagactccatttcaaaaaaaaaaaaaaaaaaagtttatataatgaaatggaaatgcttacagtgaaatattacaggaacattccattttagctactgtatgatctcggcttttaaggatgtgtgtgctaaagaacataatcttggctctatcacttgctgtcatgtgactttggcaaattacctaacctctaagccattctgcctaatagaattttctgtgatgaagaaaatgatttatatttgcactgtccagttcggtagccactagccacatgtaactattgagcacttaaattatagctcacttgattgactaatcggatttctaattagttttaatttaatttaaatagtcacatgtggctagtggctatcaatttggacagtatgccttagtttctttatctaaaaaaattagaataatagtacttgttgagttgtaagggtttaatgagaattcatactacatgctcctgacacatagtaagtgttgtaaatatgtgcatcattattagatatgaacaggaaaagaaaaaaggaaatatacaaaaatgttaatagctatcttttggttttatgtgatctttatttttaatttttcaatattaagcatgctatacaatctgaactaaaatttaatttaaaatacttatcaagataaaatgtaatttcttttttcttcctaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggttagttacaattttatttgaatattttagacttaaagctctatttgttgtcaaaagaattgaaatctgggtggaaggaatggaaaaatgttttatatattaaataataagaaattgtgtttaagtataaaaaacacattttctgagggcatttattgacattatcagtaatctagttttatcgttgccaatttgttacattttgttttttattttatttatttatttatttatttatttttgagacagagtcttgctctcgtcgcccaggctggaatgcagtggcgtgatctcggctcactgcaacctgcgcctcctgggttcaagcaattctcgtgcctcagcatcccaagtagctgggattacaggcacatgttactgtgcctggcaattttttgtatttttagtagagacggggtttcaccatgttggccaggctggtctcgaactcctgacctaaagtgatccgcccaacttggcctcccaaagtgctgggattacaggtgtgaaccactgtgccaggcctgttacatgttttagagtaatacaaaggctcttgaaaatactgagtgaagcctccaaagttgtattcctgtaacttgaaatttgtaagaatcagactctggactttcatcttagccaatcttcaggattttatggaagagaattctaaaattaatagcttttcaaattaagaacctgataagcctgaaatatttttcactagttatatattcaacctgtttgaattttactttataatataacctgtttttgaaagagaaaggcagttgtaattagatagcctaaatatatttttaattgtgtgtcatcctcaacattttcattgtcagtgattgtaaattggtagaattaactgtgtctcataacttattaccaggaagttgcttaggataaaaataatgtagccccatagcatccataaaaatggaattgcctgattacctcacaacagcaaacccagtttctcatttccagttatagttcagttaaagaatgttggaatttttttatatgacacttttaaacatgccaagtatagcgaaaataataaaccacatgtacctatcatccagctgcaacaattatcagcactttaccaatctttaatgtgtttctcccccaacttttttttcctggagtcgttgaaagccaattccaaacagcatagtcactcataaaatatttctgtgtgagtaactcataaaatactcctgtgtaactcacaaatctatacagacttctgaaaaacataatcgcggtgctatttattacacttaataaattagcatcaattccctgttaaaattttcaacaatagagcatcagttatagtctgttagaacaatagaataaagcaataaagtattatatttattgataggatatccatgtgtatagaaaagttagttattaaacaatacataaggcctgatttagtggctcatgcgtgtaatcttagcactttcggaggccaaggttggaggattgcttgagaccaggagttcaagaccaacgtaagccacaaagtgatacccccatctctacaaaaaaattaaaaaattagctgggtgtggtggtgcatgcctgtagttttagctacttgggaggctgagatgggagcattgcttgagcccaggagttcaaggctgcggagagccatgatcatgccactgtgctccagactaggtgatagagtgagaccctttctcaaaaataaataaataaatagacaatacatagactatgatctcatttttgttaaatgatatcatgatatttgttatttgtttatatgtacccataagtctagactggtatgtataatggaattgtctctatgaggtggaaattatttgtattttgcagtttttttccacaagtaatttctgtattggttatttatgctgtattattattatttttgagacagagtcttgctctgtcacccaggctagagtacagtggtgccatcttggctcactgcaacctctgcttccagggtttaagtgattctcatgccttagcctctccggtagctgggattacaggtgtgtgccaccacgcctggctaatttttgtatttagtagagacggggtttcaccgtgttggccaggctggtctggaactcctgacctcaagtgatcagcccaactcagctcccaaagtgcaaggattgcaggtgtgagccactacgcctggccttttgttgttattttttaatggctttggatttccttatatgttttgtagtccattttgtattcgtgggccaagtttgttttgagagaattcactcattttattatttattttttcttcctgtcattgcttcaccctatgtggcaattttgccttaccctggcatctgggattcacatctcagaaccaaatcttataaatttaggaagtagggggactttgtctcctgaggaaattgagttccattctgcaggtatgcttggggcctaattcctgattgcctagatttctctgaaacttttccctgccgtgggcaaatattttattcctaggtgtacttctgaattggctgtattttaccagcacttgatttatgggcaggtgcccacttgtagcccccagagagtttggctgttgtctctctccatattattccaagaagtcaaattcctgttccctgccctttgtttatggtcttggtatacccctagtacctcctatctttagtctctgctctccactgtgggttttatttatcatcagtttggatgtatggattgtttccatatgaatttcatgatcagtttggagaggatgactattttaaatagtttttctgttatttgtatgtggttgaagcagagagagaaggtgattatgtatacccacttaacccatcttgactcagaagtctcttgttttatttatgtaatttaaagtgactggatagagaactatggtgttgaatatatactgtgtgccagatagtatttataaacttaatcagatatggagtagtatttaaaacaattgagcttaaataatgtggaatcgtgcaagtgtaatttcttggatgtcaaatagatacattgtgacttatttatattttggtacagatggcctttgaaaagcccccaaggtgtgagacaagtcatcacttgataaaccactgtcttggacagatcttaatagtgatctcatacttttaccatgaaaagtagataaataccttgttggacaagatatttggaatttaaaaaaatctcatttgtgtatattaactaagattttaaaataattatgtctgtttaccaagtatattactgttctttagaagagtcttactagtcagaaagagacagttacaagtacaaccccatccacaatttcactttccatggcttcaggtatccatggtcaaccacagtccaaaaatattaaatgaaaaattccagaaacaattcataggttttaaaatgtgcgctgttctgagtagatgatgaaatctcactccattctgcttgggatgtaaaaccttttgccagcatatccatgctgtctacattacccacccattagtcactgagtagcgagctcagttttcagattgactgtcatggtctcacagtgcttgtcatccagtaacctttatttagttcataatggccccaaagtgcaagggtaatgatgctgggatattgttaacattgttctgttttattattacctgttgttgttaatctcttactatgcctaatttgtaagttaaacttcattatgaggtatgtatgtataggaaaaaacatagtatatgcacagtactatctaaagtttcatgcatccactggaagtcttggaacatatcccccatagataagggaggaatactgtataccttaaaatttaaccattggcattttcttcattcgtttttttgggtagcagtaactaagggatttgtaagttatcagattttcacaggagatgatattattggggtaaattgtatgtagatagcatgcacccctggaaggagtgcccacactttgagtacacaaatgtgtgcatgcacatacacacacacacacatacacacacacacacacattcccctttttaattaaaatgaggaaaacacacttggagagccataatttcattttataagccaagaagctaggactaaattgtggtttttttcacccttctaagttgactttttttcctgcttctctcatgacatagtagtcattttttacttaacgaaaatctgatgtaatgaaatgacattttacaagctttaaatgaagcaaatgtttgaattctctttaagtggccttgttcttttgctttcaaaagtaaaatatgttttgttttgtgttatttagcactgggcgtttcaagtttttaatagctttattgagattttgagagagaattcacatgacatacaagtcacccatttaaattggacaattcaatgattgttagtatattcacaacattgtgcagtcattactactcaattttggagcattttcatgactgtggaaaaaaactccatatacccttttaactatcacccccaaatctccatttccattagctctagacaaccactattctacgctctttgtagatttgcctattcagggcattttatatagaagagaattatgtaatatagtcttttatgacttacttcttttcactaagcataatgtttcaagcttcatccatgtagcacataccaattcttcactcctttttatggctgaatagtgctccacacacattttgttcatcagtttatccattgatggacttgatttccactttttggctatgttatgaaggatactgctatgaacatttgtgtataagtatttgtgtgttttcatttctcttgggtacatacctaaaagtggaattgctggattgtaagataactctatgtaaactttttgagaaactgatagactgttttacaaaatggctgcaccactttacattctcactagcagggtgtgagggttccaatttctctacattctcatcagtacttgttatctgtcttttttattttagccattgtagtaggtgtgaagtataatcttattgtggtagttttgatttgcaaacttcctgtgttaatattgagttgggtttgtttttgaacacatttattttagaggaaggggcagcagatgcttctaaaccactggtggactaggtcagagggtattatgaacctcatttaaatttattcccaattaacactcattgtgattccctaagtcaagtagaacttagaatgtccttagcacaatcttgtttatgttcaggtgcatttttcattctggattactgtttcctaatgttaatttaagattatatagtattgcatttaagccttgtcaaaggaaaatggcaaaatttgactcctggttgtaaaagacaatatcctaaagatgttgtcagtgatctttatgagacacacatctttgttaagtaacggttttgtaataaattcagaaaacatggttaaataaattaaagcagaaattagctcaggagtggtggtcagaaatattttttggatctgagccaaaaagaatatttaaagcctttgattactttgaattgcctttgtcaacaatttagtcaaattatgaaaggaagacagtagcatttcaataatagctttaatttttatcatccagtgtaacaaatggaatctgttatggtatccgttatcaatggattagttacagtgtgaagtcaggaggcaatgcaggttttagttattagtgaacctaactgaataattttaggtcttctggtttgagtgctataattacgtaaataatctgtggaagggaggtttgctgaggtgcccaatgaatcatttttactgcatctacagatgcaagtcataaagtttaatccgtgtgggtaacctgtaatatgtgctgctgatgttagcatagattcaggctgaaacaatcctaattgcgattatttacaacacattggagagagcctatgtgtgacatattacttggttatttttttaaatgactcgtgggggtgggggagtgttaatgttaaaggcatacttgaatcttggagattataattaagttttattccctactcccagataacattatatatatatatatatatatatatatacacacacacacacacacacacacacacacacacacacacacacaccatacttggttagtgatgattaaaaaaaagtagttgtggagacctaaatgtaaaacacaaaactataaaacttctagaagataatataagagaaaaagtgagaactttttttttgagacggagtcttgctctgttgcccaggctggagtgcagtggtgccatcttggctcactgcaacctccgcctcctgggtttaagggattctcctgtctcagcctcccaagtatctgggatcacaagcttgcaccatcatgcctggctaatttttgcatttttagtagagatggggtctcaccatgttggccaggctggtcaggaactcctgacctcaagtgatcctcctgcctcggcctcccaaagtgctgggattacaggagagagccactgtgcctggccaagagaaaaagcgagaacttttaagatacaacatcaaaggcatgatccataaaggaaagaattgataggcctgacttcattgaaatgaaacacttctgctctgtgaaagacagggtcagagaatgagaagacaagccacagactgggtgaaaatatttgcaaaagacacatctagtaaaggactgttatccaaaattacaaagaactcttaaaactcaacaataaaataatgcaacaataaaataaacaatgggcagaatagactgggcatagtgattgactcctataatcccagcacttcgggaggtcaaggtaggaggattgcttgagcgcaggagtagttcaagatcagcctgggcaacagcaagacctcatctctaccaaaaaaaaaaaaaaaaaaattagccaggcatggtggcatgtgcctgtagtcctggctagttgggaggctgatgtgggaggacccttgagcccaggtgttcaagactagcttgggcaacatagcaagaccccatcttaacaacaacaacaaaaaaggcaaaagacatgaacaaacacctcaccaaagaagatacacatatggcaaacaagcatatgaaaaggtgttcagcatcataaatgtgtacaaacccatagaatgtacaacaccaagagtgaacccttacgtaaactgggttttgggtgataatgatgtgtcagtgtaaattcattgattgtaacaattgtgccactgtagtggggatgttgatagtggcggaaggttgggtgtggggacagggactctgtactttctgcttaattgtgctgtgaacctaaaactgctctaaaaaagtaaagtttattaatttacttctttaaaaaagtggttgtagagctatttaccttttcaaatgtttgagtccctgctttgttctgtactgggtaatgccttccaaatgtcatagcctagaagttctgaaacgaatggactgtgagaaatttgaggaagtagtggtttcacttctgggtgttgtgggctttctgatttctagaacctgactttgtcatgctttcttttaaatttaaatttttttgtggagttggggtcttggctggtcttgaactcctgggctcaagtgatcctcccacctgggcctcccaaagtgctgggattacaggcatctgccaccatgcccctgtcattgctttctttactaaagtattttaggacctaatagtccaggaaatacatatatgtatattggacaaattcatgtctgtttaaagaatagggtagtctgagtgttgtccttcattggtgctaattgggaaaagttttttgaggaaatggacactgagtagagaaataggagtaagtaggagtgcaatttgttatttggagagtgtatgttattgtatgtttttgtggttcatgtaaataccatggttgaagatgatcagaattttttcaagcatctgaaaattatggtttaagttctaaaactattgtttatcatcaactaaaaaattatgcattctcagatttctcttattttcaagattatttatgcttgcttgtattgggccccttatgtacgtaatgggactttaaaaaatattcatgtccttttagatagggagtatagccacatggttcagaaattaaagtgatttaaaaacagtggacattgagcagccttgcttcagaacctgtccttgttctcctttcctgcaaattctttttgtgtaatcttccaatgctttttaaaaatgcaaataaacaaatattttaggaagatttttttttccccagaaaaaaaggtgatgtgatttattatctgtaatttgttgcatattaaaagaacattccagtactttcataaatataagggtagatatggcaaccccttccttactatgccagttcttcacttggttgataaaagtaaaattatttattaacgccttaactcatcctgaaagataaatgactacgggggaggctaaaaacaaaataagtaactgtatactatgccaagtttgcaacaacctcatgaaagtatgtacacttagcattcccattttatagataaaagaaactcagcccatataattagcaggtatcggtgatgggatttaaaactgggccttttttttccttaaaaattatgaacatttacaaacaaagaaatgtagagagaaactaatgaagtcccatatacccatcgcacggattaagtagttacaattttatatttgtttgatctagtctttttgttgttgttgtttcttaagtattttaaaacaagtcctggatattattttgcttctatttgcttaaagtacgcatctctgaaaaatgttgatctctcttatatagcgacagtgccattttgttaaactcctccaaataagcaaaaatgataagacaaaaagttggccaggcgaccaaagctatcaactccagcctaaggaaaattcagcaatttgattatgaaagggggagggggacttcttaattgtacattttacacagatttccacaaggacagtaatagctgacccacttcgaactagataaaagatacagaggcgtgtggcagccaaagccatcatgatgttgacatgatcttcttggtgagctccaagccacctttcctaactagttttagaccaatcacaatgtacataaaagtttacatgttttaattaattcttttcatgtgagaggtataatgaaactgagttttaaataagtcaggcattggtttttaatgtatggaatttttctttatgaactcatagtatgaaatgttttttcttaaaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtaagtatgcttttcattcttttttaaaggtataatagttgatatttttatcttgatttactcagttgattagtttctttgagcagtaatagaaattaaagtttttttttactgggatgatgacatttttgaattggtaaaatctgttcttctgtaatagttgctttttgcctatgaccctgtttgcattctttttgtatcaaaaatggagtatgggatgaaggagaaaggggatgattattatattatactgttctatctcctccttttttgttgatgcttattataattctgcctcaccagccagggtgggttgtaatcactgaagtgcttggctttattctagtaaggaaagcatatttcaatttcagaattggacacttttccaattttttttttaaagtatgctaaacatggagagaaaactaagtgagggtggtattttgataacttgtagacttttttttaattttagggtaaaattgaactgtgtgccaggtttcacactgatggggaattttttactgcagagttaaactcctgactatagacttttatgatggaaacacgtggcacccatcttccacgtctgaaggcataactagtgattcattcaacccctgttcttaacctcttcagtgtggtaagcaaatcacactggctaagaaaactgcagtggccctgcaggtttctctacagtacatgcaaattcctcccattagtttcattgtaatattgatgaatgcagatggactatatgactgtatgttctgactggaaaattagatgcagtctccattgtgacttatgttcaggagtttacaatttagaggtagattaggcatattcattgagagaatttgattttttaaaatttggggtgataccattaatttgctggtttcagtgttataaacatgcttttactgaagaatccagaactattattaagtttcatattctcatcagttgccaccactgagtaatagtgtattactctgttacactttgaaattgagagagagacttcatctcggtcatctaagaggtcttagtggaactaagaatattaactgcttcattattagttatgtcttattctgaactaggctgtttagacagtaaggtttttagaagcaacctgtggacacgcactacctcttaaaaacaagttgtttcttatcccttcacctccacttctaaagaaaaaaataggtgaggtgttggtggattgtggtaatttactttataattggttgtagctagaagacacatgtgaaatgtaaagttccttaaccaaaagtgtgcagcttgttgataaagtttagatctactgttacttcttggcactttagcagagaagttatatgctgaggagaatgaaatacagaaagctggtcacttgattaatttagaatgtagggaggatgggaagagatcaccctgtccctctgatgtcttccaaatcttttctgttaggtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaa

SEQ ID NO: 1994 - DNA, 32210 bp, Homo sapiens
  source 1..32210: mol_type = genomic DNA
ggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggtgagcctggggcagggctggtgtggactcgccggtctctgtgctgtcaaacggagacgagaaatgttttgctcacaatcttttgagaattctcaagttgcctagcatagattcttgcaccttagtgactcgatggtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggtgagtaaaaattctgaacagcaggtcctaggtttgggaaatggagagtccgtttcttcgacattatttcctgtgcaaaatctggcacagggttttggccattccttccggagtgagccagaaagagaggactatgtgcctgcgagtgtcaggtgataccctgaagcatcagggcaggtggtccacgagttcttcccgcatcattgacatctccacctaaccaaccaatagaggtattgaagtcccttcagcccagacagctgcctagttgaccaaagcctgggtttgattgagtccagggtcttacctttacttcccaaatcctagacaaatagtgtgcgggttaagagtttgttgctccaactcatcttcatcagttcttcccatccttagatttcagagagtagtaccttcaataacaattattctggccgagcgcagtgactcacgcctgtaatcccagcactttgggaggcctaggcgtcggatcgcctgagctcaggagttcgagacccgcctgggcaacatggtgaaaccctgtctccactaaaattaaaaaaaaaaaaaaactagccgggtgtggcggtgcgcctgtagtcgcagctactcaggaggctgaggtaggagaatcgcttgtacccgggaggcagaggttgcagttagctgagatcgtgctgctgcactccagcatgggcaacagaccgagatcctggagggtctttttctttttcttttttttttttttttgagatggaatctcgctctgtcgcccttgcttgggtacagtggcatgatctgggctcactgcaacttccgcctccgggattcagacgattctcctgcctcagcctcccgagtagctgggactacaggtgcgccgccacacccggctaattttttttgtatttgtagtggagacagggttttgccccgttggccaggctggtctggaactcctgacctcaggcagtccgcccgctttggcctcccaaagggctgggattacaggcgtgagccaccataccggtcgagaatgattctttattgtacaccacagtctctcttcagcctgctaatgaaacagttttgtttggacagagaaaaaaaaaggtttaaaaaaatgtataagccaggcgcggttgtacttctgtaatcccaacaatttgtaaggctgaggtaggcagatcattttagcccaggagtttgagaccagcaggggtaactgcgtctctacaaaatttgaaaaattagccaggcatggtggcacacacatgtgagtgcagctactgaggaggctgaggcaggaggaccgcttgagcccaggatgtcaaggttgcagtgagccatgttcataccactgcactccagcttgggcgacagagcaacacgctatcatttccccttgctgttttcttgggttaattcccttccccacctctctctgttcatgtatccctcattgatccacctccctgtggttttttttttttttttttgagacagattctcgctctgtcaccagactggagtgcagtggcaccaacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtttgagacaaagtcttactctgtcacccaggctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaacctcctgagtagctgggcttacaggcacccgccgccatgcccagctaatttttgtatttttagtagagacggggtttcactgtgttggtccggctggtcttgaactcctgacctcatgatccacctgccttggcctcccaaagtgttgggattacaggcgtgagcgaccacacctggcctctgatttttgtatttttagtagagacaggtttcgccatgttgggcaggctggtctcaaacgcctgaccttaggtgatctgcccacctcagcctcccaaagtgctgggattacagatgtgagccactgcgcccggtcctaaccttgttagggaggttttgcctgtagttcttacatctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtggcagaggataaacttgaatctagcttttaaggctgaggtttacacaagaggagtgagaatgagggatgttcttagggaagacaggaaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgcagtggggacagtgagagctgaggcagagtggcacttcaggcatatcaggcttggccaggccaggcattgctgtgagaagtacagtgtggtcatgactgggcaggtgacaggtgctcttgtcagtgagacaacatgttggaattttccaggattgggtcagttctcaattatgagaagccctgggagtcagggatgacctacatctccaccacacccagtgttctccaagctgtctttgtttttgtgttttgttttgggggaggttttttgagatgggggtctcactctgtcaaccaggctagagtgccgtggtgcaatcttggctcactgcagcctctgcctccaggtgcaagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcataccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccgacctggtaggcgctttgtagaactacagggagacttgtaagccactcgtctctttccctgtttagtaagcatgatttcttcttttttttttcctaaggtttaatttttatgaagagagattccaatcacatggttcaaaatttcaaaacatacaaaagggtgtagtcttctcccacttccctccctatcatccctctgcccctaaggcagccaggcactttccctccttcagtgttttggggagataatgccgtggataaaaatgggtttttttttttaagtgaagtattgtatacattctggtctgcatgtgcttaatagaatggagtttgttccacactagtatgtaatgagctgggctttctttttggctgtgttgtattccattgaacaaatgacttctatttatgcagcctgtcccctaatgatgagcattgaggttgtttacaccttttggtgagtctatttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccactccaaatgaggggccgtacagaccaaagtcacccctctgaggcagcgtgtggtgatactgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgccttggttgcaatgcctgtcctgtgaccagaaaatgcatcccaacacatgtcaggctgtgtctagcaggtgggagggagtctggtggagaaatggcattggaccacatactcaccgctaggtctgttcgggatttatttttaattaatttttggtaaactatcaatgattgaatttgaccattgatggccaggtgtggtggctcacacctgtaatcctagcacttggggaggctgaggcaggtggatcccttgaacccaggagttcaagatcagcctggggaatgtggtaaaaccctggctctacaaaaaatacaaaaattacctgggcatggcggtgcatgcctgtagttccagctactcagaaggctgaggtaggaggatctcttgaaccagggaggtcaaggctgcagtgagctgaggtcatgccactgtattccagcctgggtgacaaagtgagaccctgtctcaaaaaaaaaaaagaattagaccattgatcccaggccaatttgctggcttgttggctgtaacaggatgccttctgaggatgggctggttgttcgagcttctggcttctccttcctgggcacatccactcacagctgccacattgtcccaaggaaccttgctttgctgaccaggaaacatgctgtgacaagctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtctgacctggtctaagcttaggctcacttgagcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcaccctaagacccgatttgtctctgaatccaccccatactccagctgccacagtcagagccccgggtttgagcatctgccatgggtgctcacgtatccctgccaaggcttgtgcctgtgcacactcccttgggaagggagagatggaacaaagataaatttcagatttctagattcagctcactgactccagattggcctccgtctacttatgatgaacctcatttatcagaacctgagtttacgagctcagtatgagaaacacagtattgatgcccttccgtcaggaacctggggaggtctcggtcacggaagcccacctgatgttataagatgtgttggctgcgagttgcagttgagatctgttggtcactgctgccctttgaaggccttagtgacatcctgtgggtgttccctgccgagtcctgtgggtagccccgctcactccccacacggttcctctgcccctgcacaagctgcaccctctgcctggtgcccttgccccaccccaactcttcgttgtgatttgtttttaggaaaactaagtccaaatggacaggacccccaactttctgactgcctaacttctcagtctctcctccagcctcaacagggagcctctctgacccccaccttaagctaaacaaagagtctgcagggagaggtgactctgtgtgtgtatgtgtttgtgtgcacgcgtgcagtagctttagtttctgcctcccccacaggactgtaagctcagtgaagcaaggactcatctgcctttcttggattccgagcattgcaatgttgtcaacaaatgaaaagctgagattgaacctcactcatcttgctctctgttagactgtaaacaccatcaggacagagacttgggattgtttcgtggacaaagagagaactcttgttggggttcaagggagtaagaagggcatcacctgtaatgcttagtaatcactgaaacaaggaagcactttgcatgtgcgtcctttacactgagggcacctgcggagctcactcccctagcagccacccaagtccgttcagggacctcattctcccacgggaagttggagaagatgggccgtggctctgcggaggggggtgtggacctgcctcggtacctggagcggttgaggcctgtcttggtggtggctggggcacaggtgtctgcctggcctgtccttacagactgtcagtgttctctttcctggtattttggtgtttgctctgtcaaacccttcttcctcattggttggaactaggtcacaagcacattaagtccggtcatttcctctgccttctgggggtggattttagcagaagaaacaactcctcccttgctggcctcatgacctctggtgaacactagctttcagcaaacagaaacttccagaggccagagcagcactcagtcgcctggccttccagcctcacaggcaagataagccaccctcacagacttctctgtgctcccatctaaacatctaaatcagccatctggtttccttaacagtagcacagactctgggagtttgagagaatgtgtctcttgtgaataagagaaaataagtccatactggggaaggtagctctccaaattgagatgaggaggtcagggtgggagggtgagtggtcgtgggttggccctgatgggaggagctcaccatcagggaagctgaggacctccctcctaatgtgacagcagagtcttggccacctcttcattccccagtccccaacctggctgctctgagtgtctttccagctactggaaagcttcttctgcagcctgcaaagctagctggaactggactgtcagaaaaacatgtagatgctggagaaaatctgttaatcctaacgtatagctctgccttattccagagaagaccgcagtgtggacatgaagatgataaacttgaggtgatggaaggagcagaaatgccagatacattagcagctcttttttcttttgaaaactagcccttgcaagatttgcttgacatactgagtgacactatccagaaaacatcttttttttacttaaaaaaggctgatggtttgttcagacatctcttgtgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaacaaggactcaggttacacattgattccttaaggactttaaggaagccacaaccatttatttatagttgcattttgctcttcaggtttccaggatgtttaaaattttttttgactttgtttttaggcatcaagagagaatatatctaaaaaacatttgcatagttagtgtaattgctaagccacagggtgatgggtggatagattcagaggaaggcagctgagggcagaggctgcctgacagagcaggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagagcatcactcacgtctccattgggcagatttgcagagactcagcagtgaacagagcaagtccctgcctcgtggagctcatatgctgtgagcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaagaaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgaccatggccaggaggctcaggtggcccagtgggaactccttaaatgggaacttcctaaaggaagaatataagaaccaaagtccagggggcagtgccaggcccaacctgtgagggttcccagagttggagggctagagagaatctgcttccagttcaggccatagactctgaacctcacaggcacattgccatccatctcccctcacccccaaccgagacggagtcttgctctgtcgcccaggctggagtacattggcaccatcttggctcactgcaacctctgccttcagggttgaagcaattctcctgcctcagccccccgagtagctgggattacaggtgcccgccacaacacctggctactttttgtatttttagtagagagggggtttcaccatgttggccaggctggtcttgaactcctgacctcatgatctgcccgcctcagcctcccaaaatgctgggattacgggtgtgaatcactgcgccaccctctgccatccatcttaacatggcgccatgagccagcctctcaggaaaagggtctcatgaacaaatgaggaaagcaagtagaggtagggcagggagggagaggcaaaggaatgtgttgttggaaagggtagtgtgcccctcacagatgacagtacccgtctccagatgtgcccactgagagtttatgaaggggctgctccatgtggtccttgactgccctgggggagagtcacagaaagctataatgccactgcctctcggtttccccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacaggtgagtgcatcttctaccatctgggtataaaggagcagaagtggggattagtgcaaatgaccaagactttcagtccacgtcagtgccatgaagggatccaacaaccctttaagttactcatcaggggatatttgtcctcaaacattgtgaaaccaggaactgttcttccctgatcccatgttcacttgattgacatctagtctgtcaatagcttctccaataattgtgaccccactactttgaaagagagggtgttcacctcagcgtaatctgtacaaatgtgactcacttcacataatttttgctttaaaaaatctttagggctgggtgcagtggctcacacctgtaatcccgacacttcaggatgccaaggtgggtagattgcttaagcccaggagctcgagaccagcctgggcaacatagtgggaacccagtctttacaaaaattacccaggcattgtggtgcacacctgtagtcccagctcctcaggaggctgaggtaagaggatctcatgaggcctggagatcaaggctgcagtgagctgtaatggtgcactccaacctgggctacagagggaggccctgtctcaagaaaaaaaaaaaaaaaagtctttatgtctaaatttgtcatatctaatccaattcgcccattgatttttatttgaaaattataaggctgggctcagtggcttatctgtaaaatcccatgctttcagaggctaaggtaggaggattgtttgagaccagcctagacaacatagcaaagacccgtctctataaaaactaaaaaaaaaaaaaaattagccagacatgatggcacgtgcctatattcctagctacaggggagactgaggtggaaggattgctttagcccaggtgttagagactagagttaagctatgatggtgccactgcactacagcatcagtgacagagtctccctgtctctaaaaaaaaaaaaaaaaaaaaaaagatttaaagctaaataattaaaatcaaaaaaataaagttagaagttgctttcctcaggttttggctcgaaatataaaatcatacatgagactgggggccaggcacggtggctcacgcctataatcctagcacttggggaggccgaggcgggtggatcaccaagtcaggaaatcaagaccatcctggctaacatggtgaaaccctgtctctattaaaaatacaaaaaattagctgggcgtgatggcgggcgcccgtagtcccagctactcgggaggctgaggcaggagaatggtgtgaacccgggaggtggagcttgcagtgagctgagatcatgccactgcactgcagcctgggcgacagagcaagactccgtctcaaaaaaaaaaaaattcatgagattttggtagacttcagtgttacatgttcaaggataaaggaatggagtttctgctgaagtagattactattgtttgtatttcagatcactgtgtctgtttttattacaaaaacaacatggccacattacagacaatctatactttacctaccgcaacacaaaaacagaaaatttcattttccccttattcagtattttcatagttgtaaccatagtattcttttggtttgatagcctttttcttccatttaacccagaaaaactgcttgatattatgtgataactcaggttccataaccatctctctctctctcttttatttatttattttttattttatttatttattttttttgagatggagtttcacccttgttgcccaggctggagtgcaaagacgtgatctcagctcactgcaacctctgccttccaggttaaagcgattctcctgcctcagcctcccaagtagctgggatcacaggtgcccacaccatgcctggctaattctttttttttgagacggagtctcactctgtcacccaggctggagtgcagtggtgcgatctcggctcactgcaagctccgcctcccgggttcatgccgttctcctgcctcagcctcccgagtagctgggactacaggcgcctgccaccatgcctggctaattttttgtatttttagtagagacggggtttcaccgtgttagccaggatggtctcgacctcctgacttcgtgatccatccgcctccgccttccaaagtgctgggattacaggcgtgagccaccacatccggcctaatttttgtatttttagtagagatggggtttcaccatgttggccagtctggtctcaaactcctgacctcaggtgatccacctgcctcagcctcctagagtgccgagccaccacgccaggctttttttttttttttttttttttttttgagacagagtctcactctgttgcccaggctggagtgcagtggcaccatctcagctcactgaaacctctgtctcccaggttcaagcaattctcttgcctcagcctcctgagtagctgggattacaggcatgtgtcaccatgcctggttaatttttgtatttttaggagagatggggtttctccatgttggccaggatagtctcgaactcttgatctcagatgatccgcccgcctcagccttccaaagtgctaggattatgggcgtgagccaccacacctggcctctctctttgttttaattctgtaatgtggagcttttctttttcattttatttatttattttttaagagatgaggtcttgctgtgttggccaggttggtcttgaactcctggcctcaagcagtcctcccacctcggcctcccaaagtgctaggattacaggcatgagccaccacacctaactgcagagccgttttttttaatgcatcactaaggtacagtaaaatatgtgcatcttaagtggagagccagtgactgtgaacctgtgtacactagtgtggccaccacccagatcaagatgtagggtgtggcagggaggaaattagataactacttcaaactcagagtggggctggggagaaaccagtgtaggtaacaaagctggtggtgatggcagaaagaacaggcaggcgaagccatcaagagttatggagaggttcaggcatggtggctcatgcctgtaatcccagcaatttgggagactgaggcaggaggatcacttgatcccagcctgagcaacatgacaaaaccccgtctctacagaaaaacacaaaaatgaagttgggcatggtggttcaggcctgtaatcccagcactttgggaggccgaggcgggtgcatcgtttgaggtcaggagtgtgagaccaggccagccaacatggtgaaacccagtgtctcctaaaaatacaaaaatcagccaggcatggtggtgcctgcctgtagccccagctacttgggaggctgaggaggagaatcccttaagcctgggaggcagaggttgtagtgagcggagattgcaccactgcacctcagcctgggtaacagtgagactctgtctcaaaaaaaaaaaaaaaaaaaaaaaaaaaaaggccgggcatggtgagtcacgcctgtaatcccagcactttgggaggccaaggccaacggagcacgaggtcaggagattgagaccatcctggctaacacggtgaaaccccgtctctactaaaaatacaaaatattatccgggtgtggtggcgggcgcctgtggtcccagctactcgggagggtgagaaatgtgtatggcgtgaacccaggaggcggagcttacagtgagctgagatcacgccactgcaacagtgagctgagatcacgccactgcactccagcctgggcgacagagcaagactctgacacacacagacacacacagacacacacacacacacacacacgaaaattagccacacacacacacacacacacacacacacacacacacacacacacacgaaaattagccggacatggtggtacgtgcttgtggtcccagctactgaggtggctgaggtggacccgaccttttggcttaggtgggaggatcacctgaacccagggaggttgagcctacaatgagctatgattgtaccagtctactccagcctgggtgacagagtgagaccctatctcaaaaaaaaaaaaaaaaaaagtactgcaggagggacctgcagagttggccctgggaacctgccggcctcagtgagtgccctggggaggcactagctaaggttatgagggttggttggtttttttggctcagccataatcaccattctgggttctccagctcaaccctaattttaaacatccgccatttccctccagttctagtcgttgcttgttttttgttgtttttttttcaatatacatatcagaaagatgttttatatcctaatctttggccacatttaattgccataggagaaggtaggatgttcatttgttttggtctaagacatcctccatgtacaaactcaggagcagagtgagcccttggaggagtgggaagctggcaagtttgtgactagcaccctttcacacccttccacatcctacatacctcttcacaaaggctgcttctggggctcttggaggcccctgcatccctgaacatagctatgaaagccatggaagtcctgtggctccaggggcagttttctttttttggagcatcatgaaaactcaggggcttcccagcaaaggcttccatcagtgaggcagccatagttatttcagtgaggtgggctttgtctcttgggaagtcctgtttgtccttgctgacagctttccaagctgcttgttctcatttccacttaaagctgatgcgttcccgtcaaggtccccaaagtcatgtaccctgcctggcctgcccctagattagccccaatcagttgtagcattcttgccatctcttagtaaattcaagaaagcaaaactttcacccacactctgcagttctgtgggagcagaagctgcaggaatgcagtctgtctgttggaagatatgggggaggcagacagtccacagggatgcagtggggacccagaggagagggaggttggccctgggaacagaggaaggctgcacaaaggacctgactttttgcagaaggtgaaggttttgagggaacccaccaattgaaggaggggttggtgcaggcacatggcagtaaaagcacaggggaagccgggatgaaggaagttgttggccatttcaagggcccagcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctagctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgcaataaattgtgagtaaaatttttgtgatcctgtcaaaacctttaatccataaatgcaggaatactgtcacttaaaaactttgccttttttttttttttttttttaagacaatgtctcgctctgtcgcccaggctggagtgcagtggtgcagtctctgctcactgtatcctccacctcccaggatccagcaaccctcccacctctgcctcccaagtagctgggactacatgcatgggccaccatgcactgctaattttcgtattttttgtagaaacaaggtctcactttgtctcccaggctgatctcaaccacctgggctcaactgatcttcccgcctcagcctcccaaagtgctaggattgcaggcatgagccactgtgcctggcccacttaaaagctttttttttttttttttgagatggaatctcgctctgtcacccaggctggagtgcagtggcgtgatctcggctcactgcaagctccgtctcccacgttcacgccattctcctgcctcagcttcccaagcagctgggactacaggcacccgccaccacgcccggctaaattttttttgtatttttagtagagatggggtttcaccatgttagccaggatggtctcgatctcctgacctagtgatctgcccgcctcggcctcaaaagcttttaaaataagtttctcctatcaaacttctgttcagtcatgcatttcctgtgtacatcattatcacacaaacccttcggccttctctgaagttttgtctcttgggaagccctgtttgtccttgctgacagctttccaagctgcttgttctcatttccacttacagctcatgcgttcctgtcacatatgcacccttaatttgaaattctctaacttatttaagacttggtttctgaccaggaaccaccctctcttaaacctctactgtcttatcacttttctcagtctccctagaaattggctttcttggctgagcgtggtggctcacgcctataatcccagcactttggaggttgaggtgggcggatcacaaagtcaggtgttcaagaccagcctagccaacatgatgaaaccctgtctctactaaaaatacaaaaatcaggcctggcacggtggctcacgcctgtaatcccagcactttgggaggccaaggagggtggatcacctgaggtcaggagttcgagaccagcctcaccaacatggagaaaccctgtctctactaaaaatacaaaatgagccaagcaaggtggcacacacctgtaatctcagctacttgggaggctgaggcaggagaatcgcttgaaccagggaggcagaggttgcagtaagccaagatcgcaccattgtaccccagcctgggcaacaagagcagaactccctctaaaaaaaaaaattagccgggcgtagtggcgctcacctataatcccagctactcaggaggctgaagcaggagaatctcttgaaccagggaggtggaggttgcagtgagccgaggtcatgcccctgcactccagcctgggagacagagctagactccgtctcaaaaaaagaaaaagaaaaaaattggctttctttgtgggggagccatttttcacaaagaaaccattgttttcctcatttatgtattaccagtatatatgtgatggcacatagaaagaataaagccagcgttgagatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcaccaggctctgctgcattctacccatagctggagccctgggcctgcaaaacccttagcttgcgggagtctggacttgctcttgcaagttgggagtcattaaagactttaactgaagaggtgcttgccagtattgctttagaaagatgcgcagcacccatggggagtaaggattggaagggagggaattgaattgagaggcattgccataatccttgttaaaggtaaagaaaagcaaggcaggccgggcacggtggctcaagcctgtaatcccagcactttgggaggccgaggcgggcagatcatgaggtcaggagatcgagaccatcctggctaacacagtgaaaccctgtctctaaaatacaaaatacaaaataaaatacaaaaaccctgtactaaaaatacaaaaaattagccgggcgtggtggcgggcgcctgtagtcccagctacttgggaggctgaggcaggagaatggcgtgaacccaggaggcggagcttgcagtgcgtggagatcacgccactgcactccagcctgggtgacagagcgagactatgtctcaaaaaaaaaaggcaaggcagaaggagaggctgggtttctgggctacttagggggtgggagatcaagagggcgtttgttttgcctggattactgggagtagcgctgtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacatactttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtgagactccatctcaaaaaaaaaaaaaaaaagtaataggctggacacagtggctcatgcctgcatggctgtaatcctggcacttttggaggctgaggcagggggatcacttgagtaggcacctgtaatcccagctactcaggaggctgaggcagaagaatagcttgaacccgggagatggaggttgcagtaaatcgagatcacgccactgcactccagcctgggcaacagagcaagactctgtctcaaaaagaaaaaacaatttaagaattggccaagcatggtggcttatgcctgtaatcccagaactttgggaggctaaggcgggcggatcacctgaggtcaggagttcgtgaccagcctgcccaacatggtgaaactctgtctctactaaaaatacaaaaaatagccaggtgtggtgggggcctgtaatcccagctactcaggagcctgaggcaggagaatcacttgaacccgggaggcagaggctgcagtgagccaagattgcgccactgcactccagcctaggtgacagagcgagactctgtctgaaaaaatttaaaaaaaaaaaaaaaaaaaaaaaagccaggcagggtggtgagtgcctgtggtctcagttacccaggaggctgaggtgggaggatcacgagcctaggagttagagacttcagtgtttgcaccactatactccaaacttggtgacagagagagaccctatctcaaacaacaacaacaaaaacagtaatagttgagtacagtattctggtaatataagtgcactaatgagaggaatgaaactcttgaggttctaagtttgtcatctgaggtgcacatggtcatctctaaggccattctttgctcatggtcatataaaaacaggtgaaattttgttttgtgtattttaccataataaaaataacttggggccaggcgcagtggctcatgtctgtaatcccaacactttgggaggccgaggtgggtggatcacttgagatcaggagttagagaccagcctggccaacatggtgaaaccccatctctactgaaaatacagaaattagctggggatggtggcacctgcctataactgtaatatcccagctactcgggagactaaggcgggagaatcacttgaacccgagaggcagaggttgcagtgagccaagatcacgccactgcactccagcctgggtgacaaagcaagactccatctcaaaaaaaaaaaaaaagaacggggaaacagtacaaaaacaggaggtgagccagatgtgatcagcaggtcattgtttgctgactgtagtctaaagtaccggtttggttgttccatgtgcttttcatctgcctggtcctaggaatccaggtttccctgagagagggccacctaactcgatgctacactgctttttttttcttttttttcagtaaagacaaggtctcattatgtttcccagatctcacactcgtgggctcaggcaattctcccacctcagtttcccaaaatgctgggattacaggcatgagtcaccacacctggcttagctgccacacttctgaggcaggggtcttcataagcttactgcttggcccactgtgctcctgggagaagctgttgaaatccctactttggtcagaaggagtttggcacagaggaggcatttgatttttagcacacaggcattatgtgaaaagactgataacattgtcataggggtttttcctttttaaacgttttcttttttgtgaacttttatccaaagattgaaagaagctataagtacaagtaaagaacaggaagcaaagtaccaggccagccacccaaaccttagaaagctggatgatacaggtaagtggatacctgtgtgcacagccacatttgaattctggggggagacctctaggtttggcgttggtccttggggggcagtggcaacctctctggggaggtgggcaggggccccagctgctggcatcacccatgctagccaaagggccttagggaccccgcatgctcttgcggagctgggggtgtgcattatggtggggctcctccttctctccctccctccctccatggagaggagaacaaggaagtgagggcctgcattccattgaaaatgagcctgcccggccagcctggtgcagtaacacacgcctgtaatcccagcactttgggaggccaagctgggtgaatcacctgaggtcaggagtttgtgaccagccttactaataacgtggtgaaaccctgtctctactaaatacaaaaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctgcctgtgtcattctcaattgttccagcagtaaaaagccaactgcagaaaaaccccttggtaaatagaatactggcccctcaaagctgtccacgtcctaatccccagaccccgtgagtgtgttaggttatatggcaaaggtggaattacagttgcagatggagttacaattgctaatcagcaagatggggagattatcctgggttgtccagttgggtccagtgtcatcacaaaggtcccttttaagtggaaagagaagcaggagagagagcagcagagtcagagatctgaagatgctgctggccttgaagatagagaaaggggcccacctgccaaggtacacgggtgaactgtagaaactgcaaaaggcgaggaattagattcttcccaagagctccagaaggagtgcaaccctgaggacaccccgactcagcccagtgagacccatgttggacttctgacctccagaaccgtaagacaagtttgtggtcatttgtcacagcatcagtgagggactaatacagcctccagcccaagcagaaggagcagcagccacatggacaaggtgtgcaagacagtgttgatcgaatcattccacttctatcaagtgataggcccagaaacatcccttatctggaaaggaatttagggctcctggggcctcctccataggcccccacaatagccaggtacattgaaattggtgctagaaaccaaaggcttactgtgctgccttcaagaaaacgatacaccatggaagctctggaacccaccatggttgtggttgatgcagctgaggagagcccagatggaggaagagcggggagcaggagagactaacatcatcagcacagttcattctggaaaggcaagtggaggaagtgagtgtaaattgaaaggcaagggctgggaaaaccggcctcatcacaccctggagaaggggcacaggacactgcacccaagacacaattttaaggaattaaagagagtttttatttgtgcagtatatattaacttaaaagactgaagaaaaaatcgacacagtttgcagaatggtttcagttggttggtgctggaggaaatgtgctaagtctagaaagtgaagtttccctgaaagagataaaccgggatgacagggcttttccgtgtgcgtttagaaactgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtactgagggaaagtgagaaccctctcctaccccgtggaagcgtctcttcttctggcccatgagcctgcgctgtgctcctccctcatccctctggatagcctcagaaccaaccccttcgttccttccacccattttccagatgaaattgttttgggtgtgtgaagcagcatttgaaggaatgtcaattaaccgctctcctggtgtttccttctaaacttagaccctgtccccagaggggctggttctgccatgagtactgatgcttacccaaagaacccacaccttcgagcctatcaccagaagatcgacagcaacctaggtaagactgagcaccacaccagcttctgtaagccactgtccttcaggcagcttacgccaagcatagcccctgcatgagcatcctccagcttcagttccctcaccacacatcacatcccacgccaagctgggtccatcttgccacctcactgtctctggaatctctccacttctcaccatttcctacttctagcccagccgagccctccccacctctcactttcatgaacagcaccagggacccaggagtccctgagaggccataaagtatagcctggacgtgaccgctcacttcatccttcccacctggccactcagagccctgttttcctccttgtgaaatgggctacctctgagaacagtggaaaggttacctgagccagaaagtgcctgggatggtaagagttagtgctcgtgttgcaattggcactttggccacacagcctccagcatgatgtttcaaaacggaagggtgtgcagggggccgggcgcagtggctcacgcctgcaatcccagcactttgggaggccaaggcgggtggatcacccgaggtcaggagttcaagaccagcctgaccaacatggtgaaaccctgtctctactaaaaatacaaaaattagccgggcgtggtggcaggcgcctgtaatcccagctatcgggtggctgaggcaggagaatcacttgaacccgggaggcagaggttgcagtgagccaagatcgcaccattgcactccaacctgggcaacaagagcgaaactccacctaaaaaaaaaaaaaaagaagaagtgaagggtatattcttccagaactctctcatggaaccccacacactcacagtgcagtccaggctctctttggctgccctagtcccttctgccctcatcacctgcaggctcgtgtgggatttctgatgtgagttctttctgcctcgtggcccctatctgcctggatgggctcccccgactctctgtaggctggctccttctctttctgtcagtcttgcattagtatggcctcctctccctgtctctcaggacccttgtgtttccagggggctgccctggccgtttgtgattgtgtatctgctggtttgcctgctgtcttcccaatcagactgtagattccaggacagcatgggagtgtttccattttgtcactactttgtatctggggcccagcaggcaagcacttagtgattatgttttgttttgttttgttttgttttgagacagagttttgcttttgttgcccaggctgcagtgcaatggtgcaatctcagctcactgcaaccgctgcctcctgggttcaagcgattctcctgcctcggcctcccgagtagctggaattacagacatgcaccaccatgctcagctaattttgtatttttagtagagatgaggtttctccttgttggtcaggctggtctcgaactcccgacctcaggtgacccgcctgtctcggcctcccaaagtgctgggattataggtgtgagccactgcgccctagccagtgattattttttgaatggaaaagtcagttacttgaaattcaagtaggtgttggcctgtgggcagttctgtgagtttattctaagtagtgtctcagacttgctgcctcctcctaccgctactccctgagcagaaatctcccccgtggtgacctgggtcaccctgtcagtctcccaccccctgttaggagttggcaaagtgtaggggacaaataataaaatcctcccctgctgtaaaggtatctagtggaaggcaaaactgaaacccatgaagatgcacatggagtgtctgtgcacgggttttctcctgcttgctgtctgggaagccccagacagctgccacctccttctatgccctggactctgtcctccagagccaaagacttatctgaggcagaaggtgtgtctgcccagatctaaccactccagagaagcccagagaggcgtgaaagccctttgtccttcactgcgagaaagggagaggttagggctagtggtatggttggtgcctgctggcagaagtgggagaagggactttgaggaaggatactgcattcagaggcaggaagaagtgctgagtactgcccgccactaggaggtgctgagggtgcacagttggcactgtggacgagcagctgggcagttaccggcaggacgcagtctagagtaggaggtgggcctgggcagaagggcgagtggctagttcagagctcagccctctggccctgctgacacaggccaggccggtccactctggtggggcagggagtgttgcctttgttcacactcttcccgtcttaacactatctccctgctatttcaggatctcaggcaagctctctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttatcttttttttttttttaattttaattatactgtttttctctttcttttcttttcttttttagaaatggagtctcgctttgttgcccaggctagtctccaacttctgggctcaagtgatcctcccacctcagcctcccagagtgctgggattacaagcatgagccactgtgcctgacttgaagacaatctttttatttttatattttttaatttctttctgagagttttactctgtcgcccaggctagagtgcagtggcacaatctcagctcactgcagcctctgcctgctgggttcaagtgattctcatgcctcagcctcccgagtagctgggattacaaggtgtgcaccaccatgcccagctaatttttgtatttttagtagagacggggtttcaccatgttagccaggatggtctcgatctcctgacctcaagtgatccacccacctcggcctcccaaagtgctgggattacaggcatgagccaccacactcagcctatctttttatttcattttttgagacggagtcttgctctgtcgcccaggttggagtgcagtgcattgatctcagcttactgcaacctcctcctctcaggttcaagtgattctcttgcctcagcctcccgagtagcagggaatacaggcatgcaccaccacatctggctaatttttatattttttagtagagatggggtttcaccatgttggccaagctggcctcaaaatcccgacctcatacgatccacccacctcagcctctcaaagtgctgggattacaggcatgagccattgtacccggccaaaactacctttttaaaaaaactgattttggccgggcgcggtggctcacgcctgtaatcctagcactttgggaggccaagacgggcggatcacaaggtaaggagttcgagaccagcctggccaatatggtgaaaccctatctctactaaaaatacaaaaaaaattagtcgggtgtggtggcgtgtgcctgtagtcccagctactcaggaggctgaggcagaagaattgcttgaacccaggagacggaggttgcagtgagccgagatcatggcactgcactccagcctggacaaaagagcaaaatgctgtctcaaaaaaaaaaaaaacaaaaaactgattttgcttagatttgtggtaccagtgctaagcctttgtgtatcctgatcctttttctcttagtgttttatatttaatcttgcaagtaagaaggcttacaaagcaccacctcttctctctcctctctggctctttcctggctgctgttcctagtaaaaaggcagaaagcagccctgggcatatctccctacccccagcgtgcacaaacacacacacacatacacacacacacacacagtcacaaacctgggaaaaggctttactcttcaccctgacagaatcaattaagtcaagactcatctctgcagtgggtgcagtccccccaggcaacacagatccctgtctctcccacttacccacaccatcaagaagcatttgcaggtgccgtgactgtttgctcatgcctgcgtgtcatttcctcctcctgcagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccgtaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgattgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcaggaggctgaggcaggagaatggcatgaacctgggaggcagagcttgcagtgagccgagacagcgccattgcactccagcctgggcaacagagcaagactccgtctcaaaaaaaaaaaaaaaaaaaaaatagtgcactctctggctggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaa

SEQ ID NO: 1995 - DNA, 122 bp, Homo sapiens
  source 1..122: mol_type = genomic DNA
ccggagccattgtggctcaggccggttgcgcctgccctcgggccctcacggaggcgggggttccagggcacgagttcgaggccagcctggtccacatgggtcggaaaaaaggactttttttt

SEQ ID NO: 1996 - DNA, 121 bp, Homo sapiens
  source 1..121: mol_type = genomic DNA
aaaaaaaatccttttttccgacccatgtggaccaggctggcctcgaactcgtgccctggaacccccgcctccgtgagggcccgagggcaggcgcaaccggcctgagccacaatggctccgg

SEQ ID NO: 1997 - DNA, 121 bp, Homo sapiens; identical to SEQ ID NO: 1996
  source 1..121: mol_type = genomic DNA

SEQ ID NO: 1998 - DNA, 122 bp, Homo sapiens
  source 1..122: mol_type = genomic DNA
ccggagccattgtggctcaggcaggttgcgcctgccctcgggccctcacggaggcgggggttccagggcacgagttcgaggccagcctggtccacatgggtcggaaaaaaggactttttttt

SEQ ID NO: 1999 - DNA, 122 bp, Homo sapiens; identical to SEQ ID NO: 1998
  source 1..122: mol_type = genomic DNA

SEQ ID NO: 2000 - DNA, 121 bp, Homo sapiens; identical to SEQ ID NO: 1996
  source 1..121: mol_type = genomic DNA

SEQ ID NO: 2001 - DNA, 122 bp, Homo sapiens; identical to SEQ ID NO: 1995
  source 1..122: mol_type = genomic DNA

SEQ ID NO: 2002 - DNA, 121 bp, Homo sapiens
  source 1..121: mol_type = genomic DNA
ccggagccattgtggctcaggccggttgcgcctgccctcgggccctcacggaggcgggggttccagggcacgagttcgaggccagcctggtccacatgggtcggaaaaaaggatttttttt

SEQ ID NO: 2003 - DNA, 121 bp, Homo sapiens; identical to SEQ ID NO: 1996
  source 1..121: mol_type = genomic DNA

SEQ ID NO: 2004 - DNA, 121 bp, Homo sapiens; identical to SEQ ID NO: 1996
  source 1..121: mol_type = genomic DNA

SEQ ID NO: 2005 - DNA, 121 bp, Homo sapiens; identical to SEQ ID NO: 1996
  source 1..121: mol_type = genomic DNA

SEQ ID NO: 2006 - DNA, 121 bp, Homo sapiens; identical to SEQ ID NO: 1996
  source 1..121: mol_type = genomic DNA

SEQ ID NO: 2007 - DNA, 121 bp, Homo sapiens; identical to SEQ ID NO: 1996
  source 1..121: mol_type = genomic DNA

SEQ ID NO: 2008 - DNA, 121 bp, Homo sapiens; identical to SEQ ID NO: 1996
  source 1..121: mol_type = genomic DNA

SEQ ID NO: 2009 - DNA, 120 bp, Homo sapiens
  source 1..120: mol_type = genomic DNA
aaaaaaatttttttttcaacccatgtggaccaggttggcctcgaactcgtgccctcgaaccctcgcctaccctgagggtccgagggcccgcgcaaccggccggagccacaatggctccgg

SEQ ID NO: 2010 - DNA, 120 bp, Homo sapiens; identical to SEQ ID NO: 2009
  source 1..120: mol_type = genomic DNA

SEQ ID NO: 2011 - DNA, 120 bp, Homo sapiens
  source 1..120: mol_type = genomic DNA
ccggagctattgtggctccggccggttgcgcgggccctcggaccctcagagaggcgagggttcgagggctcgagttcgaggccaacctggtccacatgggttgaaaaaaaaatttttttt

SEQ ID NO: 2012 - DNA, 120 bp, Homo sapiens; identical to SEQ ID NO: 2011
  source 1..120: mol_type = genomic DNA

SEQ ID NO: 2013 - DNA, 119 bp, Homo sapiens
  source 1..119: mol_type = genomic DNA
ccggagccattgtggctccggccggttgcgcgggccctcggaccctcagagaggcgagggttcgagggcacgagttcgaggccaacctggtccacatgggttgaaaaaaaaattttttt

SEQ ID NO: 2014 - DNA, 120 bp, Homo sapiens
  source 1..120: mol_type = genomic DNA
ccggagctattgtggctccggccggttgcgcgggccctcggaccctcagagaggcgagggttcgagggcacgagttcgaggccaacctggtccacatgggttgaaaaaaaaatttttttt

SEQ ID NO: 2015 - DNA, 120 bp, Homo sapiens; identical to SEQ ID NO: 2011
  source 1..120: mol_type = genomic DNA

SEQ ID NO: 2016 - DNA, 119 bp, Homo sapiens
  source 1..119: mol_type = genomic DNA
aaaaaaatttttttttcaacccatgtggaccaggttggccttgaactcgtaccctcgaacccctgcctccctgagggcccgagggcaggcgcatccagccggagccacagtggctccgg

SEQ ID NO: 2017 - DNA, 120 bp, Homo sapiens
  source 1..120: mol_type = genomic DNA
aatttttttttttttttcaacccatgtggaccaggttggcctcgaactcgtgccctcgaaccctcgcctccctgagggtccgagggcccgcgcaaccggctggagccacaatggctccac

SEQ ID NO: 2018 - DNA, 123 bp, Homo sapiens
  source 1..123: mol_type = genomic DNA
ccggagccattgtggctccggccgattgcgccggccctcgggccctcagggaggcgagggtgtgagggtacagagttcgaggccaacttggtccacattggtaggaaaaaaaaaatttttttt

SEQ ID NO: 2019 - DNA, 128 bp, Homo sapiens
  source 1..128: mol_type = genomic DNA
ccggagccattgtggctccggccgattgagcctgccctcgggctctcaaggctaggcgagggtgtgagggactggagttcgaggtcaacctgggccccattggtaggaaaaaaaaaaaaaattttttt

SEQ ID NO: 2020 - DNA, 119 bp, Homo sapiens
  source 1..119: mol_type = genomic DNA
aaaaaaatttttttctcaaccaatgtggacccggttggcctcgaactcgtaccctcgaaccctcccctccctgagggcccgagggcacgcgcaaccggtcggagccacaatagctcggg

SEQ ID NO: 2021 - DNA, 120 bp, Homo sapiens
  source 1..120: mol_type = genomic DNA
aaaaaaattttttttttcaaccaatgtggaccaggttggcctcaaactcgtaccctcgcaccctcgcctccctgagggcccgagggccagcgcaaccggccggagccacagtggctccgg

SEQ ID NO: 2022 - DNA, 121 bp, Homo sapiens
  source 1..121: mol_type = genomic DNA
aaaaaaaattttttttcaaccaatgtggaccaggtgttggcctcgaactcgcactctcgaaccctcgcctccctgaaggcccgagggcaggcgcaaccggccggagccacaatggctccgg

SEQ ID NO: 2023 - DNA, 113101 bp, Homo sapiens
  source 1..113101: mol_type = genomic DNA
tattttcatatatgtatatatttattatgtcacaaatagctacatactggataagccagaaagatgaggaaacatgtttgcatctcacactagtgcagagattctgaaaaagaccccacttggaataccaaaccacacattagattgttctgttcccaattgtgtgccaaagtgcactctgaactgttttggtaaagccgaccgtggagtcatatgaggctgaataacttgggagaatgtaagtctgcaaaataaacctaggactggattgatcctcaggccacttggcaggtgaatgtctcgggagtgaatatgagacaagcttcctgaaaaggcttatatgacttaaagaactttttgtttaagtgtttggtcccaaataaactattaagatatataaagtaattcactgctcaaaaattaccgtcagataaatattaagggaagaaacactttaaaggagaatttgtatccacataaatccttaaattcatggtcacaactttcctaatctcaaattgttctaggtcactgctatcagtctagttctgtcctctatttcttaatttaataccaatacttttaaatttttaaaatatgctgctttaggtagatttaaaatatatcctaaccgccactttctaaccttcctgaaatatactgttcaataacaaatcctttccttgcttaaacataacttaaataaaacaagaaacttaccatttctctctagtgtaagatgacacatgcagcttagcactctgtagtagtctctcttcaattaggtaaaaaaggaagtttctatggtaaccatccttatagtcactcattcctccttccttcctcaccagcgcccaatatatatcacattactcatgaatacatataaactgctagcatgtctagaatattctgtcttgaaattatactttctactagtgacttttagaaatgactatgccccagaataattaaaaagagaaaccaaataatttttaaattaatttatacagagtttttcaccatcaagtttattttcagcacccatggggagttaatagatcttccctgaaagagaaaaacctttcctaaggaaaaatcctagaattcatatatttggcaacatttaaaggaggccatgaaatttttatcagtctagagaattgatctcctttaaggtgactctggtagttccaacgatgtttaaaggcatttcctgtaaaaaaaaaaaaaaaaagagagcgagagaaaaagagagagagagagagagaatttctgatgattaaaaaaaaaaagtgaggaatgctgagttaaacaaagttaaccacattctctcagagccttgaatgtgctaatatgtgctaatgtgtcttatggctctctaaggagggtgtagtcaaaatcatcttctacactgcttagttcccgggaacccactttttttttttttttattcatggtcgaatattatttattgtcagaaaggtacagcattcacaccaatatcagacaaaatagattttaactaaaaaattatttcgagacaaaaataacaatatatgttaataaaaggctcaattaaaaatgtataacaattataaacacatacacatcaaacaacagttccccaaaatacgtaaagcaaacattgacaggattgaagggagaaatagaccactctacaatagtagttggggtcttcaacaccccactttcaataattaatcacagccacttaaggaaccagtgcataccaaaacacacttctggcagtgttgcttcagggaattccgagtgtagggttaatgttccattttctctacctcttctaaaattcctccttcttcaaatggctattaataactttatatttttgtcctttgtgtcagttcttaattcatgttgcttataagcatgatttttattattaaagtgagatgggataaaaataaaatatttttgcaatgagataacgttttattttaattctcaccatttatatacaaacacaagtgaataaaacacatcgcaaaatggtaaaatttcatatttagtatttataggtgcatagtttcatgctcacatatttttaagtattatatatattaacaaatttcacaatacgtcattattcttagacagtatcattaaaagacacctaaaaatcttataatatatgatagcaaatcactaacaacttctgaacaacagcaacaaaaaaatagtgaggatttagaaataagtggtagtcacttaggtgtttttaatttgttttaacatcgtagattgaagccacaaaatccacagcacacaaagaccctgctaccatgtattcacttcagtgaaagggaagcaccgaaatgctgagtgggggcaggtacagatacttcaatcactgctgatggaagacttcgagatacactgtaaaaactttgagaaatgtcatgactgggcacattggaactgagcacttgtacaggatggaacatctgtcagcagatctcaagaaactgggagcaaagatatttcttaggcttcaggttcgtagtcttgatacccttcctaatattagaaaaatcaaaaagacagcacacactgttagtataagtttcaattacgcatcagcactgacagccaatgagataggaaatggctccccacttacactaaaatttacaatcaatgtttttgcaaatattctgcagcaaatattatcttatttttaatagttgtgtctttcttgtctgatataaaagtgaattacagtagtagtcagagttaaaatatctaggttctgatccggatgcaccatttaatgatcatatacctagtttggtaggacaaataagttggactgtctggttctcagtttcttcacctgtaaaatgtgagaacaaaatcaagctgtctataaagccttttccagactaagatgctctaattctcagaaggaaattaagatgtttgaaggcaagatacattttccctactttcactctcccagttgaaaatttcgtcttcatctatggcttcaattattacttgtatttcaaacctcaagctctccatacagtatctggatagcatccacaacacaaatattaatggatttaattaaagggatcagattattcctcctaaagagcaactctaataatatcaggattctgcttaaaaacaaacaaataagcataacttcaataactcaagttgttttctgaatagaatacaagctgaaatgacaagattatcctaatactctataacttgtctttgacccatagctgcaaattcaatctatcaccattttccttgttcctaagcttgagtcataattattcactgttctcagacatatccatttgcatgctcagacatacatgcctttgcttctgatattcccttgtgccagaatgtcctctgtttgttttgacctactatatctcttaccttttcccacccagatcaacattacctcctcaataaaacttctcctgattgattgaaacagatctttaaaatgttttactttttagtatgtcttatatatttttgctcctgtgatgcctggtacatcgaagacaatcaattatgtttgttaaaggaatcataatgaagaaatgaatgaatgaatttctattttttttcatcaaacctaccagactgtaaactccttatgtcctggtaatgtcaattactctatagttttccattgtgtttagtactgtgtcttgcataaaagaccccaaaatattggaaattcttattaggcaaacaaacaatttaatctcaatttctataagttgaattattatcaatatgcctttcgtgtgtctgtgtgagacagtcttgctctgttaccaagattggagtgcaggggtgccatctcagctcactgcaacctctgcctcctgggttcaagtgactctcatgcctcagcctcccaagtagctggaaccataggcgtgtaccaccatgcccggctaatttttgtatttttagtagagatggggtttcaccatgttggccagactggtctccaactcctggcctcaagtaacctggccactttggctcacaaagtgcgggattacaggtgtgaactgctgtgcccatcctcgacatgccttttaataatgccgtgaggaataatacataaccaaactacaacatacttgaactcaatttttaatggagccattatatagtttcttttcttgtgatatcttcatttggttttgattatcagggtaatattggtctcacaaaattagttgggaaatgtctcctcttctgttttgtaagagatattaattggtgttaactaattagtattaattcctctttaaatgtttggtagaatttaccagtgatgccatctcggcctgggattttctttgcaggtaggtttttttttttattactaatttaatctattcgctgtgttacaaatctattcagatttactgtttcttcttgggccagttttattcatctaacagtattttctaatttcccttttgatacattttctattaaagatactttcattttcaatcaaaataaaattaacaatcatattgtgttgtttaaaacattatactggaatatatcaattgtcgcaaatcatgcatttatctttttattctataacttgtgtgggtaacttttattttactatgcgtcatcccattggacatgtatggcaaaaaataataaccttcctttggcattccattgatttccctaactttccatttagaaatttattttagaatgtaaagtttctaaaaatatattctctaatgcaggggttagtaaacttttcctgtaaagggtcaagtagtaagtatattaagctatgtggactacatatgatttcttttacatcctttcttcctcttcttcatcttcctcctcctctttttttttaaggaccctttaaaaatgtaaaaactattcttaacttgcaagttgtccacgtaatgagcatgtagagagcaaatgattctcactaagcactaatgaaagagaaatgtgacaatgacaggtttttggtactgtcttgttagaaagattcagcttggactcctacctcagaaggcatttcataagcctcattgtcaggatccacaggcatatcttccagaattccttcctgtggggctccttcttcattctaatatttaaagtaagaagcacaaaaagaacatgatgaagtagcatttttcacttttaaaaatcagaaccatgttttggaaaaatcttacatatagggatgttggccacggatcttgaaaatggcacaccttaatattactactggcattctaaactccacaatgcctccggggaaacattgcggcaacatgggttatcaaccctcaaagtatgtaaactttttgctcaagtaatttactatttaggaaataatccacagctatagtccaaagatatttttcacaagatcaatgacagcaggaaacaaaatttttagaattgttaactaaatgttcaatgaataatgaagagttaaaaaattattgctgggtgcagtggttcactcctgtgatttcagcactttgggaggctgaggcaggtggatcatttgagtccaggagttcaagaccagcctgggctgttacaatgaaaccccatctctactaaaaatacaaataaatagctgggcatggtggcacatgcctacagtcccagccacttgggaggctgaggcaggaggatcacttgagcctgggaggtagaggctacagtgagccatgtgcatgccactgcattctagcctgggtgacagagggagaccttgtcttaaaaaaaattatcattcaactactcagtagattatgataaagacctgtattactattacctgagaattatgtaacaactacctatttatggtataatatttagcaggctataaagtgttgtctatattatagatacaacctacacagaattcagacgcaaaggtaaaaagtttggaagaaaacacaataaaatatgaaagttattttgttggatagtatgtatgttattttgactttttttctaagtgtttaacttttataaccacttataatgtaaaagcatacatatttaacacattaattttaaatgacaatgaagaaacaaattcttttctgaaatttgaagactgagactatacatattgaaggaaaataatcaaatacatggtcagaaaatttttctaggtatctcttcctagacaaagaatactacaaaactcagcctgaaatggtcatggctttgttggtattcttcactaaataccttttgttgctttgcatttatttcagcaaagtaattataagaagataaaggtaagtgaaaattcaaagaacagagaggcaatgtgagcctaaagggacttggagaaagagatcaaataatccctcagccaacgcggctgattttcaacaacatgtctgatgtaaaaaagcttccccatgtcttcacatggaagtgactgacagggacgcagaagtataagaaaatggctaacagtaagaaaaggtcacactaaagatcatgcttatggtaggtgggcagagaagcttacagatcattctgcccttgccaatgccctttttataaactaaaaaaaatccaaataatatataaattaaataaaatatgaaccaccccaaactacctcactttaaaatgtggagtaaacatactgttttcgtagtgtttcacttcttggtagatacgcctctgctgcaggatggctaggcacaaggccttccatgtcacaggacttgagctcaagtcctagcttctctagatgacagagcttttgtgatgctgagaagtttcctatgctttttctgagtgtcaattagtcttagtgatcaaacgggacagcaaaaccttctttacaacagggagaaggaaacgacatcattaactttctcattaatatttagattactgttaggatatccaagtataagggaaataaggcaaatttttttccatgattttgaaactgacagagatttgattttctaatataatttgttagaaaattttgatatggaccagacaagtaaatatggcagacctaccctgtttgttgtttgatgatcaaaaaggagttgttatgacggaactaagactgatggatattactggatttgtttatatgttatttggctgaactttgaaggatgtacacagatgtgtaggttaggtgagtgtgtgtgtctgcatggttccagcctgggtgagtgggtgtgtacaagagcaccctgcagtaatggaacagcgtcctgtccggggtgggttcccatattgctccctgagctgccaggataggctccaaccacctgcggcctccaccgaaataattaggtaagttatttgacttgtttgtattaatctttcttaaacgtatatatagctcacattaatttcaatgtttaatgtcagaagtgatttatctttatttaggagtttgatggtgtttttgtgtccagaaatttgccataggacttaattcttgcttatatcaattagccaatggtaaaactggttttgttatatgttgttttgcttcaagtcacagtttccagaaactattgatgaagttaagtgaggatttactgtattatgtgccctctgatggaagtacatacacatcaccatcttaaactaagactgtactagtttaagtgggctattgttcactgatccaataacttcatcaagtgggaacaagctacactagggatgacagcacaatcctattctagagtccaaatcgacaatagggtttacgacctcgatgttggatcaggtcatcctaatggtgtaactgctattaaaggttcgtttgttcgacaattgaagtcctacatgatcggtgaggtcaggagatctatagcatcctggccaacatggtgaaaccccatctctactaaaatacaaaaagttagccgggcgtggtggttctcctatagtcccagctactcgggagactgagccaggggaatcacttgaacccgggaggtggagattgcagtgagcccagatcacaccattgcactccagcctggtgacggagtgagactccgtctcaaaataaataaataaatatataaatagaaaaagaaaacaaaaaaagaaaagccctacgtgatccgaatttgaatttgattaacatttaactatcactgacaacttacagcaaatataaggtggtgaaaaacatgttcattgcttacaacagtggctacaatcagcaaattttgcactgtgagaaactacacaagacaaagaatacgtctaatttcaataagtaaattgcaactaaaaagaagttagtgggaacctgccgcttaaagtagaagtgagagagcattagccaattgcaacctaagaactttatttcattctcattgggaaccctacataagcaaatggaaaacacatatgaggtagttggggaaatttgaacactgacttgatatttaagaattattgtttatttctttaggtgtgatgatatattgcagttttacttcaaaaagttcttaacttttacaaattaattaaatgtttacagatcaaataagatatctatctaggtttgggtgggggaaatgggtgggatatagaagaaacatgagtttaatatttcatcagttttaaaaagtatatacagtagtctccttttatccgtggttttgttttccatggtttcagttgcccaccaccaattgcaaccccaaaatactaagatatttagagacagagagagagggaaagagaaagcgagaccatacccacataacttttattacagtatattattataattgttctcttttgttattagttattgttgttaatctcttactgtgcctagtttataaattaaactttttcataggtacataagcattggaaaaaacagtatatgtagggtttgctactatccgcaatttcaggtgtcctagtgggggtttcagaatgtatccctgtagataaaggaagactgctgtatgctcatttcaatagttagttctctaactatgtttttctgaatatgtgatctaaatttgttgactctatcacattcgtagattttaagcatactaaaatatttggcagctattccaaggagaatataacaacaaacacttcatatgaccatcagacacaattttatccctatacctgtatatttactgtttcataaacctatttctaaaaacattgttatctataaagaaatattaaatttcaactccaatttacaactgtgcctaatatagtttggctgtaacaaaaaaagaacattaaaatttgcattttatgagtattcatgacttgttttcaaaatataatcatacttgaaggtgtgaagtgcaccttctatttatttttaccacaaacaagaaaaaaaactaccaatataacaaatgttaaacacttttgaaaaaatcaattttttctcaaattttcattatgatattatattaacccagaatatgttagggcaataaaataaatgagaaaaacgtctggattttggtatatgcctgtatgcttaataagagaacctacagggtaggatatagagacatagtaagaaaataccttttattctctctctactaggccctatccctggaatagctgtagacttttttttttcaaatgggattgttttacgaacagtgaaatagactcagttcagtatcttatatctgcatttgacacacagaaagaaaaatggttatcaaaaaattacaatggaatgaccctcattgctaataaggaaagacttaaaagctatattaggaaacagaaatggctgagactgacctctttctccctaaaaagcttattcaagttctttttaaataaacctgtagggttgaatagctgatataactgattatcatttcgtactcgtcccagctgaagtgctctataaaacagatcatgagacgaagcttccttcactgctaatagcttattgggaagtacaattccagggaagtgaaagtgaaggaaaagggaagtgatacaaggagaagtaggaaaaaatttcagctactgtctttaggaatacaactacagaatttacataatctttttaaatttcctgttttgaaccatattgtatttagatacctagtaatactttctgtaaggaaattatctttattcaattctatgacttataactttaattttaaatatatttaaaatgacacataataaaggcaaaaattgctttccaaaccacactcttctagaatcatctagggcccttgttaaaaatgcaggtttgtagggccttgtgagtgtcttgttaagtatgttccttggaaaccactgcccgacatcaccaattgtttgtaaaccctgtggtataatttaatatagagtataccaatgtacttgctgtcagtgtgaataattttttttaaaaaagatatgctcattttgaagtccatcaaatgttggcaaatgttgagggttatctgaagacactgggaagtaatccatggtgatcgttaaaatagcaaggtttcatcaattatctggtatctatgctttgtcaaagttagaaatgtagagatacatttctaaattaaaacttttatgtgggaagaaaaattgaaattcaaggctggttggtctttggtatacccaaagaacaaagaggaggttggaggtgttctgaaaaagagaaatgatacacgctgctctttgagaaagttcattggcactagaaaggttctggggagctagtaagcttcaattggtgagtgacagtggtgggcaaaattagtcctagagctgcagcaagttttttcagcagttacagaaaaaattggtcccaggttacaacaggcagcctcagcatgcggacttgtagaaaattacacttttggagcaatgtgatgtttcttgaatgcttttcctcccaggcttcttgattgttttagttgggtataacaagaatgacccaatttgtgtgatcaactttcacagccttaaacattcaaagcagcagaagcgcactttctcttttgcccactgcttttacacttgaagatattttgggtagaaccattgttttgctgcattattgaacaatgtcacttagcctcaaataatggaattaataccttcactcaacaactcacaccaggaggatgaaggagagagatagtagccaaaaagataaaagaagaaactaaaaaagaactttgacttaagaggaaaaaaaggttcaacttaagcacacacccgtgttccaaaatgaaatcaagcccagaactcgtatttaaataaaaatagcatagacgtttcaaaaatgtgaatattctctacttctctacctcagacaggggagtgtgtacatagtgtagatagtatatttcactaagagaattaccatgtattttattgatgcacttaaaaatgaaggcgatagacatgaataccttgttaaaaagcaaggtaaagatatatttcatatgttcaattttctattatcaattcctagtctgctcataatgccattttggggtggggagcaaagggcatctgattcaaaatcaaactaatctcaatttttgataaaatctaaggaattttatttttaaaacattgaattaaagcaaactttggatactctgatttctcttgaggtcataaatcctctgcctttttaagagatctatgtggagaggaacaactctgggtcttaaacgaattattgaggtcttgttttggaaaggctagatattttgttaaaaaatataagatttcaaaaaacctaaaactttggacaatgttatttaatcatcaaaagcaaaacaatatgcatatttcagaaataacactatattttcagtcttactattatgcataagaaagaacaatataaaaataatgtaatgattacatttattgtttacatactctgaggagtatttaattgcatcctagtaagtatattctgtcacatgagaagccatagaaattggcatgttctgctgtatccaatgcccaaaggataataaagcatgataaaattacacttaacgaacccaacctccttttccaattatatatggttaagttaaaattcaaactttaatttttgggaaagtatagttatggcttagatctaaggtagaaataaaatgaccaaaggacttggtgcatttaacattctataactttagaaatgcatcaaagtggcaagcccagcattaagagctatttgtcactaagggcctgtggttgaagtctgttggatccatctgttctttctgaggcaatatgcagacgaaaggtaaggggagttgcaacataatttgtaatatttgatacattataatacatgataaattataatatattagaaatataatttatagcattacatctagtaagatagatgtaaaagggaacaggtaagtgaaagggcaaggcataagtcttgtatagagtgacaggtctggtacagtcctactaccaaatctataactatagtattttgaatattttgcactatttcaatgtagcagtattttaggtttggttggcctgactttacaacaagataaaaaattccaagttttaacaatgtagtgacctactgtgttttagatgttgaaatctataattttctatcaacattttctactaacctgtaaaagacatgccttagaatgtgggaacacacacaaacacatacatactcacagacacatacacacgaagtacagtagaccactgatgatctctggtgccacttcctgagatcattttgaatgttctaattaaaaagtgcaaagtataattttttgtcataaattatacatgctatgctattatatatgctaagccaaacctagcaacaaggctgagtgaagatgtggctcctgggtcatatgctaggctttctttcggcaaatggacttgctctccctcagttatgttacatacctactcagatcaggtctcagcaaatgtacaaattactatgtcatcagccatctggatcacttgggaatagtcacattggtgaacgctgtaagtcatatcttaaatacattatacataatccatacctacagattgagaatgcaaatctattttaattaaatgatacctttagagaacccagtcttacacataaataacatatatttagaagccatttatgctctactttgtttatcttttgtttagaggcagggtcttgccctattgcccaggctgtaatgcagtgatacaatcatagctcactgtagtctccaactcctgggcccaagtgatcctccagcctcagcctcccaaatagctgggactataggcttacaccaccatgctcggctatttaaattttttttttttatagagatgaagtttcattatgttgcccaggctggtctcaaactcctggactcaagtgatcctcctgcgtcagcctccgaaagtgctgggattacaggcatgagccactgcacctgagccgtgctctactttggataatctgttactatcttactgattttcttgtcttttgcccttctagctgtttctttagtcttggcaatcaccttagagagagagaaaaagagaaaagatgaaataaaaacaatttatttcagtttttaaaggtttggcagtggaggagagagtaaagctaatatattaaatatatttggggttattttggggagctatttactagttttatctctgaattcaggtttaaatacattcaaccataaattaaaaaataattggtggataaatcaggaattggtgcaaaatcatttttaagaagaaaatgtcattatatagcaaagaggtagtatgctgctttaaatccttattttccttggcaagcctaacaagcagggcagtgcctgctgtatttatggtagtgccatataattagctgactcacctaataagacttcacagcgcagcaacaactgccagctttttttgtcctgttacttggatagactcggttgaatatactaatgcacaaagggaaatctgggaataaactatttttacttttcatgtctaagggctgatcctcctcttctagaaataaaatttattatgtatgttaaactatattcaaatttgtttactattttaagctttcatggattagaatcttgaaggtcagccccttgggtagtgactgaataagacattaacgatgtgaagatgggtcaagctgagaaaggtttgctcttgtgctgagctcagaatcaataagtcatttcatgtttgcaaatacaatgatatttggaggcaggtctttttttttttttttttttttttttttttttgagacagagtctcgctctgtcgcccaggctggagtgcagtggcgcgatctcagctcactgcaagctctgcctcacgggatcacgccattctcctgcttcagcctcccgagtagctgggactacaggcgctcaccaccacgcctggctaatttttttgtaattttagtagagacagggtttcactgtgttagccaggatggtctcgatctcctgacctcgtgatccacctaccttggcctcccaaagtgctgggattacaggcgtgagccactgcgcccggccagaggcaggtcttaaaactagcaactgggtgagaaatcagtggggagggtaggctttgacaaagtaagagataaagagtctgctttcatattttagaaaaacccagggaatgctgaaaagcccataggaaagaagaaatatgctgtcaagatgttagtgagccaaggcccaggagtttgctctcaaaaacagatgagaaactggacttaaaatctgactgggagaaagtactttaggcaaaacaaactactcatatacaaaaggatgggctctgaagcagagagtgaaggcaatagcttcaagatcggtggatttaaaacctagaagtatcttctctaaaagataaaagattaagaaaggctttaagatagctagagcaggaataaagtagtcaagtgaatgtgataccacaaggttccagaagtttccatactaatagaaacagatactaagtgaagtttgaggggccctcacaatctggatagaaaactcttcaagtagatctcaaccttcaggctggaatatctttgcttagctatcccagccagaggaccatagtggttgatttcaaaaggagttgcaattattctatcttgtaaattctctcattgttaagttttgtcacagtttgttgttgctactttctttcagttacctagaaaatgttttctctgaaaacctctatccatgcctcaacagatcggagataaaaaaggaatcatcttacaagattatcaagaaagataatgggctaggtgtatccttaaaaggtcattcaaatgaaatattaaaattcttacttttctgtgttattcggacatggaataacaataacagttaatgtttatttggtgcttactctgtatttggtaccatttcaagagttttatatgcattatttgatcttaaaaaacaactctttgaggaagttactactgtctccattttatcagtgaatgaacagagataggaagtctggctccaaagcccacactcttaactattatgcaatattagttgtcaaatgtcttgaaaaaaaaatctgtgtaattactaaaatattacgctgggctacttattaaggtaaaattacgtttcaaaaaaattaatcctttccaaatgcaatgttaactattcatgatgaaatatcagaactatctctaataccaatatttttattggaataaaataggaggttaaaggaaatgtttatatatataaatgtgtgtatatatatgtatatacatatatatatactatgcacacacacacatacatatctatgtgtatatatatgattttttgcaagggcaaaaaccagattttttttaaacacataatcattaaatctgcaaatatcaagtttatcaattttttgttacaggaaaaaatagtttattataaattcaatgcatagcattttctggtttagacctttccattattgttctgacagaacaaagactatgaggttgtcagaaataaattgttcattttgtttcctaaatatgtggcaaagacattgtatgttttttgtttgtttgcttgtttgtttgttttagaatagtttgaaatgtcttcaaaccttttgaccaaccaagaaagcttttgcctgggcacaggctttatctttcttagcattacactagagatactaatccctcccaacaatttcattatgattatcgcaataaaatataacgatccattaagtccatggggcagatgtttatttatttataaccatgccttattccacagagaatttaaagaggaataaaagattatttcctcattgcatcaaatgaatatcttttattttgtctaatgttgtatttctttttctttaattggcactaaatgtttatttgcattcttttaattacttttaaggcatccattatttctggattacattactgaactctcaataaatcaatacatagttctgtatataattttttcaacattttttccttctttaatttggttcatttgtatctccctttgctgtttattgagtagaaattctgatttttgtagcaaagggagaacaaacaaacaacacacagaatattctgtatttaatgctgcaattgtctctatggttgcaatgtgtaggtggggtgcattcaagtgggcttgtggtatttgtgtgtgtgtgtgtgtgtatgtgtgtgtgtgtgttggaagaatatatattgaggatgattcctaattttatcactttgttgaggaactgaaattgtggctacacattcactctaaatattttgtctcacagtcccctcccttcaacaattatatacagtacactatttgttggaagctcaggagaaaaagggcatttaagagcatgagatttggtggcagactgacctaatagtagatggtaccagtgagatcttgagcaacgtaaatgtttcaactgaaaaacggtaacaataaaacatttttcagagtgatgttgtactaaatgaaatgatatacataaagtagcctataatgacccatgcacagtcataatatcaaatatttactgagcatctactatgtgctagattattttaagcacttttgaaaatataagtattttgataaatgtatatcatatattgtcttaataagattatattgttgttatatttcatcttattgctaattttatttttttaagaaaacctttttttggaaagaatcgaaactaaaaacccaactatttaaaaaatggaaacttttggccgggaacggaggctcacacctataatctcagcactttgggaggccgaatgggcggatcacaaggtcaagagattgagaccatcctggccaacgtggtgaaactccgtctctactaaaaatacaaaagttagctgggcatggtggcacatgcctgtagtcccagctactcgggaggctgaggcagaagaatcgctggaacccaggaggcggaggttgcagtgagccgagacagcaccactgcactccagactggcgacagagtgagactccatctaaaaaaaaaaaaaaggaaccttttgccttacttcgtttgctagctacattcaagtctgcaattaagctcggtgttttgcctttctcaaactgtgcacaggtcctcttgtttgttccccttctctctgttgcctaggaatacagccaaaaacttgagtaatagatgatagatgggtctgtcactaagcacatcctagtgacatagataagaagcaaatgctacaaaattataggtgcaaactacaagttgtgttttaattggttttaacaagtacttataagcagaagaactgtgaaaaatctaacattttgtcctacttgcaagcctgccagtcttttgagtgctgggcaaagacacaatagtgctgggtcagagacaattaactttactactcacattaatagcattagcaagagtatcatgattttcttgcactgattcctcaagccgcaattcccacagaaaagctcaggtgacacctacatgctcagtgggttgcattagaaaagaggaacgcagagctcaggaaacatggatattttataatggccagtaaagatgtccctttgctttagaaagaggcactacctctatccaaggctgcaagcacacctgccttttgttttagaaggagaaatgatttctatcttccaaggctgttcactatatgaaaagacagtcccaaacaaaaggcagttactgacttgcttgaaaaatgtgcagaaatgatacgctgcttgaatgtggacagctgacacagggacaaggagtaaaaatgattaggttttgagcttgaccaactaggaagataattattagcagtagagaaaaaaagaacaaagtagattttagggcagataagccattttttaggtaggttgagtctgagatgcctccataaatataagttgaaaatatgagattggagttgagacttcagaaatacatattttgagtagttacactacagaggtaagtcatcagagttcataaaattaaagtgagaaaaagaggcaagtgaagaaaaacaagatggcattgcatgaagaactttcttaggaaggaaggcagcaaagaggtaaaattggaggtgtagtcagagatggaagatgaaaaaggaaaataacaatatttcagaaatgaaatgaaaaaggtcttttactaagtaattggtactactacttgtcagtttcaagtgctgtaaaaaaaatgggaagaaccacacatgtgcactttcagtactatgtattttatgcttcagggatgcatacctgtttaacaaaagtatgttttttctcaaagtgtgttgaatagtccagaaaaagatggaggtagaagtcagacttcaggagataaaggaaccagaaagatcattgaaggctgtgatggtagaaaacattttgacaaagagttgtgcaatgagaaagctaggggtgggacaattaattttgagggtaacaattggggatttgagtagattttttgcttctgttctttaattgttttgtcttctttttaaagaaaccaagagactgttaatgtagtaggagcagagtttcacaatacagagcagagagggtgttggttgataaagaattgtctcaaatgagaggaaaagaatggagccaataacagagatgatgtttaatttgggaaaggtgggacatgttaacatgagtccagagaactaaaatgagcttatggcatgcagatgctgaagatgaagaaaggaaaggaaggaaaaggaggaatttatatttatttattgaataatcttgtaaaactgttaatcacccctttttactgacgataagacataaatgtcagaggtgttttgcctaaagtaaaaaattcgatagtcaagctgggtttaaaaccatatcagtcttacgtcaaagcatgttttaattgctgttgtgtggttgtgattttaagggaagaagaagagttttataatgggttctctgaaaaataaaatatcaattagaaagaaacaaaacaactgctgagaagcagtgaatccaagcagaatctgagtatcatcactttttagttaaactaaccagtccaatatcctgatttttctttaacaggcaaagaatttttgagtctttcccatagactgagttcttgtgaactattttacagcaataatggcatccaatcctatagataacaataacaaagctgcagaccattttgttgccaggtttctcctccagggtggctttccagctagtttgtaaacaaataactcaggtggccctgtcatgttacattaactaaaaaccaagtctaaagcacacatataataacatatgtgtgtgcaaactggcttgctttcaaattcctaaatcatacaattaaattttaaaaataactgtatttggaaacaagaaaaaagtcactttgacacccaactgatgtatataaaggagactgtgcatatgggttttaaaatgagatgaaaattgaaatttgatctttgagattaaaaacaatgttatgtaaatctatttttatttaatttttctgaaaaatattgtatttgctttataccctcttgctatacaaacttatattgttttgcttaccctctttttttattcctcctactttttcttaattttgatatctctgaatttaaagtctagagaatgattcatcttcactagttctatcttttccagtgctagtatttttgtttttgagctgtggtttccctatcccatttttgagatctcaaactataatttggtgtcgagtacccaggtatcttatctttaaagtgaagacgtaggcagcacaaaggtgcttttattagaacgtccactagatcagaatgaccagtgcacaaaatttattttcctagcagactcaccaaatttaacctggaagagaatgtctgactctgttgaattttcttaggcaaatacaatatttgaaagtcactgaatgtttcaaacaaaatataacaacattcagataacagaactgtgttattgttctcatgtgtttatgcccagaaaataagcagactggagcttctctaagattaaaagtcaaaacagtattacaattccagcccagatttgactatctaatcatttaaaccttagtatcatcatcatcaccaccgtcactgcatactcattaagttaaaaaaaattcctttaaaataaatggaaaagaaaatatctgtgtaaatagattaaagcgattcctgctcaccactccctttctccctggggcaggagacttgagcacatcaaaggaactcatagcgttcttggagtaagtgtgaaagccaccgtgatgaactaaatgaatgcttacatctaaagaaagatgtaaacatattacattaaaaggtggcatgacataatggtatatcactgattaagaaatgtgaggcgactttcatgtgccactgataaatcattataatttgacatagtagataatgcccctatatttcatctgcatacctggaaaatgaggactttcaaaacatattcctgccagttacagtcaggtattgcaaaacaagcatttagtgagcatctaaactgaagcttagaacttcagttttgtggcggggcgcggtggctcacgcctgtaatcccagcaccttgggaggccaagacaggcggatcacttgaggtcaggagtttgggaccagcctggcccacatggtgaaaccccatctctactaaaaatacaaaaattagccaggcatggttgcacgcacctgtagtcccagttactcaggtggctgaggcagaagaatcgcttgaacctgggtggtggagattgcagtgagctgagatcctgccactgcactccagcctgggcaagagagtgagactccatctcaaaaaaataaagaactccaattttattttcttcatggcatagcataatagatgagttaacaaattaatgaaacagattgacatgtgttaattgcaatcatatacagaacagaaatcatttccataaaatatttaacctgcctgttacttcccctaaatctctctgtagctgatgccccaatttcactattagctcttcagacttggatgttaagcactgtgccttcccctggacctctctttaaatgtcacagctatttctggcaggtaagactattgctttggttagtgtgaacacacaccactgtggatcacaaggcacctgagagaaaaggctgccgaaagcaggaaaataactcagaaaaaagaaaaaaaaacacatggtgctgaaaaatacaacagatatgcatttgtatacttatgatctaatttatgtcagtcattaaaagaaaataaggtgtttagaaaatacagtgctgtctatggttatatttaatattgtgaccacttaatacaaagcaaagcattcttgcttgctctcatggagagtgcaatttagaattgagagctcaatttctaaggagggtttatgtactctatcttgaggcacaccaaggagattgagtttaccagtttagaaagcactgccataattcaagtcagggagagggctgatggaagatttttaaaagattttaaaagatcatgagggcaagctggcttttaacaaaacaaaatatttccatgtggcttctggctgactgaattaataaggcccagagactgatctgaaggcaaaagcctttattttttattgcaatggagaaaaactgaacattatttgactatcagttgtgaagtttagtaaaaagattttcactaatgggtggttttaatatttatgaatgtgatggttcagcaaattttctccaatgttttgcaagaccactaattaataatcatctttacaaatggaacatgtaattgtctgctactattttttctttgccaatgcttaatacttattttgaatacgttttattttttttctaaatttctctatttatttctacctgagcatttcttaatttttttattcagtcctgttattctcactgtaggatttttaaaagctggtatattatattaaaatccttcaactgtgaattcagcaatgttttgagttccagggattcatctggcattaggctgaccttgtcaagcataaacatcaacattaaagaaaatatttaagaaatgaaaggcctgaatcaaaataagaggtcaaattttccagggtgttttgtgtcttgaaaatctttctgctgtaattacctaaagactgtggttagataattattgagggacttttgcaattgtcccttttctctatatagatcaccacattaattaaacgagagtctcactgggaacaggttgctgttctgcatctttaagtatttttagtactttattttcaaaagagaaaaagaaccactaagaagaagattgcttctcagccaaattttctgatatacagatattctcaaaagacaagcacacacacacacgcacacacacacacacacacacacacacacaccccccaaggctctggaatgtgccttaacaatcttatttttgcacattttaaaaggaggtcattatgaaatttgcacatattttatgacctgtaatgtacttctctgatctgatttcacttgagctaataaaaaaatacaaatcaggtgcttgctgtgatcaagatgctaaagttatatttacactgcttcataaatgtaaggtgttaaagcttagtgagacaagaagtaaactgataattgattaaccagggtgctatacaaatctacctagagggtgccttcccaggttaatgcaattatgggagaaagatcctggctcctggctacagaaatgccaactaaagtgttatccaccccatccttcactttggaggatgcgttaagatgacactgtgctgtgtcaaaatgaaaatacaaacaaaagcaaataaaccgagtgataataaataaaccgagtgactcagtttccttatccattttccagttacctttttttttttaggccagtctgcatgtccactagaagaaaagggacctgggttcttcatcagcccatccttagatcttagtgcacatatgcacctagtaagtgccgagcaaatattcaatgaatgactgtacctttcctaagaattcttcgttgattatccttcaacagagctaacttctctccctatgtgctcagtcaaatgctctcccattggactgagttcagcataaactgccatgttttgagatgattggtgtaagcgaatgtcctctcctgagttgcgagaatctaagagcaggacaacatcacatgcttctctactttctatagttcttttgtccactgtctaacaaataatgccaagtgaaaaagggaaaaatgaatgaataaattttgtaagatgccaatggaaaaaaacagaaaatcaagagttactaaaaaaaaccactaactccatttaattgttttagactaagaatccctcagtgatacctagccaaaattaggattcagatccaaaataaaagatactgttgccccaagtagatatcataatttgttacaataagtaaaaatgtatattattcaatactaaactgttataccacatttcaagtttttaaaactttatcttccttttatgcatagatagtagtagagcattaagaacatgcatggctatcacctgaggtgttgattgtaaattcacattcctaggctttgtctcttaactactgaatcggaatctttgggagtgaactgacaggaatctgaattttaaaaataaggtcttcaggtgattctcatgcatctaaagataactgctttaatatataacaaagaaacccaaagagggacacttgaggattttttcaatatatcttcttttgcagagattaatagtgaatgttgttttatctgctgtttagaattttacatatgcattggatgatacatcttcttttactgacaaaaaggcttttctctggagaaaataaaaaggcagctttccctgagagcacacacttctagcaaagccccaatccatatgactctaagacagagtgatttccaccttctagtccttactttcttgcaaaaggggctttcaaatctcattactgatggtcccatcttttattactggtgttatcaatgggatgcttgcagcagcttaagtatgtggataaagaaggaatgcacaatatacggtactgaatatttttaaaaagtggtctttcagaatgtctgtatgtgtgggggcccatgcttaggcatatgtgcatgccagtgtgttatttatgttgaaaccaatgttttacattaatggctggaattccagaaaaataagaaaatatttgtattttctaaaccattaaaagtttagtggaactcattaatagtctgtatcatctctctgtatatttcagaagtacattttaagtgtaacagctaggggtaaactttcataactgtatgatttgaacacaagtacaagaaatattcaaggttttcttttcttttttttttttagatgaagtctcactcttatcgccgtagctatagtgcaatggcgctgtctcagctcactgcaacctccgcctcctaggttaaagcaattctcctgcctcagcctccgtagtagctgggattacaggatcctgccaccacacccactaatttttgtatttttggtagagaatgggtttcaccatgttggacaggctggtcatgaactcctgacctcagtcgatccacccgccttggcctcccaaagtgctggattacaggtgtccaccgcgcctggccaatattcaagtttacacaggaaaaagaatactttctctgcataacctttacttatttactcataagcctctagttctctctggatttgactgtaaatctcaacacatttcccagaaactaacatcttctggctgacttctattaaaaattcagacaaagaaaaaaactgaatacaatggagagagattataatactgctattctcccattctctctctctacagcatatcacctcctccaaaatcagttcatatctaactcctagcacatttttagttaaaaatatacatgcacaaaatatatgtgtaaatacacatgctgatatcacacatatgtgtgtgtgtgtgtgtatatatatatacacaaaagcagatatatatatatatatatatatacacaaaagcagatatatatatatgctttcttgcaggtgatagaatgcttttttggaggtggttttgtgggcctatgtaatgtctctattgttatattttaaaagtttcttttttgtttgtttgtttgtttgagatggagtctccctctgtagcccaggctggagtgcagtggcaggatctcggctcactgcaacctctgcctcccgggttcaagtgactctcgtgcctcagcctccagagtagccaggattacaggcgcatgccaccacatcccacttttttttttttttgtatttttagtagagacaaggtttcaccatgttggccagggtggtctcaaactactgatctcaagtaattggccagccttggcgtcccaaagtgcaagactgcaggcttgagccaccacgctccaccaaaagtttcttagcactcattctcatgagaaaaattgctgaaaacttggcaataaagaaacagaatgactacatgtcctttaaatgttatttttaaggggctcaatcaatgactatgaagttatctaagataaaacaccagattttgacattgccattaacttttttattagagcccccagatctacaggttatatgtgcagatgtgcagtggctgctttatttcccttttcaagagcttttcttatacagcatctatccactctcctatagagatgaagttaactcccttgacaactatcacttgtccccaatccccacccttccacttgacatacaaacccaaagagattcatgctcatttatgctcagtagaaaacataattccataggttactgctattattaatcaaatatttactagatttatatctattagtcaattctctttagaatttctttgactgtttctataaatctttattcctcagatattcctttaaaccagtcttaccagcttattggctccactactaattaattagttgaataaaatctttgaaatgtgtttatgtttgtataaaaaccatcttctttacttttcaaaaactatacttgagcacactgtgaaaagataaattgctaggttcaactgaggaactgaataattttttcctcttttagttttaacattctacacaatctaaattattttaaaactcagaaaatgctttaagctcatatttatagacttcccaagtagtacaatctgttaactgaggtaggtaagtaaacgtccttgaaaacttccataaatgatggtgaataaattaaaaaggtggaaacaattttccaggtctctgagccatattcaatataatgaatcctgaataggagttcaatgaaaagattaggtagattttttttaaaaaaaacccatatcccatgggatcctgctgtaaggtacttttataaattatactgattatactgtctcatttctctgtctatttgccatgtgttatatactttggtgatctttgagaaagcatttaacctattacaggcatttttttcccctaaagtacaagtaggtaggtcaaaagaacagcaaggacaatgtctatccacccaatctggtggcctccgaaggacaaaagccagagttaatctaaagcaatcaaggagtctgaccaccatggaagccctgaggaagtggctgctgtatttcccttttcaagagcttttcgtatacagcgtctatccactctcctatagagatgaagttaactccctagacaactatcacctgtccccaatccccacccctccacttgacatacaaacccaaagagattaattaacatttgttccaggaagagacacagacaaaaacatccgatattggaatattccttcgtgaataaatataaaacttatggagagggaggaagatattttgaaaggaaaaaaatcattggactttattgctcaaagccaaaagaaattgttttttgtggcaaaagtaaaacaaggtaattttgtactgtgtgctgtatttctggcaattatctgttatcttaagaggcttatatagaaagaacaattgtacctactttcacagcatgctctgaggatctaaggaccctcaacaaatagttttcatgctacaagcaggcacttatttaggcacaaataggatgggattctttttttaactgtagtataaataattttatataatacagttatataggcttttttaaacaaaatacagtcagattttaaatctctctattctaagatagacacttcacaatttaaattcaagactccttgtttcttgaagacatctatgaaagcaaatgtttttgagaacttggctgaatctgagtccattccgattagcagattccacattcacttttgagccatgacttagaagctatcaagacattatgtagcaacctttttctcagtattccaggaaaataaaaatgtgcatgcattaactcaataggtattcagatgtttcccattagtaagttgtgaccatgcaataaaaaccatgctcaccaatattccccaataaacttcaagatttgtaagctcatgcatacccacatttatgttaaaatttgaaataatgaaatatttttgcattgtgaaaaatagatatatatgcattttgtgaccaaaaccatcaccacagttccattgctgttgttgttcttcttcttattattattattattatttttggtttgtttgtatctggcacatttggggttataaatcacaaataacataaataagataatgttaatctccttcttacaaaatccaatggcttcccacaagtctatatataatatgcaaatttcttactatagcttataagatctggaataatttttcctatctccagccttcacctcttctcacattcatcatattctagctaatcaggactcttttatgtcataaaatatgctagatttgcacacccttaaagccttcatatacgagtttgttctgccttggatacctctgttccacattcccgaacattctctctctcatcacacagctggaccctttcaccctcctgatctcaattgaaatgtgaccttcctgtataaactttccatgagctggcttgtctgactgaacccaaatggctaatggattttctttcccgttacatgctctctaatttatgatgctttgcttggggggaaaatgagaggtgggagtctgtttacggaacatggaagtccttttgcagaggtacaagagtggaaatggctgttccccagcctggctctctgagtcagacctgacatccacagagagagcactgcagtaactgcaaacgcttctgttttgattgtggtaattggaacaatcagggcacaaactgcaaggtcactggcaagggtagcagcaggcatgattcctcccttagtaattttaaagcagcagatttcaaaagggaaaaccaagcagatgaaagtgagcagatttgttcttcagcacatgtgagatacccttggagatgccaataaatcactggagagactgtgaaggaggcttaggccctgcagatgaagttagtgatggagggaaatcgtgtttatcctcgggctgtcaggtctgaaatacctgggttaagtaaatggcctctgggatggtcacagtcggcaattattagcagttacagatccatctctatgccaaaacagataacagcatccaggaattatccaaagtcacaaatcagtgtcagtgtcttgtcactcacccacgtagtgcttttcccttcctcctagttacttaatggataagggcacattgtcaaataaacaaacaagtgaggataaatgttgctccgaaatttaaggtgaatcattagtcagacttggtatcgtcatggaatttggtctgttttctaactagctttattttagcacagccataaatctggctgtaattgtctttaactccgatgactcatacatctaagcatttcatttaactttcaaccgtgaaaaattccaactgatttggcaatatgaatgtgctcttacatgcatatgatcatatgatgctgtcagtacaacatctgtttttgttcttgggatgttgatggactatcatgaaccatcttataactttcccagtcccctttaagtccaagaggatacaactgagaaggcaggtagagtttttggtcagtggctaggtttttcctgaatatcaaacaaattgcctggtatgagaatttaacagaatatgaccacaatttttttaacagatttatctacttgaaacatcgcctcagtcaatgaagaaacttatgttctataactaataataaaagatcatttgtaactgaaatatgacaaattgctgttttaatcatgaggattaccatttagaacagctaggtaaacatttactttttaatccggaaataagttaaagcaaataataaaaatttatatttaaatcacacaacatgttttatcatgaataataaatgtttttaaagtttaaaaatgtacttgttaccttgtgggtattcctgaacatgattaggatttttatttctccaagtatttttattcactcacagaatcaaaatgtcaaggctatataagttttcatcaagtgctaatttagcatctaagtttttattaattaatttgtaaaggaaataataatgagagtcaaaggaagaagcatctcctgtggtgagctccatttccagattccaacgaaaccattaaaatatttatggcactgaggctgaatcagacgggtcttgtgtactctcttgtgtggccatattgtgtagcaacagtgggtttcgaataataagattcagtcatccatttagactccaattggagctcaggcaacttcaatttgtgattataatgattaacttcaaaaagatgcactatttgtagacctatgttgaaacttatgcagtggaactaaaaagccacctatttttataataaaaaggcacaaatacgcaaatgcaaaagaaattcattggaaaatcttgaacgtttcaaatataattatcacaaatgcaaatataaaataacaatatgtttgttaatattatactttcatttaatcagttcttctaagtaaggcaaatatatgaattttttaatatacaaaaatacccccccaaaactccattaagtatatctatatgaccattgggtaagattttttatgattattagtatgggaaaattgtgactgtttagatatattaaatatattaagtaatatatttaatgatttaagattgttaaataatttatattaaaattgaaacctcattttgccagtattaaaaatttcaaaatttaaatacatatgacaccaatgcatacaatgttactttgtcctgaacataagttttaaaagaatttaagtttaaatattctcctaaatgctttgtgagacttaagataaaaaacagttcctcagaactcctgacaaaggggggcagtaaagaagcaaaaagatttttatggagttcagggaaagctgaaaggcctttgtgtacattccctattttctaaacagtaaatgatggattgcattttaggcagactacaaaattgctaaaattaaatgttgggatggaaatgtggaatgcagagtttgcaacccccttttaatttaatattttcaaagaattaagagaaattattatattttattttataaaatattatatttaaaattactcaattctaaatgaatgttattgcaaacctaggcttataagaagaatgcatttagaagccctagataacatacaatataaaaataatatttgcaaattatgcatttgttttcttttctttctttttttttttttttttgagatggagtttcgctcatgttgcctaggctagaatacagtggcacaatctcggctcactgcaaccaccgcctcctgggttcaaacgattcttctgcctcagcctccccagtagttgggattacaggtatgtgccaccatgcccggctaattttgtatttttagtagagatggagtttctccatgttggtcaagctggtcttgaactcccgacctcaggtgatccacccgccttggcctcccaaagtgctgggattacaggcctgagccaccgcgcctggcctgttttcattttaagtgtagttgtctagcattttcaatacattcccccccgtttgacaaattttatcttgccatttagctaatgggcaagcaaaaaattaagtggaataattggacagaacaattatctggtaacctaaacaatggtaacatgagataggtattttatgcattgtttggacttataaactatctagtgttctaataatagacataatggtttattcaactaatagctactgtcatccttagaggttattaacaactcaaagtagtgaattacatccaactaaagggtgcttttgtatagacatttgttcttattgctggtcacttattcttcaaatatcttttaggcaccatttacaaagatgaccagaggtacaaaatctgcatatataatagaaagagccaggtagtcattcaataaaagaaggtatatagtaccaggaaaagatttttatcttagcctaaggcagtctgaattctcaagcccaaagcacataaatttgttggaattatttcaatttctagtcactaaaaatgtgacgcacatttacaccagtggttcggttgattacttctcttcagccctagtctcttaagcacaggtatacacacttacagcaatatctctgcatacaatatttttgacagaatgaaaaagttaaaaatattgatgtttatttcagcgattctgaaatggtttataaaaattctatgactataagaaattcatgaggaatgcaatatatcaggaaagaacaatgtcatctttacataaaaaggatgcgtgtcagtaatttgagaggctggaatctagtgacaaatgtgtcactttttaaggtgtgcttgattcacagctgacagctttgatttgaaattgcctttaaaacaatgtctatgtatcagtgcaatgaattctaaccaaaagcttgttggagctaaccacagtacctatatattcaagatgttcatgggaggaatggaagatttgatatttaggcactgaagggttgctatgatagttattatacacaattgagtttaaaatgaatatatgtgtcagttctattattaaatgttataaaatatgagggaataataaatgctatgtaatttataaactacaagaaaatttatatcaggaaactgcttatttcctaatatatgcactgtcttcagtgtctccaaaactgtcaactctgccaatgtgactagcagatgatgagcaggcagtccgtgtgatattatcaattacatagtcagaaatctgagtctttctttcaccttatgagctgtttaggaagaaggtgtatatgtgtgtaacagggagcaagaggagattaacttgtaagccattatctgatgcaaaggcagacatttactaagtcatctgtgaagagatggttcgataatagctaagcattcatataaatcttcagggactcgaattctctcaagtgtgacagaatactcctctcaactgccagcgctcctgttgtaaaaaatcacatttggcaaagggctctggtgttttgagttctgctcagtgacaggtttgttttaagtaagattaatactgaggacaataaaatgaccttcaattaagactccttttaaattttgtctacctgatttccactatggttcgtgtctagctgtactctatctaagaatgatctttaaaacattcaggattatgagagagatatctaggaagtcataggaaataaccactattcaatgctgttctgtacaccattagtaaaccataagagaggacaaacatttatccaagaaagagactattacatagccaccaggacccaatatggattcagcacaattgagcaatacatgtaacagatttgtggtgaaaaacaggtgctgctcaattgcttagtctaaaattctccctcaattccttcccatcacctaatttgtttgacatctagtctttttacattataatatagtatattaaaaagttcttattatggtttttttttttgagatggggtctcgctctgtcgttcaggctggagagtaggctcagtgcaaactctgcctcctgggttcatgccattctcctgcctcagcctcccgagtagctgggactacaggatcccgccaccacgtctgggccaattttttgtatttttagtaaagactgggtttcatggtgttagctaggatggtctcgatctcctgacctcatgatttgcccaccttggcctcccaaaatgctgagattacaggtgtgagccaccgcgcctggcccttattatagaatttttgggcatacattgcacatttttctaattgtgcttcaataataccaaacaagtgggcaaatgcttcactgggctacatttgcatccctgagtacaatttcacattggttttggttttgtgaattttggaggaatttattttgagagatgcccctggaaataaataatgctgatgttttggtgtaattttatttattgcattaatggaatatgtaaatacaatctatcagcattaggcagaaaatatttaagagatatcaaattcttttgccgagaaaggtagtagtttgccaggaactacaagctttctaactgaacttttaaaaataaattttaatttttaattttgatagatcatcatagttgcacatatttaagggctatctgtgatattttcatacaatactgccatgtttactgccactattcacaatagccacgatatggaatcaacctttgttcatcaacagaagaggagacaaacctgactttggtctgtgctggctgcaggttctggagagctgtttgaagtgacaagatggcaaatgaaagggtcagttggttgcctggtggattattcgtcctcataacactttacctagaaattttgccttttctcacaaaaccataataatggacaaacagcatgaacctagatatgcacccccagtcactatcgtaaggtcaagttggtatgagtcacataagtagaggactagaagttttatctgaatagtattgtcatagtggctaggaatgagagtgaaaagtagactagatgtgtgctttgatatggcttggagcaaaaggtcaggtattggggcacttctgaaatgatatctattatttaggaactgggtcaggaaaatctataattacattcctactgtatttacataccattcattcctaagagagctcttccaaaaaaaaaaaaaaagagatgtcagtgcataaaaaataaactccatttctttctcaagcccaaagtacataaatcttgaaattttccagctaaaaaataggcatatgttctagcatcagctttaatttatcccacattcattctctgctacaataaagtgacaaagccattcatattttatgttacatctaattatctgtttttcagttagataaatatgctttatatcctaggtaccatcagaatttcaaagctcagaaaatcactaatgagaatggaaggaattaaccatcatgcaagcagaagcatgcggctaccatgctacattgctcagagttcatgtagcagtttaatcagggtagcagctgtgcaatgagctttgttggaactggagtctcgcatcctaaatgtgaaatatctactgtttgaaagggtgataactttatgccttgcaaagaaaacagtcctcaagtgttattttttaatgaattaaccctttatctttcctcacaccttttctcttctttttttttttttttttgccctcagaagtatttaaaggataatcccatatgataactcacactgcctagcttcagtacaatgtctcatacattgcaggcactcacaaacatttgtttaatgaatgaataagtgaaagtccaatggaaaattacactgttgaatttacaatggttttagaggtacatctctaaatttgttgatttatttaggattgtacattgtcacattttcactgctaaatttcatattattcattaaagaaaggcagtgttggagagttttatagttgacagatgaattatctataacttctaatatactcagacatcatgtttttctagcatgtaacttttaaaatataaactctccaacatttaaagttttaacactttttagtaattttttaagaaatgacagatcaatagtagctttccataaataaaagcctattaatttgtataacataacaaaattcagtgcaacataaattcatatagtactcctacaagaaatctataggagtaaaattatgattataaaaatcaacagacttaaacaaacaaataacagctttcaattaagtttatagataccaaagacattcaacctttaacatcccactgtgtaaaatcaaatgggaaaggataaaaggaccaaagctatggttagtaatataattgattgctgccctacctacaaactaatttgttttaatatctgtgctagaaccagtatgttaccccttttaactttagctaaataatgtttatacaaaccttactatgcagagctatctttaacaagagcatcccattgaggaaaaaagaaaatagaaagatatgaaaattttcacttttttctaataccaacagatatcactttattgatattgcatttctgtatataatgacatagaatatgagcattccctgtagttcagttttactgacagtaacattgcacaaatcattttagggctatgtgctatgcagagacattgtacagttaattggcatcattaagtaacattttgaaatgatgaggtgttcaaatgtagtagttaaaggcttgattggacattgctaaattgggtactagatctctaaagagatggaatttaccccctagtaggctttatcctttttcacttgtctcagatttggaactcatttcttttaggttgaaaattttatgttcatgttggaaacttaaattttaacaattaaaagattacttgaaatgcaatgctacccacggctgcctgtcattttgggagtttcttatagattctttttagggataagaattatgttaaaaccagatgctagaattgctttaatttttattccccagtttctcatttccattttgacaaagaggcccaaaacatgaatagccttttgatctgtttttttctcccatatcagttcccatgagaccagtgacttcattctttctgttattgcaggtttacattttgcagtcatcttttattcttgtatcactatcttcaatcattgtggccaattctttccaggtcattctcaaacctccatatcaaagctatagatcaataactatcagaacaagttaaacattaagataaagttaatcatcttttctttataataataaccaccactgaattgcaattgttatgaggtattatgctaaacactttatcaaatcttatgaaataggggtaatttttattctcatctcacatgagaacttgaggcacataaaaattaaggcattttgccccaggtctcatggctggcaagtggtctgtctgacagtagagagccagcttcaagcactgtactatagggccactgtgtcatgactataaacctttcatggcatggtctatacatttgggctcttcagcttcaaatttatctatcatgcaggcatgacactaggttttcacttgcactggaagtcaactgctggaaaattagtctgtagaaaaccgtaggccacagagttcctgaatgtgttagtaagaggcttagattttattttggatgggctgggaaataattgaagggttgtaacagggaatgtgcagaattgcattgtggagagatctaattggagattgggggaaagatgagcaggccctaaactgtgataatgttggcaagcttgaagggagggacagaatcagaaaatatttgtaagtgacatttctaggcccctgtgatttactggctggaggatgagcaggtgagaggtgtttgttttgaaaaaagtgattttgaagagaggtcagaaaaagattttcatttttttacttcatgtgttcatgagttggggagtcagggtacagaaggaaagacacatgaagccagggactgacacagagaccagacacacagtgggtgcttcatggatagctgttgaatgatttgtgaaaatcagatagcagtggtgagggtttttatgcaagtgaaatacaaatgaacttctcaaggtgccatatctgagttgtggctttgatctggttcctgactttgaattattttgttcctatgaagtacaggactttgtaataaaaatccaccatacacaaaatcccctggacttaagaatatctccacaagttataagaattgaaactgcttagaaggaacaattgcttgtactcagccagtcatcctcagctgcatgagtctcaaaacgggggtggagagtgtctacctcctccagaaaaggtttttagagcgaaatcaaagagactgcctcttctccaccaaaattatttgtcttaagatggggacaagaaacctggcacccaggagtaaggacacagacgtgctctctcattttaagctgaagctgaactgtcttgtcctaaaaacatatgcccagactctagaaaagctctcttagacagactgctaatttctccatttctgtcacttaagaggattttagggacatataactttgagaattccattctgcagctttcagaggtaatacaatccaatactcatagtgggcttatggtgtacccggcacttttccaaacattctacttgttatagcttctttaattgaggtacgtattcttatcattctccatttgggagatttgagagagaggcaaagtatgtgccttaagatgacacagttggtaagtaggaaagcagaactttaacatcagcagtaaaaccctgagactattgttttaatgtgtttaataaatgccccactaagaaaccagagcaaattaaaagtatgctgtgttctattaatttgatacaggcagaagaaatctaaaaacagcaaagaatgatatttaagaagaactctattttaagtagttataggacatatgcttaaactgagtgaactttttatgaacttttcatcagagatttttttttaattgttgtttttctcctgtgtctgtgactgaataaatggcctctgttcactggaatgcttcacatgcttcctctctcagttgtaggtgtgtttatttctattcagacaccaaaggcctatgggtatctgcaaattaacagtttcatttgctattatgttccatcattgtgaagcagcacaggaaattaacatatctgtaaccacgcccttactatataatatgaaagtgtaaattaaaacatgccgtgttcattaaactgagataaaaccacattttgaaaataaagtttagtaagtggatacttagtatcacattggcgatactaagcttatgacttgcttttaatatttggattgcaaataaatttggaagctaatgtatggagtacaataatagcgaaaagcatgggctttgatattagacatggctatgcatccgaatatcttattattggatattcgattcaagaacatatcagaatagtaattatgttgtatttgattcagtggctgagattgaagggcaactaaccaacagaggagaagatattattgattgttctaaagatttatcctccaaagctttcctttaccctatcttgttacatcttttttaaacaatgctaattgtgtcccttgtacatattcttattcaactcctcagcaaacatcttctatgtgaccaacattctgagaggtgctggagatgcagggaagagtaagatgctatgcttgacctgcagtatcttgaagctagttggggcagcaaaccattaagacattcagcagcatagctgttgtctgcagaaacagatggggatccaagggttggaaataatacagaggagagatggattcatttgaagagttctcttgttgcatgcttaatataattaaagtgcctagccactagtagatgacagttttctaattttacacatcatgtaatccccttagtcttgaagatattgatggtgttaatcacttgaatgcagtgacattaataatttcttagataaaaagtatactgtttccaatcataaattccctgcctcccagactctctgtgagcctcatgtgcataagtggagggaaggacctgctgatctaagaatacccctagtgtcaaagaagtaaatggtcaagtaaggttgtcctaagaagccatgttaccccttctgctggtgagcacagagcccaggtataaaattttttttttttttttttgagacagagtctcgctctgtcacccaggctggagtgcagtggtgcaatctcggctcaccgcaacctccacctcccgggttcaagcgattctcctgccttagcctcccgagcagctgggactacaagcacatgacaccacacctggctaattttttgtatttttagtagagatggggtttcaccatgttagccaggatagtctcgatctcctgacctcatgatctgcccgcctcagcctcccaaagtgctgggattacaggtgtgagccaccacgcctggctgcagaatctttacctaggttactgttgtccatgtgggtaacaatcttgacatctgaagtgttcattgaataaaaatttgtattgaatattcttctaacaaaatctgaaaaaagtacagagctatttttgaaatggatgagaatgtatggtaatttagctagttcattgtatgtgtcctgttttcagttatcattgctactgaattatttatctttaggtgtataaattatagtcaagatgcttacaattgatgaaggaagaatgattttaaaacacagagcaaaatgttattttaaatacagaagtctattcttctcctccatgaataactggcattctgtttctattgtatattaggttgaaatatgtgtttttgtcattaccagtgtttccacaggataagactgaaggcacaagcatttaatatttgctgaaagcacttaaacagaaaaaatattggctagtgagattaagaatgaaataaggtagacaaatagctggctgcaaaagagaccttaaaaagtttctcagagcctggccaaaatggcaaaaccccatctctactaagaatacaaaaattagtggggtgtggtaccatgcacctgtaatctcagctactcaagaggctgaggcaggagaattgcttgaacccaggaggcagaggtaggttgcagtgagccaagatcatggcactgtattccagcctgggcaatagagcaagactctgtctcaaaaaaagaaagtttatcagtctattaagaatatacttgatttttacaagaagaatcaattgctttacaaagttatttatctaaaatgtatgaataaaaatgtataactataaacatatctataaaactagtaaagatcaaaagctcaggtatctttaactttctctgcttctactattcacaaaaatatttgctcagagacacagaaactcatcttcaagatttatttttatctgggtggagttacagagttgccttggtaacagcaactatcaccaaattaagtgttaagcacacgtttttaaacatttttaacattttaaaaatgcagatgccaaaggagagcaatgtcaggagagaatgttgtaaactccctttttcccacatctacttgacattacaaggtttgtactactttcagaaattctccagtgtttaaaaaatgcgtctataaacacacatatacacagagcacttcttattgaagtaatcaccttaaaaattatgtaatgcaatgaaaaccacaatggttttcctaccattgactaagaaagcaaaggacctttcttctgaaagtgaggaggacctcttgcctcctgtcatttgtgaatagaactctgtagtcagaaccagagcatttctggcatttggtctagaatcattctgaagggcaagcctggtgctgtgttgctaagcacaaacaatttggtatttggctccaaaaatatgctcgagattagttcttccctcagcaacaggcgctcagccaaataatttttaaccaactctcagagcccagtattgcttgagctactgagatcctatttcaagttattgctatcaagatatggaggagagtgaaatactgacacttgtgagatcccaagacttacactaaatccatacaatttctgtcctgaattaaaaatttttttaaaaaagagatgaaaagtgtgacatttccaaaccacgtaattggtttctttcaccttaaactccaagttagagaagtattttgttgttgtttgttttgttttaaaactagacttggtggaatacagaacataaacattttaaacaaaatattaaacttctagaacagtggatcacttaaaatgaaaactttaagactttccttagactgagttttttattcttaaaaaaaattaaaaggaagttgaattttatttctaaacggtgcaggacaaatgaataaaatacattttgcctctgtcttaaacttagaacagatacgcaatctctttaacagtatgtaaaaattcagtcttttctttctttggtttccaaattacagtgaaatgaaacattttccttttatgtgtaattagtgcagtttaactaagagttatggagcatctttccacctcatggtgtatccatgtagctgaatttcttcagcatttgcttttttaatttgtataaggagtaactgttccatatcttagaaatctttgaaattagaagttgatctaatagcatctctaatgtagtctctccttgaattttaaatataatagatatgacctgttatttaaaagatatagtgtttactggcatataacagttgtgttgagaatttttcattgaataaaatatatttcccttgaaatttttgttttatggtcatatctcataatccacctctgaatcaatgaacacttgtattggtggagaaaacaaagatccttcagacagactttctgtgtggtatgttctttctgtttcttttctaataacattaacttacatttaaaattattataattcactctattttcacaaatcatcaaatcatactcagatatttaaaaataaattttattgtatatatttacagtaaacaacatgctgttataagatgaatgtatatggtgaaaaggttattatagtgacaaaaattaacacatccattgtctatctcacgtagttacccactttttcccctgtggcaagagcagctataatctactcaattagcaaaaatcctgaatacaatacactattactaactatagttgtcatcctgcatgtcagctttttagttcctcctacatatctgctactttgtatccttagatctacatctcccaatctcctccctgccacctcactcatggtaaccagtgtgtggactgtgttttttgtttttttattttgagacagagttttgctcttttgcccaggctggagtgaagtggcgccatctcggctcactgcaacctatgcctcctgagttcaagtgattctcctttctcaactgcctgagtagctgggattacaggcacctgccactatgcccggctaatttttgtacttttagtagaaacaggatttcaccatgttggtcaggctggtcttgaactcctgacctcaggtgattcacccacctcggcttcccaaagggctaggattacaggcgtgagctaccacatccggccggtaaccactgttttattctaactttatatttgaactttttctttttagattccacatataagtgagattatgcaattttgtgtgtggatgtgtgttggacttatttcccacagcttaatatcctccaggtccatgcatgttgtggcaaatgacagggtcttctccttttttaaggctgaataatattccattgtatatacatataccacagtttcttttatccattcatgcaccaacacatacctaggtggtttccatatcttggctactgtaaataatgctgcaatgaatatagcagtgcagatatctttatgaggtgatgattttatttcctttgggtacatccagaggagggattgctgggtcttaggtaattctaattttaatttctttaggaacctccgtactattgtccataatgactgcaccaatctatatttccaccaacaatgtacaagggttcccttttctctacacacttatcaacacttaaactgaacatgtagactttttcttttcattattctctaaacaatatagtataaaaactatttacatagaatttacattgtattgggcattatcagtaatctagagattatttaaagcagcagtccccaacctttctggcaccagggactggttttctggaagaaatgtttccacggacagggatggtgaggggaaggggaatggttttgggatgattcaagcacattacatttatcattagattctcataaggagcgcacaacctagatccctcacatgtgcagttcacaatagggttcgtgctcctatggcaatctaatgccaccactgagctgacaggaggaggagctcagctcttgctgtgcagcctggtatcgaacagcctaacaggctatggaccagtactggtcatggccctggggttggggacccctgattgaaagtatatgagaggatgtgcataggttatatacaaatactaagccattttataacaggggcttaggcatctgcagattttagtacccaagggaggtcctgaaaccaatcccctatggctactgaaggacaactgtgtatcattcttaacagaaaaaaacaaaatctgttttgtaaataaaattttttcattattatttccatttcactctggaatttagttagaaattaagattaacaaaatattaattgactactaaaatgtaccagcactagcagcacataccaaaaactaatacaaatattccaataatattaaataatgactgcatttgtatttcatctgagagtggtttatggttcttccccataagtggctgatttattgatggccactttttcttaactcctggtctttctcacaatcacagaaaacagtcccttatcacacaaataaaaaagtcatctcaccattcctctgtaccttttatcttaacagacttgtgttttgaaatattatttatactattttttaattttttgagaccgggtctttctctgtcacccagtctggagtgcagtgcgcgatcttggctcactgcagccccagcttccgggttcaagcaattctcctgcttcagtttcttgagtagctgggattaccagcgcccatcaccacacccagctaatttctgtatttttagtagagatgggtttcaccatgttggctaggcttgtctctatcccctgtcctcaagtgatccctgcaacttgacctccaaaagtgctgggattataggcatgagccaccatgcctggccttatttatattatattaactctaataatcactatgccactttctgttgtaattctttaggcacttcttctttgtatgtttttaattagcatgtagttatatagttatatatttacgtttagatatacctccaagtagccaatattctacatgaagtgataaaggatttatttatccctgaaattatgaaaagtctgccttgttttttctttcttgcattgtgctacagtacacacatacacggacacacgaatgcacacacatgcacactgggttctgctaattatcatttccttagttccatatcattccccaacccctaagccacctgtgtccataccagtcttcccactgcctaccagccccatgtcagatgacctccatcagtagtatctccatttatggtgtctcgcctttctgacacatagtaacaagtgaggtgttaagactaacaagagaaagaaggcattattcttatctggctagaaagaaaacaatcagcaacttgtcttttatttaagggaagaaggcttcactctactatattttcaagatattccaaaactgcaacagaccctttcaattattttactttcatctattaccaaaaaggccaacttttagattgaggcaatgaaaactcagaaacttttttggaatgaccttcagatttgagatgaccactgtttcaacaatatttcagttataattctttctctatattcatttagggaaatttgattctgaaaaatacaaatagcttcctttctcctgagctaggactgtatttagaagggaataaattgtagattttattaaaatttgatcacattttctttttttgtgctacgacacagtagcaatgtagattgaaggcttttacatgtatttttaaaattgccatagagaattatttgtattaatcatagatttccaaggctgcaaaagctaaatagtaaagcatataataatggtagcgttaatttgaaaaaaaattccagctagcaaaacatgagtctagatgtagatatcatgttcaaaaatcacaaagcagattgccagcaaaaaattgaaccaagtttttccccttcagaaaactagctttatttaaaaaaatttcctaatatttaaattgattcacacgtttataactatacaagggtttccttgtttcatcaaagaaataagtatgaatgagcagaatgttttagtataaaagtttacaaagtttattcacactcggaacaaaggaataagtaggaaaaaaagagcaactaaaaacaaatgaattcttttccccatccctctcgtttgtctccaatcagttaaatccttttaatgatatatcataagtagcttcatgctttagttcacattgacgatattcttatatctacatcattaataatcaaaatagtctttctgtctttagttttgctgtctctaagtcagaactcaatactgttgctctaaaatacaaatgttaagatgattcttcaggagcttctcatcacctgtactataatgctactagcatgagagcacccacctagccttcttatctcaagtcctgccctgccactctgtacatatatcccctctttaattcacccttagacagagacagagagggccacgcatcttgtcttttcctgaattaatatgtggtttttgccccatgctttagcacatgtgaatccatttgtccagcatgcctttgctcacctgtgtacaagaagagctacataacagatcaaaaggaacatcaaaggcgctggttcttagagtctcatgtccattcctccaattctcgccacttctggatgcactgtttcttatgagcttccttaaatatgctgtgcctttttgctttctgcgtatgggcatctccagtgccaaagtaagaggagatttctgcagaatttcaggaagttaatatcctagtggcagctctcagacaatgggagacaggagctaatggctgtttcttcgttttgtccttcaggctgataatccagaaaaccaatctgcacaatgcttgagaaggtgcagagaattagagccctcattgccctcaatgcagtacctttatattggctttttctccttattcatcacatgctcctgtttcccgagattgccacccacatatactacttgcaccctacactatatttcaggctcttccttcaggataatgaaaccaagctaaaggcaaaatccaacttttgtttaactcatcctgcttctgagctcccaagatccctgaacctacttctcttatataatttattatagaaagttatttaagcatgagatttctctagtttatctttgaatctccactgtcaatatagtctctggccaatgaaagctgttcagttaatgtgtggtgattcaatacatgcactcctaattctcatttatgaacattttgttaaatcgtggcctataggaaataggcatgtaaaatgcacctgtaagttttatagcacctagtacagagtgacagctcaaaactatttgcagaatgaaagaaaaaaggaagttgactctccaaaacaatacacatggccaaagcctggaaaaaagtaatagtgtcccagtgtaacttctaggaggtgtgaggaagaaagaaaaacaaaattggcaccttttcccaggctttagactgagagatattaacttggagaggggaaagcatagtctaaagagaaacagggctaaggaaggtatcactttcttttactatctctcagacagattgcaatgcaatctcaaggcagcactacactggacaaggtactaggactctgaccattcttgtttttattcttttttttttttttgagacagagtctcactatgtcacccaggctggagcacagtggcactatcttggctcactgcaacctctgcctcccgggttcaagtgattctcctgcctcagcctcccaagtagctgggaatacaggtgcctgtcaccacacctggctatttttttttttgtattttttttgtaatttttttttgtatttttagtagagacagggtttcactatgttggcctggctggtcttgaactcctaaccttgtgatccacccgccttggcctcccacaaagtgctgggattacaggcatgagccaccgggcccggcccatatttttattcttaaagaaccagaactatatgcatctagtgttccccaagttttcttctttgtcttttaacattccaggaaaacagatattgagtgttttgctggatcatgcatagttccatatccttttgaccctctgtttgctgtagccagctttgattctttggattcatggtcaccctataacatattcactaatccaccaatgaaaggttatgtaatgtataacaatcaactcagggttttctaatgacaatctttatcaatgttctataagcttgaaaattaatttaataatttataccattgtgcataaaatataataaaaactttaatttaataacgaaattcatgcatacttttacaaacttatcagtcattcagaagtaaatgtggacttcagttttgtgggcaggggtttacagaagtatgttttactaaagtttggagaaaagatcagtataaaaatatgaaattataccaatagcattattagaaatagttaaaagacaaagtttaagtattttcataatcatatcactttttaagtgactaaactactaaagaaacatttagttaactctaaaatattgttgtaaaatttctatgtgttttgaggaaaaatacttttattccatcataaaattttcaacttagagaaacaatttgtttacttgaaaaattataatattttcaagtaaaaatggttatactgacaatttattaaaacataaataaaagttcttcccacactttgacacatgattagaaaaaaaaaggcagtaagattttcatacagaattctggggttaagtagaattcacttgtgtttgctggtctaagatgcaatggaatttggaggcaatggggctggattctatcaaatcagacacacggaagaggttataacgtgagaatttatattttttcattttctcagcccacacttgaaataacaatttgcaagagttttgctttgctcaatattaggcctgattagctaaaatgctcaaatttccattcaatccttaaaaacagatccacacttagtcattcttcacacctctctccctcgccctttcacacccaaattgttaacttttttctctattctcacatttatagtctggttcagacttccgtgatctgtcacttgctcttgtggttaaatttctgaagtgaaattcctatctctaatctcttctcctatgtatgtcatcagacttgcaattttttctaaacccaaaatgtgttttcactagtcccctgttaaaaaactgtcaacacatccacattgcccactggctatagagttcaattcaaactagagtcattcactacttggacaaccagcttcccagctccacctctgggtattctttctcttgccttcagaatggtgttgaggatataaggtgaatgcaacagccattgctctcagtgagctcatagtctaagtgaggagacagatgagcagatcattataaaacaaattggcaagtgcaatgacagaagtgtgcataggtgctatgggaaccaagaggaaggatatataataagccagggaaggaagagaagattcagggagacttactggaggatgaattgccctcagaaagtattgaagtgtaggtaacagttggttaagagaagcagaaagaaggaaaaggagacagcagcacagggtgccaaaataagaaaagcctgggtaatactgccaagagaaatctacaattaaatgcaattcccatcaaaataccaccatcattcttcacagaactagaaaaaacaatcctaaaattcatatggaaccaaaaaagagcccacatagccaaagcaagattaagcaaaaagaaaaatctggaggcatcacattacctgctttcaaactatactataaggccatagtcaccaaaacagcatggcactggtataaaaataggcacacagaccaataaaacagaatagagaacctagaaataaacccaaatgctaacagccaagtgatctttgacaaagcaaataaaaacataaagtggggaaaggacatttgatgtattgtatgggttacataagatcgattaagtggagatggaaattttacaactttttgttgtatattgtaaactatttttaaatattagtggcaaaaagactaatatggataaatattcccaacaatttgatatttgatgtcccaaactattgtgagattggttataataaaaaatagcaaactaccctgctgatttcccatgaagcttaaccctctctcacatttcagaaccagcctgacttaagcctctacatacttaaacagcttcaaatgcctatctgagacagctttgtaatgggtctctgcccctgtttctctgtccacaagaggtactaattcacttctcttcagttgttagacctaggacacaatagacaccaagttacatttctgttaggtgcatcttggaagtgcctgagaactgaccactgggcacctacctttttacctaagtctctgttaatgttggtctgtttacctgttagtagtggagcctggtgcatagaattatctccttgccatctgtgtcccacaacacatatataaccccctgcatggcatatgaggcctttcctgagaggggtgcttttaagccaacattccagagacctagttcccctgccccaggtgcctcagtttttacacctaggatgctattttgaatcttctcctcaatgacaagtatctgtactcacttagtttgggtccatgccacattcctgaggcaactgaaacccacctactccttgatggccttccaggatgcttgtctgtactatagtggacatcccttcctgcctcacggatgtccgtgtgtgtgtgtgtatgtttggtttttactggattcctgaggaaggccttccactgaacttcattcatgtgctttgctacctgttagaaaatgtaacctaatgtaaatgtaaacctctggtgcctctagttttactgacttatgttatataaatcttggttcctggttctttctgttgccctgttatgagatgtatcactctaagccaagcccaaacactaagataacaagtgctaaagatgacgaatattctgaagagttttcaggacacacagaattgtttgtggccagcacctcagtaccaataacagatatttcatgttatatagtggggtcattaaggacttatttgagggaataatcaagaaaaacttcctagtcttgctagagatctagatatccaaatataagaagcacaaagaacacctgggaaattcaatgcaaaaagattaccacctgggcacacagccatcaggttgtctaaagtcaagatgaaggaaagaatcttaagagctgtgaggcaaaagcatcaggtatcctataaaagaaaacatagcagattaatagcagatttctcagcataaaccctgctagccagaagagattgggccctatatttagcctcttaaacaaaataattatcagccaagaattttgtatccagtgaaactaagcttcataaatgaaagagagataaagtctttttcagacaaacaaatgctgaatttgccactaccaagccagcactgagaaatgctaaaaggagctctaaatcttgaaacagtaacttgaatacatcaaaatagaacctccttaaagcataaatttaacaggacccataaaataataacacaattaacaacagcaacaacaagaaggtattgaggcaacaactatcatgatgaatagaacagtacctcatacctcaatactaatgttgaatgtaaatggcctaaatgctccacttaaaagatacagaatggcagaatggataaaaatccatcaaccaagtatctgctgtcttcaagagactcacctaacacgtaaggactcacataaacttaaggtaaaggggtggaaaaagatattccatgcaaatggaaactcaaagtgagaaagaatagcaattcttatatcagacaaaaaagattttaaagcaacaacaattaaaaaagacaaagagagacattatataatgataaaataattagttcaacaggaaaaatttacaatcttaagtgtatatgcatctaacacttgggctcccaaatttataaagcaatcactactagacctaagacatgagatagacagcaacacaataatagtgggggacttcagtactccactgacagcactagacaggtcatcaagacagaaagtcaacaaagaaacatggacttaaactataccctagaacaaatggacttaacagatatttacaaaaaatcctacccaacaactacatccttttcatcaacacatggaatattctccaagacagaccatatgaacaagtctcaataaatttaagaaaatcaaaattatatcaagtattctctcagaccacagtggaataaaattaaaaattaactccaaaagaaaccctcaaaactatacaaatacatggaaatcgaataatctgctcctgaatgatctttgggtcaacaatgaaatcaagaaagatgaaaattttaaaaatatttgaattcaacaataataatgacaaaacctatcacaacctctgggatacagcaaaagccatgttaagagcaaagttcatagcattaaatatctacatcaaaaagtctgaaagagcacaaatagacaatctgagcttacacctctaggaactggaaaaacaagacaaagcaaacccaaacccagcagaagaaaagaaataacaaagatcagaatagaaataaataaaattgagtcttagtgtggtggctcacacctgtaatcgcagcactttgggaggccaaggcaggcggatcaccataagtcaggagtttgagacctgcctggccaacatggtgaaaccccgtctctactaaaaatacaaaaattagccaggtgtggtggcaggcacctgtagtcccagctactcgggcagctgaggcaagagaatcacttgaacctggaaggcagatgttgcagtgagccaagatcatactgttgcattccagcctgggtaacaagagtgagactccatctcaaaaaataaaaataaaaataaataaataaataaataaaattgaaacacaaaatacaatacaaaagataaatgaaacaaaaacctgcttctttgaaaagataaacaaaatcaatagaccattggcaagattaaccaagaaaacaagaaaaaagatctaaacaagctcaattagaaatgaaatgggagatactacaactgataccacagaaataaaaaagattattcaagactactgtgaacacatttacgtacacaaactagaaaaccaagaagagatggacaaattcctgcatatatacaaacctcctagattaaaacaggaagaaatagaaattattaacagaccaataatgcatagtgagagtgaaacaataatagaaaaaatgtcaggaaacaaaaaaagtctaggaccagatggattcacaggtgaatgctatcagaaattcaaagaaaaattggtacaaattctattgaaactgttccaaaagatagagacagagggaatcctccctaaatcattctatgaagccagtattaccctaatatcaaaaccagaaaaggacataacaaaaaaagaaaactacagaccaatatccctgatgaacagagatgtaaaaatcctcaataaaatactagctaaatgaatccagcagcatatcaaaaagataatccaccatgatcaggtgggtttcataccggggatgcagggttgctttaacatatgcaagtcaataaatgtgatacaccatataagcaggagtaaaaacaaaaatcatatgataaactcaatagatgcagaaaaagcatttgacaaaattcagtattgctttatgattaaaaccctcagcaaaactggcatataagatacacaccttaaggtaataaaagccacttatgacaaacccacagccaacattatattgaacgggggaaaatttgaaagcatttcccccgagaactggaataagacaagaatgcctgctttcaccacttctattcaacatagtactggaaatcctagccagagcaatcagacaagagaaagaaataaagagcatccaaactgctaaagaggaagtcaaactgttgctctttgccgatgatatgtttgtatacctagaaaacctaaagactcatccaaaaagctcctagatctgataagttaattcagtaaagtttccagatacaaaatcaatgtacacaaatcagtaccagtgctatacaccaacagcaacaaaactgagaatcaaattaagaacttgagcctttttacaacagctgcaaaaaaaaaaaatgcttaggaatatacctaaccaaagaggtggaagatctctacaggaaaactacaaaatattgctgaaagaaatcacagacaacagaaactaatgaaaacacatcccttattcatggattggcagaatcaatattgtgaaaatgagcacactgccaaaaacaatctataaattcaatgcgactcccatcaaaatgccaccatcattcttcaaagaacaagaaaaaaaatcttaaaattcacatggaacaaaacaacagcccatacagccaaagcaagactaagcaaaaaataacaaatctggaggcactagattacccaacttcaaactatactacaagactatagttaggaaaacagcatggtactactataaaaatagacatgtagatcaatggagcagaatagaaaatccagaaataaagctaaatacttacagccaactgatcttcaacaaagcaaacaaaaacataaggtggggaaaggacatcctattcaacaaatggtgttgggataattggcaagccacatgtagaagaatgaagctggatcctcatctctcaacttatacaaaaatccactcaagatggatcaaagacttaaatctaagacccaaaaccttaaaaattatagaagataacattggtaaaactcttctagacactggcttaagcaaagagttcatgaccaagaaaccaaaagcaaatgcaacaacaacaaaaaagataaatagatgggacctaaaactataaagcttctgcacagcaaaagaaataatcatcagagtaaacagacaacccacagaatgggagaaatatctgcaaactatccatctgacaaaggactaatatccagaatctacaaggaactcaaacaaatcagtaagaaaaaacaaataatcctatcaaaaagtgggctaaggacatgaatagacaattctcaaaagaagatagacaaacagccaacaaacatatgaaaaaatgctcaacatctttaatgaccagggaaatgcaaatcaaaaccacaatgtgataccaccttactcctgcaagaattgccataattaaaaaataaaaaaataaacgttggcatggaagtggtaaaaagggaacatttttttacactgctggtaggaatgtaaactagtacaaccaccatggaaaagttatggagattccttaaagaactaaaagtagaacaatcatttgttccagcgatcccactcctaggtatctacccagaggaaaagaagtcattatatgaaaaagacacttgcacatgcatgtttatagctgcacaattcacaattgcaaaaatatggaaccagcctaaatacccatcaaccaatgagtggataaagaaaatgtgatatatttacatatatatataaagcataggggggtgtgtgtggatgctatggaatactactcagccataaaaaggaacaaaataatggcatttgtagctacgtagatagagttggagaccattattctaagtgaagtaactcaggagtggaaaaccaaacattacatgttctcatttataactgccacctaaactaaaggatgcaaaggcataagaatgatataatggactctggagacttgaggggaagggtgggaggaaggtgaggaatgaaagactacacattgggtgcagtgtatgctgctcaggttatgagtgtaccaaaatctcagaaatcatacctaaacaacttctccatataaccaaaaaccacctgctccccaaaagctattgaaataataataataaagttaatcagaaaattattgtctataacaccaatatattatttttattaatgcatttcttttaatgtattgttatttgtcattaattaaattagtagttacactattaagcgatctgttgttataattaattaattaacctccctttatcaattaaattataaagccctgaaggcaactgagtagaggcccaataagtgattgctgaattgaaatgctgaactgaattatacttcattatatagaaagcctcatatatagggcctcacatatacccttacacaaaatataagaatccactacaaatcacttcatcgattaatcaactggctgtactttgtaacaaggtttgcacaaataaaatatctttcaggaaaagtgtaaaatatatttcattaatctgtgaaaatgcaactggaagttttgtggcttcctagtttgaactccgcccaagaaggcaaaacctttatagacccatagtttcccgtctaggtactgctctttcacacatctctaagtctgactagacacattgtaacataagctgtggtcacatgacaggtaggtgtctcagtaacaggcaacaccagtcatggaaaaacaaaactaagtgtccaaatgagtgcagaatcctgattgcagctcacatttactcttaaacaagaggccctcttcttatattctcaggtaagtgactctgtaataagaggattgtgtagcatttacctaacagctttactttaggactgtatactgtccttagatatttttaaaactttttatatttcatttctaaataagaatattacaaaaaatttcctaacatttatataacataattctcaaagtagatagagccaaataactgacttctgctagttttttttccagatatttgtcttttatgtacatggccagaaaccacttagaacttgcataaaaacaagttaagaagcaaaatgtcagttagttcctttctctatcccagagcgcactgtttcattaggaatttttcaataaaaataataatgtagaaggtgtgatttttacagttttcatgtcttgatatatagtgaaattgagcaatgtgagaataaatgtgatctagaaaagaaaaatatctttcgatttgagaacagatggttaataataatcatgacagtgattcaaggttaatgacctacatgctaaacttgttttaatttttaaaagccattactaactgaaaactccctgctttagctgaaccaacacttaacaagtgttttttaaagatgtcttgataccttcagagaagttctcctgctgctagttttctctggagcaacagtgggaaaccccaggtggttactcctttgtgaatataagcatccacatgaaattggttgtttccgcatgcacgggcaaacatgttttgttatactaatgtctgaagtacaaattgttgtagaatcattttattccatagacttccaagtctaattctaatactaacttccatcaatagttaaattattatttatcttctatccaaaggctacctgaaggtcctatcactttggtgtgagaagaatcgggtaagacaaaaagttaggcttgcaccagttatcaatagaatattaagaaagatttttaagaaggagaatagcagttccaggttccacatatttgatacttttcaccagaaaataggaaagacggattgggtctgcaatgtattttcaaagtcaaacttctattcctctatttaatgtatttttacagagatgacttgagaaaacacacatttcttttgaatcttgatgtatatatttttgacggatcagacactcttacttgagctaggtgatctcacatcattatctgttgctatgtgctattgtttctgtagccaaatgaatgggccattggcaatcaagccaaacaaattttgcttttacacccgattttagcattaatctacagacacggcttttcaatagtagaaaagatatctcccattttagtccaaatttaagtatagttaaagctacattttgggaaaaatgttttatcatttttttgttcacttgtgggatgaaaagtaggattaaacagtccattatctctaccttctctaactgcctttactaaaattttaaaatatttcttttgaagaaacaaaacataatatttgccattaaatcttaaaagtatgacaactaaatggatgctaagacaattgtgtttcaactgtgggcttataaactctattgagaaactcatttatgatcatgagttttttccaggatggacatataaagatggatttttaaaacactggcctggagaatagggagagaagaggtaataaaaaagtatttatattacttatatgagacatatctttttataatatctatatttaaaacattttaaagtataaatatttctgtactataatacaatatacagtattatagtttatggtctgtgatttacggtaattactgtgggtcattttttctgaattaattttataagtgaacaagcaaagtgaccaagagaatgatctatgatccagaaataactttcaatgataaaaaacctgaagtacaacaaagaagtcagaggcagggctagacaaaatggaactaaatatactaagaaggtgcagaaaaagaagagaagagtatgttgtggcttaaccccatatttccccatggcagaaggacagaaactaaatctgagggcaactcaacagtagtcaataattatcagccaaatcaatggatgaataggtggatggatgaatgcatggatgaatgtttgtgcctgggaacccttctgtcatcatgcataagcagcctgagtcttagataatactatatgacatgctttcttcatgtgaataaacagacctaaagacaggcactaggagaccctgggaccacaaagctcagattgttataataaaaggagggaaacaaagctccctgttgaagaaaatttttgcacacttgatatacaatatttctactaatgaacagagaaagcttgacttgaaaggacacatttatattagatgtcatccctatctagaggccattactatcaagcatctgtcaggtaaaggagatgagatgcctgtaattttttctttaaatattgttttttctaagttgtgttggaaatggggagttgcaagtttgtatttccattgcttaaaaatagaaaacagatgaagaaaggagatatcatcagcagaacatagaagatttcataatacggaggctaaaactcttaagaaaaagcaatatttattctagtgcccaacctaccatgagaaagttgtgcgactttgggcaagttatttaattcctctgggtctgaagatgagtctgcacacaagagcctataatgatcccttccaacaccgggactggcgggtctgcagccacagttacatctggaaactccactggtgcttttggagcttcccaagagtatcaggaattcaatatgcagtcataaaaaattttgggtcatgttctctaagtacaacactgccatgtgtgtgaagagatatctttattaaaatttttcttaagttgttccttcctaaagtagtgaaagctgagcagatcttagaaattcatttagaattcatattactcaattacacttgactataacacttaagaatctagttattttccttttgtagtaaaaatatattttatttgaaatatgtgaatggttacttagtcattttaatctacatgaaaaatttaaccttaaagtaactctattttaaaaatatgaaatgagactatcaatcggtacttatgaagcaatgtttattcttctaatatagtgtgggaagagaaatgtaaaagtcttgcaacacaaaagggattgttctcacaaatcataggtttgtgagatggggtggcaaaatctcattgtttttaaagaaccaagctgttcttcatgagcaagaacactgaattccctggttttctttttctagtcactatacccctggcatcataacactactgtcaatcaactgcatccagaaggtagaataaaatgccaagtgatactttcggcagaattccagagattctcagatggttttttcttttccctcttaaaaactgtaccatatgagttaggtttattttgaaatgtccatgaaaaagaagtcagatatttcttaaaattggcccctcttagatatttctggggaagcttcatataattccatttgttcatgttattccttttcatcataaatcagtcctctataaagagcttcaaattttcactgcctgatgctactgtaaaaatatacctaatatgtttgatcgaaagacagtagtcaatatatttattaggagaaatactttattcactaatcttaagaaatactagaggaaatccagtacaatctgaagttaaaactaatgattattaaatgaatgttaccattttattaaaaattaataatagtaataaaaaactacaaagtactttcacatttccatttgactctcacaataactctgcttttacacataagcatatatacttacttacctgtatacatgtacacatattatgtataataaccctcttactatatgtaagattcagagagggtaaataacatgaataagaccacaggactcttaaattatgtgctagtgattataattcctacattatttctataggatcagctggcttcactgatatcaaaagattatatatagttatataattttataaagttctgctaacttagtgactttatatgcatttttcaggaaacttgcaaaaacaagaaggtgaataaacttcgaaatgagaagagttcactaagcataatgcatttattttgcatcaggatttttcaacgttttaatttttaattaaaaaattaaacatttttaatagccgacatacatctccaaaatttacttctccaatctttccaaaagaattgatgaaaatgtaaaccaagatttagatgtaaggatgatcattataacattataagaagcaaaaattacagaaaaacattgtattcaaaaacaggtgttgatgaaggtatttactttattcacaagtaaactgaaaccagagagatcacatgatttggtcacaggcacagcaacaggtaggagcagatctgggatccaaatccatgttagctatctccagacatagatctctctccaccaaaacacacttcagaccacactccaactatgggaccaatggtttgccccattgtttattgcctatggtaatgggtttatgtataatcgtgactaaaatcattatccttttaaattgaaagaaagatgggatgggtgggtaaatagattacagcagaaccaagcagtagattgctattttgccacacataccaaatattagataatgaacttcatattaaatatcttctctaggtctttatcttcatcatagctcacaatgttgtatgatgctctggcagaaactaaaaactatgcttgtagaatgtctcatttatatgacaacagaacgactgagtgaaatggagcttaatattaagtctgttaagaggttagggacaagccaaagacagagtgagactctgtctcaaaaaaaaaaaaaaaaaagtaactcagagataaataaaagtaagttctgagctgacatccataaatgctttgtggcattagatgctgctaagagtgaattatttccatgaagccaagatcaagctgttgcacaagctgtacattaattacttgaaaaaaattcccagtagggcaatgtctaaatatatttccatgagaatagtatatatatttgttataaaggtgatgatctagccaagagggtgtctgacctccaaaatatatccactaataaaaaaaatccaaggagcatttggataacagtggttaaaaaaaattgcaaaacagatggacttcacattttgggcatgactacacacgtggccagatcaatcccagtgattcttccatgcaaatatgttagtgtgattagttgattgtaggaaatgtggcatttgcattactaatatgttttgttcttgtcatggttgtaaaaacagtctttacttagcaagtataaatgttagcaagtataaatatgtttaaacataaaaaataagactaaacaagaataaaaactgtttttaactataattatcaagtctacaacccaaaagtctttttcccatccttgacacaataacattcaaacatgatttttaatgatctcgtagtacatttattgctaaattgtactcaaaataatgtttcattttacttaagtggcacaagccccctgtaggtatgattacattccgcatactaattcttcttgagctcactgacagaagtgactatgtcttcttataaaatttctatactcccatgatctagcttagtttcaaccaaataaacggcattcagtttatatttgctgaagggaagataatctccttctagttagcatctatccacacacagtgcttaataacagattgtatcagagtttgctagttgtccaccaaaatctgttctcccttctttgtcagggcatatggctatatactacaattttctgtctaccttgaataaattgtggctggtatccaaaggaatgagaaaggaaataatgtatgctacttcgaagtgggtatggatgcatcccctcagaagacggtggggctgcaacttgggaggagtctgggttcctcaatctccctaagggagaaactcacccacctgccaaaaacacctaccatggacttatgtgaatgagaatcaacctctactgtgtttgagcattttaattgacattcatttaacactatttaatatacagatgttcagtagatgttcactaaatgaattaagtttttgtagtttgattttctgaagaatttgaaacagatcaaatgtatagagaagtttcaagaacagtcaaagagtccctctatccacttcacccagaattcctaattgttaacattttacctcatttgctccctctgcctaacacatggatgtatttgtgcgtgtgtgtgagagtgtgtgtgtgtgtgtgtgtgcgtgtgtgtgcgtatctttttccagcacaatggtgcattaaccctaagtacttcagtaagtacctctctaaagcaaggattctcttctacactaacactgtaaaactgtcacaaccaggaagtcaacactgatagaacactgccatccaagccagaggatgattaaattattatgtgcttattgggtgctcaattgggtgttcagcatgacaagtatcataaccaccataatcatcctggctttctctttcatccaccatctctgtctctctctcttttccctcctacttcctaggctgctgggcacactgccattgacctctgcttgacatctccttcctccccctgtcagcagccttgctcagacatcaaccaccagtgtttgcatgtccccatggcaagaacaagggggaagggagtaggagggaaaattagtaaggacaagggaaggtggatgaatgaattcatttttaatataatgctacgtgaaaagaaatgccagaaagtaacattctgaaaatcactggtaaaagcatccccaaagtctacctgatatggacatttaaattcattaaaaattctgagtttaagaaaacagctaagaggttgagaaatcagagttggctgcccaacttacaattctccttgctgaccagcatcttttggctgcctctcaaaataacaggataaggcacacaaaactgaattcttcacttggattaaatctgaatcttccttctcttattcctttgcttataaaatatcttcctaggcttgagacagtctagagaccacctgagaacactgaatgttccttttgagtatccagtagcataactcacactgtcaacaaggccttacttacgtgtgctgaacatttttatatttttgtatcctttatcacaaaccaaacactgcttagttataaaatatatgtgtaagtcaacataattttttttgtcaaagcaaagatttttctccaaaatatagctacagaagaaaaggggcttataacaagtgtatagtacacattcagaaacattttgtttcatggatgtttcagtaaatgcttcatttctatgtaggaggtataagattcctgctaaaaatacattcccttccctgaatattcacaatagcttgccaaaaattctcacaaatgaataaagacagaactgattaactgtattaagtgtcctacttaatacaataataattcaggttttaaataatttcaacatcagttcattatattaattaatctcataaaaacctcccaattaatgtactatgtataaattttatcaagtactttgatgaattaagaggaaggtaaaggttttcatcaatatctgcaataatattattaaattgggctaaaaggaaccaagacaaatgaagatatataagaaaactaatcattattttagactaaaacaggaaaagaacatagttatctaggacactgtctccttagtttttaatgtttcttccccagatgggtttgcacatcttttgcctgaaaaaagaacttatttccaccacacaagttacattaaatacgtcttttagctcctagggagctgaaaggcaagtccaaaatgaacttttttattcgttatgtcatgaaactataacactgcattattaatacacctctaatcaataaagcctaaaaatccattcccaagagacccagatttctctaccagttctagttgtactagttattctcagcggtaagttttcctagttcttaatattaaaatgagaggtccagaggctctaggtggtggaggggttgctagctaaaaggagggtgtcctacagaaagggacagagtctccatgagcaatgctggatggtacctgtggtccagttcttggcacatggtgagtgctgcctaagtcttggtgccctagacctgcagcagcaatcggcggggaaaggaccatgactttggtgacaaaagtgatggcagaagagtggaaagaggtatgagtgatgactaaggacaaagaaacaagggtagaaggacaattccagcagcagcctatccgaataacaaaatccttatctcaggaaaaccatctctgctatgaatacatacacacacatatattcatcaggtatcaatttaattactgattggaacactgtaaacttgttcaaaatagaggttattattcagtatcttcagctgtccggattcaccattttatagcatgctctctgacattagtgagaatgaattgtactctacatatttaggtaatggtttggtatacagctgctattaacgatttgtgtgctatgcaatatttgtggtctcctgtcacccacctcaggagacacaactgatgtaagtgagacagctcagcatatcctatggaaaaatctcttattaaataaaggtcaatgattaagtagtatagtcattgaattaatttgttttccttaagaggagctctcctcaggtcaaaattaaagtcagggatagataagtctctcatatggttcccccagtgtgagaggagcaagctgttggtttcctttggtggcttttttcttgtctcagaagaataaattaataaattctgcatagctgtgattttgtgtgacaaaaatgaagaacctgtgcctctgtttacaaagcaatgcaatgggaatcacctcccctggtgtctcttccccatcaccaccactttgcccgctgaaatgttcttaaccccacccaccataaaaggtgatgataaattgttgcttcaaactcatgctgattgaaattttccagctatttttaaataacccccactactggatttcttgcttctatgttatatgacaatgcttctttcaggtgaaaatgtcctggaaacaagtaatttttacctggctacctttttttttttttttttttttataaagaaagaagtttaattgactcaccgttctgcatagctgaggaggcctcaggaaacttacaatcatagcagaaggggaaggggaagcaaggcacacctcacatggcaggagaaagagagagcaaaaggaagtgccatgattttaaaccattagatcttatgagaactcattcactatcatgagaacagcatggagaaactacccccatgatccaatcacctcccataaggtccctccctcaacacatgggggttacaattcaagatgagatttgggtggggacacaaagccaaaccgtatcactatggatggtagtatcagggtgcacatgcatctttttttttttctctctgattttctttttttatttaaattctttttttttaaattatactttaagttttagggtacatgtgcacattgtgcaggttagttacatatgtatacatgtgacctggctacctttaaagatggatattgactcctccaaaatgctttcacttgaaaaaaaaaagaagaaaaaaacctcaaaaatgagaagggctttccgacttgaggaaagcaaatctttttaacttgcactaggaacatcacgacattttcttgcctcttagatggtttgtattttggatgcttctgaagagaaacaaagacatatagaatttaaacattatctgtgtttatttgtagaatacttattttttgtattttgttttttaaatgagtatgtctgatatctcatacatttagaatatttgtaatagaatagcaaatttccaccatggaatcagtggagagctatgcaatttaacaactgcaaagaatcttagagatccttagagtaacacatcctcttatttacaaatggggaaacagggtatacgagtagaagtgacttgcctaatccataagctaggggtacaacagggtcattagggccatcctgttcaatttctccctgatatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgttgttgttgttgagacgggatctcactctgttgccaggctggagtgcagtggcacaatcttggctcactgcaacctccgactccttggttgttcaagtgattctcttgcctcagcctcccaaatagctgagattacaggcacgcgccaccaggcccagctaatttttgtatttttagtagagacagcgtttcaccatgttggccaggatggtctcgatctcctgacctcgtgatccacccacctcagccttccaaagtgctgggattataggcgtgagccaccgcgcccggcctcttgtagtttttaaaattaaatttaatccaataaaacatttagtttgcctttatttggaatttgttatctattgttatatactctattaatacctcctcttcagcaaggaaattttcttacatctgcttacacgtacatcatttgttagagcccctaaatattggtaatgatgatgatgatattatagcatgaattactttacgttgaacattggcctaagtgctttaaacacattatttgcctagcatttacaacatttttgtaggtattatttgtcacaattacattttcttgttctatgatataatttgttttgatatcgtattagttttctattgttcccctactgaattaccacaaatttattacattgtgggattgtaagtctgaagtccaataggggtctcactagcctaaagttaaggtgtcggcaggactgtgttctgttttggagactctaggagaaaatctgtctccttgccttttccagcttcttgatgccattcatagcttctttcatgatctggcatcctatacgttatacttattttctgattatattttgcctaacctctgtgagatattaattatttgagggcagagatttttatttgtttgttcataactatatccaggtgccttaaaatgatgcctgacacaaaataggtactcaatcaacataggttaataaatgaatgagcaaaaagttttattgtgcatattaattgttacctgggggaatatactcagacatcttaagtctcatatgtaaacttggggtattgatatcaacatgccattttgaggattaattgaggttatgtctataaatacctactagcatagtgtctagcacatagtatgaaaacattgtattattattatttattaaaatggcattttgttttctttatagcacctgacactatccaaattgccttttctgtttcttttctttttacttatttcttaattgtttcacaaaggcagagtcttgtatgctttgcctctatgtctttagtacctagaatagtgcctgtttaaaagtaggagctgaataaatgtttgctgaattaatattaatcatgtgtaggaaaagaagcttgggaatgttattctaccacccacagctgtgcccactattatgatggttgttttgtgtgttctttctcaaggattcactttcagaactcaaaatggggtgtagggtggtggtggtgccagcagtggggatgggagaagctcgatctctccctacagtagaagtgcttactgctctatgtgttcttcagccctataagaaccaatgaaagccatccacacttccctcgatactggacatccctacatactcacagcagtctgcaaaacatatccaagggcccactgagacactgaagatgacccattgatttaatacatatttgcaaggctctgattgagaacctctggacaggcgcttatctagaggttacagtgtgtgactaacacgacacagtttaggatttatgtaacaggaatatgctatagggagagaaagaacagaagacctcagttgacacggtggaattggagtgagagagatttccatgaagccaagtaaatagtattttggagagtgaaggaggagacatcatccttaacttcaatattattatcctgtgtagattcatactttgtgtattttttacttaagagaaaaaatagtaataatattcgctaggagaaacactttgaagaaagaaataagtccaggagccctgtaatgtacttttcctctatttatttcccacataaaattaaagctgttttagttctcatcgcatttatcatcttgaactcatttgccacattattttatttaaatattccttaacctacagagagtggacttaactgctaaaaagtacttaatacatgttcccaaggaactgcttcaattaccactgcacaaaggtttgtttgtttttaataatacagtattattactagaagtatcatcaagtcatggaatggtcaaaatattcttacttctattgctagggtgttagaaaggactctggactacttgatgtctagatgcagataaaaaaagcagctgttcacttcacataaagtagccgctactgcttaaaggtaagggtaaatcttgttcactgtggatgaaggttactaaagagaaggactaacatataaaataggttcaaatatatacggagatatagacttaaaaaattaagacttctccttcaattaatattccaagaaaagaaactccatattgccatctaaacacagaagcttttctgtaatggtattccagtgaaagtcatttaaattcgaatagaaaaatttaacttgagatctgcccttatgaaaagtggtgagaattcaaatagttctcgaaccctatttgtcatatcacttcctgaaaggatactcaatctcttaatttttttctattattttgtactttatggaaaaatatttaggaagattatagaaagaaaatttttaggaagtagcgtctctagttttcctaaaatttatgtcaaacccggcattatttattttacatataaaaagatcataacttttactctttgttaaaactatattaaaacaaaagagaagcaacccactaaataataattgattaatttcatttggaggtcttctatgtttagtatgtttatggactttttaaacactgaggattcactaattttttttttttttttttttgagacaggatcttacttttttgcccaggctggagtgcagtgatacaatcacagctcactgcaacctcaaccatccaggctcaagtgatcctctcacctcagctaccagactagctgagactacgggggtgtgccaccatgccaggctaattttcgtatatattttttttttggtctaactgtgttgcccaggctggtcatgaactcctaggctcaagtgatctgtccaccttagcctcccaaagtgtgggattacaggcatgagccaccatgccaggcgagaatttgcttttaaatgagaaagacacaatacctgccttcggaaagttccctgtcaaattttagaaataaataattaaacaaagtttataggcataataagtcataatattcttgaaaagatatgcagagggttccaaaggagcaccaaccaaccagaggggaaaatatgggggcaacagagaggcaagaggtgatatgagagagaaagcctgagctagaacacagagccaggtcatgaatctgaaggcaggaacaactctgtcagctgtgagacatgaatttggaaggctgctgggagagaaaagcagagattagtcgtgcaattatctacttaagatattttgggctggaagcagtggctcacacctgtaattccagcactttgggaggctgacgcgggtggatcacctgaggtcaggagttcgagatcagcctggccaacatggcgaaaccccatctctactgaaaatacaaaaattaaccaggcgtggtggcagatgcctgtaatcccagctactcaggaggctgaactaggagaatcgcttgaacctgggtggcagaggctgctgtgagctgagattgcaccacggcactccagcctgggcaacagagcgagactccatctcaaaaaaaaaaatatatatatatatattttgaagtctagagatgaattccagaaataaggtatacagaaagtgaaactgtaggactttgtgattgactagaactgagggacaagggagagggaaagggaagagttgaagatgatggaaacaatagattacaggaagaggatcaaatttagggggaagaagatcagatcataatcaatacaacttaattccacatgttctgaaagttaaatatctcctctagccaaaagacccttcctattttacttctctggacctcttaatgtttctttgatgtttattcccctgcacaaataatttaacccctttacagatccaaaattttatagtaggcaaatattgtaacccccttgaaaatgtatgttatgaatagcctttgtaggtgatatttttgcagtttggtaacttaggacaaggtccattttcctgtcccttgttaaatgtcacaagacttcatcttctctacctatatatcacaaagtaccttctgctctgctgatcacaaggtaattaagttttggagtggaggagtgtcttaggtttatgttcatgcattaaatataaagaaatctatgatttttaaaaaattaactatattgaggtataattcacttacaatcatatgcactcattttaaatgtacatttcttgagttttgatgcattaataaacccatgtaacgaccaccacaattgagaaatcatatatcttcattattttccccaattttcctttgtgcctttttctagttaattccttctccttctcctccacctccaccccagccccatgggggtagccatgaaggtacacctcttggatcttttctctccaattagctgccaggagtgctattggcctcctgctgcagcagcaatgggatccaccacagcacaggaacccagactggcctccagccaatgactgggagcagcaaggaaactacagcccagacatgtctgcctaatgcatgactcctcaacaagtaacctttgttggaagccaagactttcttgtaactgcactgtaatctgtggctattcctacccaattctccttccttctgcctccctttgaagtgatatcacaactacattgtggtttttccttgcctggtttttctcctgttctctttctacctttcatagctattgcctgcaataaatctcttgtggatggttgtaattctaacaccatcttggaatcagcttcctgaatgactgaactgatgcctctacctccagcaagcatggatcttgttgttaccatggatgacatttgtcttttctggaattatagtatgtactgatttgtgcctggcatcacacagcatgatagttttgagattcatccatgttgttgaggttatcagtagtccattccatttttgttgctaagtagtattctgctgtatgaatacagcacaattgttgattgattattgtgttgttaccagttagagctattaagagtaatgctatcgtgaataattctgtacaagtcattgtatgaacatatgcttccattaatcttaagtaaatacctaggggtagaacttacagatgaagaaacagaagtacagcatgtaagtgactttgcacaagtaggcagcacaggttttctgactttaaatctatgctcttaactcctatgccgtattgttcttcatgggaagaaaagctatttttcttgacccatttaaactttccataatgtttaatcaaaatattcaatatttaagttaaaaacagcaaaatctgggatacaaggtgtaccaacctcaagtaaacatgccaggtgtttggaaaagtagaagaataatgaaccttactacatgcaaactgtgcaatagttacatgtagaatgcatctcaaaaaaaaaaaggttcctggaaaccacagtgctatgaaaagataatcatagaaaacaaggataaatttgaataccacatactcattttaagaaaaattttcactgagagaaaaaatttaaagcaagttgatggcatataaacatccttgaaattcttcaagtgaatacaaattagttgagttaagcattcagataatttgggtccttctcaggtggcctagcaagttagtcaaaagataagacctgtaatcaagctgccctctctcattaccgtcgttaaactgcataggtagacataataatcgacttgaataatgtaccatcaaacaacattaaatagtctatcagatcacactgcttatagtacacattaactactcatatgctttactatctaaagcagggttgtccagtcttttggcttccctgggccatatttgaagaagaattaattgtcttgagccatgcataaaatacactaacactcatgatagctgatgagaaaaaaacaaaaacaaaacaaacaaaaaattcataatgttttaaggaagttcacacatttgtgttggatctcattcaaaaccatcctgggccgcttgtggcccatgggccacgggttagacaaacttgatctaaagcaataccatccattataattattctgtgagccaattatgtaattttaaattttctagccaccacatttaacaaattaaaaagaaccgggtgaattttatattttatttgatacaacttattcaaaatgttatagtttctacatgtaatctataaaaaaattactgagaaattttatgggtttttttcataatatgtcttgaaatctgttgtgtattttacccctatatctcaactcaggctagctacttttgaaatgcttgatagcaacatgtgtctagtcactatggtattgtacagagtaggtgtagagatcaacaggaaacatttattgagtacctatataagaaattatactagataccagggaaaccaaaaagaaaaaaagtcatctgtaagaagtttagcaggagcaacacagtgaacagattccagcagagattatggcagagattactgtgatcttgggcaaaagtgtgtatcttaggaatttaagatttaagaaagaattttaggcatgaactatatgacaaacatacataaaggcaggagaagcctgctatgctctggtgacaatggatcaaccagtattagagaattcacatgatagatactgaatttcctggatgctcagtggttagctaagtcttaagtttatgaatgaacaaatgacacaagatacaacattagaacgaggatggagaaaaaatataaaatctttaaaatatcagtcaaacgacaaattccagcttcttatgaatgaagagccagttaaatacgtttgaatgaaaaatgacgtgtgaagtgatatatgtggcagttaaagttaaccaggagagaaagctaaactaccgctgcacaggctcagcatctattgcactaatctaggcatgagttgtgtcctatccaaaccttcataatggaagagatgggggagagaatgaaagagagattggaaaaaacaaggatcctaaaatcatcttatggctaaatttgagagggagggaactatggaggcatcagtgatttatatggtttatattgtaggtcatgggaagtcataagaaaaattctggtgccaatggtgataactgatatgaagggactccttgcttgaaggaaaaattaagttaaactgagacctgttgaaatcaaagtagtagtgtgatatctaaataaaaatgtgtagcgtgcaaagagaaatatgagagtgtgtatcaggcaagagatctggctagaaatgtaggcaaagggataaatagtcataagactataaggcattgcggagggaagaggaaaagcttggagaatgagtcagaaatccacacaatagattaaagatttaagttgtgagaaagtttttatggagagtgttctggggaataaattagagattaataaaagaataaaaaatcaaccaggtagaaagggcatgcatcctggtgtgtgcaaacatgtatagctgcatgaatgtcaagtttactatcttacgtggctatatcactatgcaaactatagcctttcatagtacgtaagtgaaagcattagaggattatctgtgtagtcctaaaatcctttgtgaatacatcacattgtcctattacattcttgcccatgttttacataaccagactgactgtaatatgagtattgtgtgtgccctttgttaataaatccttgtataaaccccacaaggatttctctaaagacaaacctggcttgctaaatattactcactccaggctaaattttaataaattccataaaacactatcagatatattcctgagacttttgtattttaagtgctgtcttttcctatttggtatttgcattggttacttttgtggggtgtgctggtttcttccttcttccccttcagacactccaccccactcctgcactgtgcctggagaagatgaattgtactgactacaccacggtttttcaaccttggcagtaatgacattttttaactggatactttgttgtggaaggatgtcctgtgcattgtagatgtttaaaaaaatccctcagtgaatcatagtagcactccactcctctcccttcctcccctgagctgtgataaccactaatgttccctgggagcacaattggccctggattagaaccactgctacatcaatgcactccttttgtctacgctgtgagtttggccagtggaaacaccacaaagaggaaacagggagggaggaaagtaaggtcaggtgatccattttccagatattgactattctcgccctgctaggccagtgcaggcaggtggtatcagtccaaagatcacacagctcaagtcaggcagccgtcttcacataggacttgcttggtcatctctccttcctttctccctctttttctgataaatggtaatctccctgttcatttagttcattttggcctagtggttataacggtgctcgctgttgccatcctaaagtattgcactattccgtgtgtttttcctaacccggtctaaaccttcgtaattagtccctttataaagtctcctccaactaccaaatttgtgtgcactgtttgttttcagcaggagttataattgatatgatgtaagtacatatcaaagtatttacagaaaagcaaaattccaaatattgagatgttttctctgtattggccccaatcattggaatgttttgtgcatacaactttataataatcactgacacctatattattttcatactttgatttgctcaatgaatgctagttataaaaaacaagatcatttaaaatacttccttgcctttattattctcaggtgaaatggagatatgaatttataataaagagtgacaagttagtggaattgtaaaataacattatactcaaaaaagaagaatagagattgtaaagaaatgagattgagtccgtaagtaatgtataactgtctcagtatttcattgtcataccttataagtaagcagggaagtacaaatagatgtgtacttattaatttagtctttcagtcactcattgagtcaatcaattcttgaggccaattgtttttgaaggcactgattgtgctagatactgtggatgttacaaaggtgaataaaatgtcttaatctgaggaagaatttacaatctacacaggcatgaaaaaacaaggaagagtgtaggtgaaagggaaatttgaatgtgaaatcaccaaggtcacaaagcatgtctcctcagtgctagcgaaggactatataataggctcacaaaaatatttgtttaaaatgtaattaaatgaaatttgaagaaagcagaaaatgtctcacaatgctatgtggaagttattagaataacacccccttcccagttcctaattgcattcctggcatatcttatgtacattaatctataattaaatgaaacattaactgctttattaatggctactttagaaggagtgcattcattaaggattattttgaaatacaaataatttccccataaatcttacattcacatatttggattctgagttttacccaagtggcacacaaccataatttgtaggacaggtgaaataaagttcctactattctggtactgtatctagactgagctttacatatttttaatagctttttttttttttttttgagacagagccttgctctgtcacccaggctggagtgcagtggcgtaatctcaccctactgcaacctccaccttctgagttcaggcgattctcatgcctcagtctcccgagtagttgtgattacaagcatgagcaaccgcatctgtctttcttttctttctttctttctttctttctttttctttctttctttctctctttctgtttctttctttccttctttctttctctctttctctttctttcttttcttctttctttctttcctttctttcttttatttcttctgttctttctttcttttctttctttctttttttttttttgtatttttagtagagacaggatttcaccatgttggccaggctggtctcgaactcctggcctcaagtgatctgagggtcttgacttcccaaagtgctgagattactggtataagccatcacacctgaccaatagcttgtatttttgaaagaagttttaggtttgtggaataattgtactgagattacagtgcattcccatatactccattacccttcccccaattcccctattattataattttgcattagtgtggtacattattaaaacttatgaaataacattgataccttattacaactaaagtccatagtttatattagaattcactctgtattgtaaaattctgagttttaacaaaggtataaggtcatgtatccaccatgacagtatcatagagaatagtttcactgtcctaaacatgccatgtgcttcacccattcatccctctgcactttctcagagccccaggcaatcactgatctttttactgtctccagaattttgtctctttcagaatgtcatatattggaatcatatagaatgcaacctttcaaactggcttacgtacctaagttttctccatgtgtttttgtggcttgatagctcatttctttttatcactgaataatattccattgagtacatgtgccagtctttttgttcattcacctattgaggaacatcttggttgcttccaagttttggcaattatgaataaagctgctataaacgtgcatgtgcaggttttggtgtggacacagtttacatttcctttgggtgaatatcatgtagcatgattttggatcatatggtgatatggttaggctttgtgtccccacccaaatctcatcttgaattataatccccataatccccacatgtcaagggagagaccaggtggaggtaactagatcatgagagctgtttcccccatgctgttctcatgatagcgagtgagttctcacgagagctaatggttttatgtgtttggtagttcctcctgcattcattctccttcctgtcaccttgtgaagtaggtgccttgcttccccttctccttccaccatgattataagctttctgaggcctcctcagccatgctgagctgtgagtcaattaaataaacctctttcctttataaatttcccagtctcgggaacttctttttagcactgtgaaaatggacaaatatatatgttaagtatagtttagcttcgtaagaaattgtcaacctatcttccaaagttactgtaccattttgtattgccagcattagtgaatgaatgaaagttcttgttgctccacatctcaccagcatgctgtgctcttggtgttttggattttagtcattttaataagtgttttgtgagctttactgtttgatagctgagttacaaactggcaagtatccaagcaaagaacagagaactggaggtttgcttttctaccgaaggaaatatgttgagaatacaggaaagtttcacgctaaatgtaaataattttttacagttaaactaataatgagtgattgaaaaaagttgacttgtgacatacaaatgatacaaacctttcattgtcctctctttcatgggtattaatatttcatttgataaagatttaagtactaatgactatcagtatctgttgattgctagcaattttgagtagaacactttttctgatatgtatgaatatatagacaagaatcatatgatacacctggattgtgtaatagcctttatgatgcagtaaggcaaccactgaacttggaatcagtgaattacaatttgtttcttctgggtccctcactagccctgtgactttggtctatttgacttctgtgagcctcaaaagtgcatttgtaaaatggaaattaaatttttttctgcccatcttactgtgaagctgttgtaataataatattgacaatagcaataattatactaataaaaagcaatttactgtgtatttgaaattatgcaaacaatttgaaaatcatagcactatataaaatgtaacgtcacattagtgttggagtttacaatttggcagggaagctgtacaactaaccacggcacaatttgataagcaataaacttcctttagagtatacggagaaatggggaggattataaatattaagcccttttgtgccaggctctgggaccacaattatcccatgtgatctccatcacaccttgcagatgtaaattttcttattcttattttatacagatgatgcaactgaagaacgaagcaagttgtccatggtcacacagctaataatgatagtattttcctattcctcatagaaaactggagacggccacattatatatccttaactacagggaccatttctagaaatcaaatttctagaattcaagccacaccacatacaatatattaccccatagcttattgataatgctaaaatatgggatatctttgcatagagatccttaaattgtgctagaatatgagatctttttgcatagagatcctctcgcatagagaattcctgctactcaagaatcaatgttagacattcactctgtgctcacagtgttcttttctcttctgtcaaaaaaaaaaaaacaaacaaaaaacaaccaccttattttacttgtgaccttcagtaccaagtaagactggatagaatatcaagataaatttgcgacagatttagtgtcctttctgtcgcattatcatggttgcccagaagttaagaggtttggaatgattccagtctgataaggagaacaagacattgaagtaagtgtctggagtctaaaatagatctgggatagctattactttagcttttctgagatttaatatgggaatgaggtgtaaaagaagagttgaaataactattacacagagatgcttgttccttcttcctaaggcctaagaacatttctcactcattcttctatcctagaattcataatggtatatggcactgcacagaaattcattaaatgttagtgaaatattacatgtgaaagaaggtagtaatgtaaatagaacctaatataattttttatgggctcatttatgttctgcattttcttataaaattactttttagattgttttgctgctcgaatcattactggttgctatctagggatcaccttcaaacccctttcaaaatacaatgttcaaaaaaaataaaaacaagggcctggcacaatggctcacacctgtatcccagcactgttgggaggccgaggcaggagaattgcttgagcccaggagttcgaggccagcctgggcaacatagagagacgctatctctataataaataaataaataaatatttttggaaaaacaaatgctgttaaaatgcatttctagcttaggtcacataaaggatctgaaatgggcatgtaaacaatggcaagtttttatatatatcaattaacaggtcttgaaaaaagtattgactctactggcttgtgtgaaatttccctgaatgaaatcagacaatggtgttctcagaaacaatgcatcttagaagagttaatatcagccaaagacattatatcatactaacttctctcccaataaaatgcctagaaaacaatgtatctctaacaagaaaaagttcaatgctgtgttaactggcaattccatttaaaatattttcaaacacattccctaaggtaacaaatataattattaaaagcctaataaatcttttaataatccagaaagaaacatttagaagacattaagaaagacatattcagaattcagacagaagctcataaaagctaacataaaaagcaggttaaaaatcaatttctacaagaaaaatatagacatataatcaaacaaaagggggaaatacataacaaacactagacgaatgcaaattttcaaagctatattttaccaaattttaaaagttaactttaaaagaagaattaaccttggtggcagcaaaatccatgtctgtgtgtctggctgatttgggttcaattaaaatcttgggtagagaacacttaagtgaaaatatagggcaaaaataattccatacaaaatataatgaataaatagagcaaaatttcgcatataaccaaattccaacattttaaggaaggtattaatttcaagctaatatccaaatttgtctggtaagaaaaaggtgagcatgatccctatgatagtggttgccattacttctacttttgtgaggcagaataggtgggacagctctagggctcttctgattttattctatcaattataagaggtctgagaacaggaaatgaaaaaagctatgaccctcaagccatctagctcaaacgatttcactggcatctaggatctgatatattttggattggggaagagtaaacacaggcaaaatttgcattggatgtgaagctaatggcccttccacataattttgctgtaggatatcaattgattccctgtttcagaggaaggattgttaagctaaaatggtttcaaccagatcaaacattaaagtaagcagagtttttcagtagatttgactagattcttcatttactataaagatctgccacacccgaaataccacctgaaattagttttctagttaaatcagtatagactatggataaaagaagttacgaagacaaccctcttaatcttgatcaatattcagagatgactactccccatcacaaaagctaattcgtttttcacatttttctctgctcctaatgaaatcttttttgctgaagtttctgaagaaataaataaagaagcctggtgcctctcagagttccacacagctgatgagtctaggcagtgacaaatgacactatattcctcagcgtgcaacctttctctccctctcatcttcttgcaatggaacactgctacattccttgcagaggaaacgtactgtacatttcatagctgtcaccttggcataaaaggcagagggagggggaaattcttcttttggtctgcctaaacattttactttattttttatatatcaataaccatgagaaactattgagtaagtttagatataaaacagagaactttgttttggaaggcattacttttcaaaggaaatgcatcgtggagagtgaggagtgaagggtcaatgttttcaagagcgatcggaagctccctgccttgatattcctaatcttctttctggcatcttatgctcaccaactgcctaatagtggatgcatgtggttctgcccatctgtccaattgccattctaaattatgtggtttactaagaaaatacttaacattatatgaataatgtataattaattataagtagtttttaaatcttcaagatttatctcatgagtgaaatggttgctttgttcttaaggagaaaattaatttatttcccacgtatccatgtacaataagtagtgctgttataaacatataagaaaatgagctatcatgataagtatacagcatagagttaagtttattagaataccctcatattctataatatacaaaattactaacgtgcagtgaaatcatatagaattctgaagtagtgaattgtttccttactgtttaacacattcttgcagtttgtctttttaaaattaaaatcaggaattctgggcagttagttgtttttgaagacaatgtcatttatctttgctttaagaaggaaacagtctacatttaacaaacaattcattttctacatattaattgagcagtgaaaatatggttggcaggtctgaagaacagggaaaaagacagtgtagttagagtgtagttggagggtggcatacaaggagaaaagggataggaagtaagaagttactgaggtccagataatgtagggcctttaaaacacagtaaagatttgcatttcattctatgtatgataagaggtcactggatggttgggagcagagggggatgtgatctggtttctttcttaaaagaattattccgactgctcaagaatggactaggttgggtgtctaagtggaagcaggcagatcagttcagaggttagggaaggagtccaggtgagaaatgatgaaggcctagcctagggtggtaacagtagagaagggagacatggtaagactggggatacattttgaattacagtgtaggtaaaattattagcttaagggttagatataaaaggtatgaaaggaaaaggatcaaggatatgtatggtatatctgcaaatgctaggagaccaaagtgaaatttcacatagtgaaattactgtgtttcagcagttagggataactttttggagttctggaggcttgggctggacttttttgcatggataaaattcagacaggagacataaaagccttcttagtggtaagacagttattagataattgggaagtattttgaagatacttgtctacctagaatgaagaattttgttgagtatttgagagctatatggctgaaaagaaagaggccagataaaacaaggccctgagtaacaagagtaggccttgggccttgattctatagagagtgcaaaaccactggctaattttttgtaactaatctggctagaaatttccagatttccagcacactatattaaaggaagtactgccaaaaaacatttcatggattccaaaaatagagatcaatgtagatgaatttataagatgaatgaactctgggaagaccaagcagatttctgaaacaacactaccatatatttcattatatacacacacagctacacacacacacacacacacacacacacacacacaccataccctgaacataccctacaccctacataatacttatatatacacgttagtgctctgcagttaatttttataaaggcaccaattagtttctaataagaaaaagaaatgtgtaaagaagagaagaaatttcattctctccatgaagaataaaaaacacaaatatttgttagctgtaacaaatatacatttttttctcaaatcatttcatgatatttatcacatgaaaaatgggtactttggggagattttctcctaaagccttcattttttcatatatagtgagatctaaacaaccaatttctatttacagttgaattctacttccaaaaacatacaactatgactcaatccttgttacctttcaataaactgttaagcccaaagatataacttattttaaaatgtgaacctagacatttgggatgatcaggcatgctagttactattaagaatagcagtatgtactaataaaatggtattcagagattataagggaagcactaatgaataaaaatgacccaaactatatataaagtctttgttcatacacaaaataaacacatgcactatggatggggttctctaacgacagtagaagtaaacgggcagctaaagagtgtatcaaaaactgcacttttacagtttcctatatatcgtcagacaggttaacaaaagtatcgaaaagttggcatactgtggataaagtacattaaaatgagaaaggcaaagttttaaggatatatgaaaatgaaaggatggcaactagtatggtcgaaattcatgtgataaatcgtaataaccaacgtgatagtattaagtggtggggccttgcagaggtaataaagtcacgggggcagagccctgacaagtggaattggtaacattatgaaaggccttgagggagtgagttggccctttctatctctctaccatgtgagaacacagcatttggccctctggaggatacagtgacaagacaccatcttgggagtagagaaccggccctcgccagatactgaacctgaagacaaatgccttgatcttggagttcccagcctccagagctatgagaaataaatttctgttgtttgtaaattacccagtctcatgtattttgttataacagcacaaacagattaagacaacagctttctcagagcccaaaacatttataatagtaagaatttgcaaaatcaaacaatgagtaaggcctcaaatgatcagctgtacttgctaaaaatgaaagaacaactaaatcactcaattcacttgggcaagacaatccattattcgtctaaaatttttgttaataattttctgatttactatctaatagtactggataccatacaaccaattactcctacaaatttttttgttaatagttctctgttttgctttttaataatactggataccaatactggatatccaaaatggtttgatagttgggaacaaaggggataaaggaaagaaatgtactataaccagagatttttgaaaaataatgagactgtatgtactatgatacttcactcagaaaacctcacttcaaacttaatgggaagagaaaaagattggggaagaagtcttcaagcacagtccataatattgatagatagactcctacacatattaatggttgacagctagatgtcaatgcctagagcacaacaaataggtcttatatatcactatattttttatgatgcttggcattgtattttttttgtttgtttttgagacggagtcttgctctgtcacccaggctggagtgtattggcatgatctcagctcactgcaaactccatctcctgggttcgagcgattctcctggttcagcctcctaagtagctgggattagagtcgtctgccaccatgcctggctaatttttgtatttttagtagagacagggtttttccacgttggccaggctggtctcaaacacctgacttcaggtgatccacccgccttggcctcccaaagtcctggaattacaggcgtgagccaccgcaccaggctggtgtagtattttatacacagcatgcatcaacaaaatggatcagatggatgggtggacaaatggataattgaaagaataaatagcagaaatgataactctaacttttaagagtctatcaagctaaaatgacttttgaatcagtcgaatgaatgtacgtgggaactgggaacttaagaaagagaaggagcataaattgcaattgtggctaaagcagcagaatgcttatttacataagttttaaccagtgcggaatattgtaattaccatttatgttgtttttttatgaatccagtacatgcttattaaagggaattggagaaaataaaaataagaaaggaacgcaataatccagactgtaatctaggacccagtaatagttacttagttgcaaaatttcctcaagggcaatatgagagagaccattttgtgcttgttgccatgctgggggtgcctactggcgttaaagaggtaaggcccagggcttgtaaacatcctacaatgaatgagagttctccacagcgaagaattacccagcccaaaatgcaaaatgggcttcactgagaaaaactgagtaccttgtgcatttattccacgtctttatatgtacataagccacatacaggtttttaaaaaataaaaatattatgctgcacaaactgctttgtaatttgttcttttcacatactgcaacaatagcatccttccacaccattaataattattctacaacattttaatggctgttcagcaaaccactgcatggatcaaccataatgcatttaatgaggtccctatgatcaaacttctagcactatttttttcaattttgttttataatcaattctgtgataaacatcttcatatttaaacttatgatcatatttaaattcttagacatgcgactggtcagagcatgcataatttcaatgcttttgatagacttccaacatgtcctcaaaaatgacttttattagtttattctctaaccatattgttctgattgatggacatctctaacataaagttgctgaaaatatgaaacatcagctgaggcactgtgaccctgggaactggctggtcccttcctagcccacatcttagtagaagatgcaagggttattgtggaatacgtccgcgggttaaaaaccatgtatcaattctaaattccaagtgccagaccctttcattacctttcattagcgaagtataaaaagaaagagggagaagggattttcaaggaaagtaataagaagggaagtattagtggaacattagagtttgtctctggtccttcctctgagtggggactcatgaggcttggtgttgtctgaaagcaggaaggacttgggtcttactccctggtaggatgcagcctgaggagcaaggccggcagtcacagtgtgagcaaacattcatacagacgtgggggctgacatatcaagttggagaatgtatgctcacttcctgtcacccccatacaccctgattcccaagagttgaggcagttgtggtaggggttcttaggtttcccatgggctcagattaggcctcggacggaagtgaaggcagtggctggctgggtgaaatatggcggacagagtcggtgagtaacaggagagcatgttatcccttttagacccctgaagtattagagaggatcagccaggcacgtttagaccatatgatgtatcatattgtagattcaccccaaggcatttgtggctgtgcagtaaaagtgcaggatgaaaccagactctctgaagggtagggatattcccgtccctatccctcatcttttccccctttgcagataaaccatcccactttcaaatgaacttgggaggagggggctttgaactgtgcttggggttgtttctcctctggaaatgcttccattctaaaaagttctggcatagggaattggcctaaggaaaaactctgccctccttccccttaatggactgtcctgcctttgagtgtgagtaaaaggggctgagatcattcatcagccaattttacagctgcaatctacttagacctgcccccatctaggtcaccaaggatctttgtcagcatttggtacaaagcctatgtgaatgaagatggtcatttctttggtgttgtcccaagaaatgtaacagaaaatgactataaaagaatggattctgatatgggatgctgagtcctgataatctctctaaatgtctttcatctaggacctgcaatcagccattattaagaaaaagagaaaaggattgcaggggacagttccaattaacctgtggcatcccaaatctgtgttttactgaacacctagaactattctccatgggtttggcgtcaaagaggcattaggaaagatggtaactattcctcttacatacaatattaaggcctttgagatttgcttcagcttaacagagatacttttaaactttgttaatttaaatgtttcccaaaattatttgagcagagaatccattctaattataccatgtgcataatactcaatggaatcacatgactttggggaaatcagaggaaaactaatagtgattacattttatttagctaaataaaacggcatgttcagtgatgcttttccctctttgtgttatacaatttacttacttaatatcatcaaactacaaaggaatatggaaaagattttctgtgatcatgtatcgacacacttcttagagaaaatgtaagttcttggcaaaatattacaactgtataatgcactacaatttttaaaaatcttttgtctgcattatcttatttcattcacactccaaccctgggcagttggctggccagttacagatgagtagctatggtttagaaaggttacatgagttgccagggatctggcaacgcataattgaatacattgtcttaagattcaagctattaaacacagactgaaagcattttgaactcatttaattcaacatttttatttcacagataagaaaactcatgcttagagaggggagatgacatcatccagtagagtgagagagagaagaccaactctctgttccctgaattcaagcccatgccctccacaccatgccatgttttccctgtatatgaccaaacaaaatggtgcagttaaaccacgagccgtcatgcacaggagggccagctggccatcatgctggatcaaacagcagatatagaccatctctagcagaacacttgtgaattgcctttgtttcaaactcataaatgttagtatacctttgtaggaggactaccatgaaagatgaattgccactataagcagtcattagtatttagtggagattaacttttaaaggtgcctactttagatatgtcataatattagaaattaaggatgaagtatttctatctatctatgctttgtaggacaattatattaatcccaaagttacctgacataagtaggaagcacatgcctcttctgatatatagcaaataatatatactcaatccactgagcaaaaattggaacctcaaggcaaagctgtatgtacaacctcagaaaatctgtgtggcatgaaataccgtaacgtacactgaaagggcaattttcgatttttgtgaggattcccaatagccaaatagaaaaaaagtgtgtatacatgtgaattggagatgacttgatattaaggattgtcagacttatgtcaccccattgtaagcatagatagttaaaatctatttgatttcattaaattaaaagtgtacattattcatcacaatccataatgtaactgaattcattcctatgaactgaattccaattagatttatcatattgttgttgtgaacaccagagaaaagtaggacagtcccacatctaagcaggaagataaaatatatatccgttctttatttccattttttcacttacttgttcaataaataatctatttattcaacaagcataatttctggctcagtattctttgcattagtattcactatgacattaataagaattaaatgctactttggaattttcacaagtaactgcttagtgattccagaatcacctggtagaaggggatatttaaattgcaacttaaaaatccaaatgttgttaaaagttttaataaaatttcttataaaaattacttcatatacgagttgacaaattgttcattttctccttgtagaagaacaattaaattgatgagatgtatcatctaactctcatacacgtaattatatatttgcatgacaaatacaattggcatctcatttacctcatttctgtacccttgaatatcacgtaaacatattttgtcctgatttttaaatactttgaatagtttgagaaccaaaagacctcttttgacaatttcctcttgataaagcaaatagcatcatcaatgtctccctaaaacttaaaagctaacagcctatgcttgaaggggcagaaaagtcaagttatttcttactttttagggacaaacaggttgtttatcattgtagttggagacaagatatatggaataatatataaacacatcttatcctatttatgcccgtcacctaaacatataagtgctatttttccaagtttattatcaaattacaaagtggaaatatggctcagatggtagtagaggtaaaaacaaacctaagtcatgtaagatgagtaagtctaaagatctaatgtacaacatgaagattattgttaataatattgtagtgcatactggtaatttttcaagaaagtagattttaggcactgatagtaaaaaagcaaagataaccatatgatgatgggtatgttaatttgcttcaatgtaggaatcacttttatatacgtgtgtatattatatatatatataaataaagataagtatctcaaaacatcatgctgtacaacttaaatgtatacaattaaaaataattttacaatacaactaagtttgaagtcatcctacatttaacagtatctcattaatgaaaccagcaaaattatcatgccatctttgcaagtgaaggaatactaacaatagacgttagcacatgcacagtaaaaatgggttcacagaagtgtggtcattgctctcacgttgcagtccacagaattttaagctatgttaaacatttatgaaggaacaagggaagtgcacaaatatgatttaaacctatttgttggtgtaacgtgatgcagttctatcccactcatcctataatacatttctttgacaaacaaaactatcatcgcaatcagttctttgaatattaaaattggatgtatagtcatgcatatgttgtgggattgtaatgcttacagactattaaccactgatcctaagatttgggtggaagtatttgtctctatatctaagcagctaaaatatcatggctactatctgtgcgtgtatgtgaggtaatttcagtctactgacaaaaacacaatttaatgtatgatatttattgagagcatcagcctctctcatttctaagataaatctctttttttccatgatggatatatacttgtaacaaaccatattgttctcagagaccacagctgctccctttttcccagggtaaatatgtcagtctcccggcctgaactgcccatttcttgaaggcaggagccacccatatgttactcagttttgtatttctcatggtgcccagctgagtgtctggcacatattaagtactcagttaatgatttttaatgaaaacatagcagtaagcctattttccttataattttatacataattacagagtactttcccacctagaaccttacaggattaagggtcattagaattcactattcatccatcttgaacccagtgaaattttgtcagatacaaagaaaggccataataattgtgtttctaagtggggacagtttatgtaccattagtgggctctcatatgagtgagaaataccaacttttacataccacattgcaaaatgtcactgttacatacctttagaaacaaatcaatcttaaatttttctttaataatcacagtatgctttaatctaagattatagtgccagtaatagtatatgccactcgaaacacaaatacaaatcaggcaattcattgtgtctcaaagcttttaatttaggtctaaatatacctaatagtcatctggttatcttctgaagtcaagcacaaggacaagaaccaaacttttaattatttgaggcaatgtattatattaacaattattagacacttaaggggaaagcttactataaattaaaatatttctccagtcctgacatctcttattactaccttgttataaaattattttaagattatgcctgtgacctgtgtgtgcttcttcaaagaaatctgaaatgttgcctgtgacctgtgcttgtttgtgaaatcaacattaaatgattcagctgatggcaacatacatcatctgattaatcatttaatcagagggtccataacactcaagtgtttaaaaataaattttcatgaagcccaacatgacagccatagtaagtcaaaggaaatgagtaaaaggatacttagatattatattcacaatgtcaaacctgacattttaaaacctgctttttttttattcatctagcacacaactggctagctatccttttatgaattaagtcaggattattacagaatatacacgtgtcaatccatttgaaatcaagatttaaaaaaagttgttcataatatattgatgtaatttttccaaaatggcattgcttaggaacttcattctgattttgaacaacaataaataacatcgctgaacctggatgttttaagtatccaaggcaacagacatttcaagcttatttcttgcgtgaaaactattaatcatcatgtagataagtcgtgtctcaatgggatatgataacgaagctgactgctgtattatttgtcaggcagtggcttcacagtttattcaggacttttgctctctaaaactccagaaaattacaaaaatataaaaacttcaggatccaactcttttagagcattccatgtggcatgaaagagatgctcattagttcagcaaggatttatttgagcaccagccacaagcaagacactgttgaggagctgggatagaccaagtgttctagtggctactccacactgcacgcatagtagcattacagaataacgctgattcaagtcactttctttgtacaatattcttagaacaagcagatctttcttcttcaatagaagtaggaaatataaattttctctatataacatcactgttgctttgcacttaaaatttctgcctgtgcacttttaacctgtttctactctgccaatgaaaggtatgaacttcaagaaatgaattgtatgactgataacttcttatgtgcacatgagtaaaaatatggatcaaaagatctattattctaatgtactaaacacaagagttaatattgttctgtaaaacaaaatcttataattcaagataactcatttgtcctttaactagtcttatacttagaaattattactaagggcagctacattcatatgatcaaattaacaaaacaggtatctgctttgatttactctcgatttattggttgttcagaattatgtcatttaatttccacctatttgtgaagggagagggaactttccctccctcatcaactagagggtgatggaccagataccctcaaagggcatgaaaggtgaaaaccggtgccattactccctttcagtgttcctgatcttaaaagcagagccattaatccacttctacaagctagacatccagtacccctacttgtcacatccctcttcctccaagtttctggcacagtgtgagcaaacattctttcttgaatgatgaatgagtgtctcaatgcagtcattaataagcatttcaagcaaaaagagtttgcttatttctatttaccagggtcattttgatcaaagtttaaaaaatgaaataaattatttcaaagttcataatgaacaaattaaatactttcattgaaaccatccagattttttagcatcccatagatgtgaccacaattgcagacatttattagagtattctttgaattattatagaaactcagaactttattgctaaattagacttcaacaattttctagtagagcttcctcattttatgagaaagacttttaggagatctgcgaaaggttatccagtcaggtggtgtatgagcagagaggaagactagccattttcactctcagtccaatgtttatttccacaactatgctgcaatttctaggttctatggcttcattttcatattagaaatcagtaagaaactatactacctataagggaaatatctccaaatgattaattttgtcacatcacttagatttctgctttaaatattaaaataaatagaagtatttttagatgggtggaaagcaaacccagttttgtaaaagattaagcactttcatgctccatttgcaatttatattgtatgccttaaatgcaggtgaataaaagacggtacatgtttccctgttgcttaatattctgaagcaataaaatcctctagttaaatctagttgtccataactgaatgtataaagacccaaaggaaggtaagttttgaggaagtgcttggggaagtgatatagtggctggaaaagtactactggtgtccagtctattccaaatgactgtgcaatcttggactacccacttcctctgtagatttctgtttcctcatctctacaatcagaagattgatctgaacagagggtctgtcaatggacttcccattaagctctttgatgtgcgtatgtgagtgcgcatttttctgaagctaagagggtctatagcttctattagcccgtgaaaagggtcggagacacaaaactgattaattgcctgtgtactaatttaatctgaggtccctcttaacttgtgaaatcttacgaagctataaatagaattaaaattttagatggaaaccaggaattaatataattattatccctaataagattatttgaaaagcatattttgtacaaaggggtaccaccatgaccaaccatgcattcaaacattagctgaagaacttcactagaagcccagtaaggatttgccatcattagcatccattgcaccagacactagacatgtaagtacatgtagtaaatctaaatatatcacagatatttttgttctgcctttttattatcagagttttaatgggctatcaaggtaaggctgctacttaggattacatgaagtggaaacaacccagaatagtttgccagcaaataaaacttctttctcacaattttcaagatattcatccaaaatcattttgattgtaacttttggatagctgaatagcactgttcttatactaagcatatgattataaaagacccagaaatgaaagttgttgtgcttactcacttccttccctccttaatttaataaatgtttgttaattgtctactgtaagttggaaactctcccagacacttgtgaaatatcaatgaacaaaataaatatatttcactctcatggtgcctacattctagaagggagaaataaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaaggaagggagaaaggaaggaaggaagggaaaagaaagaaaggaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttccatatttaaaatgaaagttataatatctttggtataatcttattcgtgtcccatgtttgtcaaaaaaattcagtcaaaattcttctcagaattttaaaatctacctcaaaactatatctctggttggtatgtattttaagtctctcatttcccacaaatatgtatttggcaatgaactgttatgtaatatgcagatatgccatttaataagagatgatgtcactataaagaaataagtaaaagaactttattttggaaattaggaaattaggcacaaagggatttgttactccaaggaagagaaattccaagacttacaattaacatgaaagccctcattctttctgaaatgtcactgttcctttggcattttactacattttttgtttcattaactttcttccagaaattgaaacaatcataataattataaaatttgcatggcatttatctgggttaatgcctgaaacaagcaagaccaatataaaggtagcactttttcacaaggggagggtcaggtagccgttccccacagtaagtatcttgctcctgcctccaggcctcacatgaaaatgaaccgtaatctcaccagcttataaatgtaacacaaaacgtacacagccataccttgcccaactggtcctttttgacaaagccagtggctgctgcaatgctccctgctccctccactgtcttctgggctactgctgtcacacccgtcaccactgctcctccaacatttgtcacttgctctttggtcttctcagccactggtacaaataaagagcaacaacagattaaagggtggtagaataacagtgacttaaaatcattccacttccactagccatcggcttccatacacctgtatctacacatgccatagataactgagtggtcagaagaaacaaaagccaccaagatgtccaagtgagtgtggttcaaccaaacattgaatcttggctaagatattttggctaaagtcatgcagtattaaaaagtgcttcaagtttaacgatcaggaatgtaaagccatgagtgatttggatttggtttatactatggaaagtttacagaaagcaattcttacaggtgcagttatatttgaaccagactcagcatgaatatttctttatttcaattcagtgccaatcctttgatctcactcagcaagttaatttccaccacaccttctaagcaacacaatacatacttctatttatttatttatttgagatggagtttcattcttgttgttcaggctggaatgcaatggcacaatctcagctcacagcaacctccgcctcctgagttcaagctattctcctgcctcagtctcccgagtagctgggattacaggtgcccacaaccacacctggctaattattattattattattatttgtatttttagtagaaacagggtttcatcatgttggccaggccggtctcgaactcctaacctcaggtgatccacccgccttagcctcccaaagtgctaggattataggcatgatccaccgcacccagcccctacttattatctacgtgttcagacgtggtattatcacatatgtacgaataacagcataagaaacggttgtgaaggaacttggatctttttatagaacttcaggtagtgaaacaaagggttcttaaaaagctaaatttgcagtaattttaataggagcacaggagctagacagtatgaaaatgaagaggctattgagcacccttacaatttcttttcataaaacaaaatgagatacggtcattcagtagatttattaaaataagttaacatttttgagaagacagtgtaaatagtttgaattgagtttacaagcagaagtttaatttcatgtcaaaaactttcttgttcagttaaataagccagaaacagaaaggcaaacaaccacatgatctcactcatgtggaatctaaagaaaaagaaaagttgatatcatagaagcagagaggagaacagtggaggagagtggaggatggggacactcatctaaggaaatgaaggcacattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacacccggctaatttttttatatttttagtagagacagggtttcaccgtgttagccaggatggtctcgatctcctgacctcgtgatctgcccgcctcagcctcccaaagtgctgggataacaggcgtgagccaccgcgcctggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccagaaacggtccacagtagtgttgctccctatttgtcttttaggctagaattttgtacaactacctaacaactccgtgccacttctaaggatatggctgatgtctccttaagagcaagagctatttacaattcaaagttcgatttaaatgccagcgaaaagctgtactgaaaatcttatgttttaaaacatttctgaaatgttgatcctttaaaaatagtcaattatgtgtttcaagttgtcatttttttccttttcaaggacgtgaattgaaaattttgcttgaaacgaacattttcttgttataaaatctcaaagcgagattaaaaataggttttgaattttttacagatccagccataaattttataatatctagatagccttttatatatgtataaattttaatctagttttaatgcaatacactgcacagtaaaatgtactctacacattattataattttgttgttttattattataatcataaataaaatggctacattacaaaatgacagagtgtacatgtagcaataatcgacacatttaaaaacatttctgtagaactgatttctctagtagggtctctgctgacctttaacctctatttttccccttgagggcctttcacactatctctctactcactgacattccaaatgacgggtgacaaaacaaaaggaaaagagacacactcatattagtacattttgggtctaataaatggtaactgtttttcggcaattgagttctttgaaatcagggattctgctttatttttctttatattatttcatagtagataataaataatttagaatatactaaaatgaatttagtgtctacctctaatgtctgcattaatataaataataggtttatatttgactttagctactttaaaaataaaattccaaaaaggaaatgtgataccaacttttagaatagatatagccaaatctaacctttgacattaaacaaaattataaaattaatatatggttttgaattgttatacaagtaaatatgtatatttaaatatacatatgtaaatatggatttaaagaaaataaatttgaaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttatatcatagtttatttttaaagtacctgaaaaaacatatcattcagtaagtttaattaaacacattttcatatatttctataatatgatgcattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggggaaattgtttctttaatattagaagataatattaggtactatgtaataatttcttgtttccctgcattaagacttgtagcaagaacaattaacaattagttagcacttaatatgtacccataataaacattttacatcaggcataatatgcaaattattctccctctctttaaccattgaagtgtaattatcttatttcttctcataattagacttaagcactttatattaaataaccctattcaaaaagttaattcatttatctgatgtgggagaggaatgattatgatagcagccgatttatcccaatgtgtttctcatagccatactagttatgacagcatttttggttatttcactactgccagggtggtccatgggtgcaatcgctgtaaatattgcacatgctgaaatcaccatgtccttactgcctagcaacatttcccatagttttctgtggaacactagtttcattcaaccctagtaactaatgaagaaagttttcaataatcaaaaagtttgaataaccctgattttaactatgtaatgcaaatttctttactgtaggacatctcagattccttaatacgctaaagagaaaataaagtatacaaagtctcccaacattgtacaatgttagaaacttaagattgtgagccactgtccttcagaaaacattttataaaatgtctaattgtacaaacttcagtctctctctctctctcacacacacgcacacacacacacacacacacacacacacagatatgtgtttacattttggcattctggaaaagactaaaaaaatgcagcccatctccacagtctccattagatcatcaggtgacagtaatagttgggttctttaatttttaccactgactccagaacttgccacatgcttgtctgctttctaaacctcatgggttcttcctcaactactaaatggaacaccattcatctaggttgaccgtcttcagatagtggagtctccacctgtctgttatctagttcttattataatcatgcttcacaatatcatatttataggaggtccctagaaggcatcatagtccacttacttaactacttctctgttggattgcaacagagcccattaaaggtgcacaattaacttctaacagaactagtttcaaaggagtctgttttatttttacactctgatttttaaatcaaaagtattcatttaaagaaatatttttctccactagttgtaaaaatgttgcacaagaaagttcactataaaactataagtaacacttataaaatacatattgtttgcttttgttttccagatgttttgtgtacattaattcactgaattattttatagatgaggaagctaaatcacacagaggtgaagaatcttgcaaaaaacacacagctggtaaggagtaagcaggaagttgaaccaagaagatctgactcctgtgtttttagtcatatccacaacactgtattaagattcccatatcattgtcctcatttccattttagaagtcagtgataggaacattttatttgtataggcactattgtgtttaatgctttccgattatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattgtaaacctaattgacttgttcaaattctcggtaaatttaggccaaatgaataatataatcagaaatgtaataattgcacaataatatttgtacaaatagctataccataacaatacaaagataaatacaataaacattttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgtcaatacatttttggtcagaatatttaaatgcccacttactataaattaaacatagcttatcaattcaaagccctcattattcttggcaagtatattttttatttataatcaatatttacctatttaaaaatactttataaagaattcagtttcaataagactgatatgttcttagaatgctcagtgattgttttacaatttcataggaatcttgaatactgggccacactaatcactagatactttaaatatcatctttggatataagcacaatggagcttacctgttgccacaccatgcaccactccctccttggttttggagcctacaaaaacaaattcaagacataagtctcaagctagccttaaattgctgattagctagttttcaatacaactaatttaaaaatctcaatcttcagaagtatatatattattatatcttcagggaaagaaaaaaatatatatatatatcctaaaactagaagaaggaactccagtaaccaccacaataaatagaagaaagcccagctaacaggaggtcctctccaattacgattttagcacaaaataatgactttatcccctttgttcccacatcacatgtcaacttacagaggagaaaaaagaatgagataacaccggggcccagtgagaagataattttgaattcagaactgtagaagctttaaaagtacagcactagagacagatcagtcaacccatgaaacaaaagggaagaaggatggagagaaggctttaacatgtgctgaacacccattatgtaaaaaaaacattttaggctgggcgcagtggctcatgcctgtaatcccagcaatttgggaggccgaggtgggcagatcacgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaaaaaacaaacagacaaacaaacaaacaaacaaaaaacacattttacatatcatcttatttaatcttcataacagccatttaatatagttatattatgcccattttaaatagctgatgaaattaaaaatccgagttaagtaatttatgtaacattacacatgtaataataggctataagcacattcaaactagggtctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatgttttacagaattatcatactcctttttaagtttggatcagtttacaaaatgttatcatttgcactttaatgtcatgatatactgacagtgtatttaacataaggtgtatttttcagcaacacttcctctgggacaccttcactctttatcacaacctctttccccattatacggataccttcacctcactacgttcctctgactgcatatttagagtctcctgaattgcagcagtgacaacatcctcagggtagctacttcctgtatacatcaacttatgtttgattcaaattttacttccagaatgtttcacttcctttgtttgctactctttcatctttgctggccagtttcctcttttgattgcgcattttcgtgaaacatcacatgggctcaccactgggagacaatgtggccacacaagtccgggcattgctgtctgtatgaactgcataacagatgtgaagcaaccaatctccaaaaagctttgaaagaagtgctgtggttttgtcactgattataatgggtttctgttatttatgtaatgatttgaaggctgaagagttagcagcaaagtttgtactttatgcaatgactttcggtatactgtggtaacagaaatttgaattgtgttgttagtggctggtgttatttaactaaccatagtacctggaatttgtttgtgctggaactatgcagagtgagaacagctgatatttaagagaatatgtttcaatctctatctctcatcctcaccacctgcaccccatgttgtcttaaaaatgactagtagtaagaaatgtctaacagctggaatgcgatctttgttctttgccttagcagtacctaagaatttgacctttggttaaattatgaaacatattctaaatcaaagacaatgagatagaagtagagagtagaattatgattattagaggctgacaacggtaagagggaggggaggatatggagaggttggttaaagaatatgaaattggagccaaatatgaggaatgagttctagcattctgtagtactgtagggtgatatacttaacaatagtttattgcatatgttcaaaaatctagaagagagaatttttaatttttactgttcccaccacaaaggaatgataaatgtttcaggtaatggatatgttaattaccctaatttgattatcacacattgtatacatgtatggaaatataattctggatcccacaattatatacaattattacatattcactaaaaataaaagaaaaattaaaaatagagtagcatatgacccagcaatccctcttctgggtgtagatccacaagaaaagatttcagcatatctgtttccaagggccccaacacagtggctcttgcttggaatcccagtgctttgggaggctgaggcaggaagatcacttataactatataaggaattttaaaaacactaaaactaatatttatttatttagcaaaccagaatttaaaacattagaaattaaagtgttttatttctttgtaaaaaacttatcaagagtaatgtaaatagtgtttgtcttcttctcattgtataacttcctatacggagtggacatgttttttatattttacagaattgtcatactctattctaaatttgaattaggagtttgagaccagtctgggcaacagagtgagatgctatatctacaaaaaatattaaaaattagccaggcatggtaatgtatgcctgtagtctcagctacttgggaggccaaggcaggaggatctcttgagcccagaagtttgaggttacagtgagctatgataacaccactccattgcagcctgggtgacagcaagaccctgtctccaaaaaagaaaaaaagaaaaacataatagccacaactaaagtgtctactgatagataggtagataaaaagattgtggtacatagatacaatggaatatcagtcagccctaaaaaaacaagatcctaccatttacaacatggatgaacccagacaaaattatgctaagtgaaataagccaaacacagaaagaaaaatattacattatctcacatatatgtggaagcttgaaacaaaattcaaatatacagagactacgtaaaaaacagggttaataggggtggaaaagtaggtagaaaatagggacatataggccataggatccaagcaagtagcagatgtgtaagatgaaaaagtgtacagatctaatgtatgaggactgtaggtgataaaattgtactatatttgagattcatgataaataagtggattttagctgcccttgccacaaaaacaacaaaaaaggtaactatgagagattatgaatatattaatttgcttcaatatagtaattttttagtgtctaatgtatctgatagcatcatgttgcataccctaaatatacacaattaaatttatttttaaaaaagaatgccactaggccgggtgcaatggctcacgcctgtaatcccagcattttgggaggccgaggtcggggatgatgagatcaggagttcgagaccatcctggctaacatggtgaaaccccatctctactaaaaatacaaaaattagccgggcatggtggtgcatgcctgtaatttcagctactcaggaggctgagtcaggagaataacttgaacccaggaggcggaggttgcagtgagccgagatcacaccactgcacttcagcctggagtgaaatgacagattgagaccctatctcagaaaaaaagaaaaaaaaaagaatgccactaaaccacaccattagaacttataattaattattttttataaatatcttatgcaacatattttatatttttgtagtgcaaccccaaagagataggtatataacttaaaaaaacgagataaatgagagtcctcataaggttaccatgtatcaaaccaatcagttgttctttgaggtcataattatttactaataatctgtaattgatggttagcctttaatttatgagtaatctgtaattgataacgtacacctacaaaataggtgccaagtggttatgtgactagcaaggtataaatgctgtagggacaccagagctgatggcttccctgagcggaggtgtcccacacacaccctatcttgtcttcccaacctcaaaagagcacagagtggagaagaaggtcagaagtaatacctgagagttttgagaactcagttatccctgttgtgcatgttatgttgactttgtcagcttagtgaggtgaagcacattttgacttgagaatttgctatcaatttcactgatggccactgctgcttattgagcagagtggcattggaagacactcaaagatcatcattttcttgtatttattgcatttatattactgagcattatataaagataattaaatctttctgcttttggatttagatctaattaatttctgagtcatttgaagaaatttttgtctattaaattgaagtatgttgattgaaaattggtgtacgcagataacaaaaatggagggaacaaaacccataaaaataacactgatcattaaggtagttcttcaatgagttaaaaagtagttgttaaaagtatattcttataaaggaatgagattacttttcttatgaggcttctaccaaacatcttcagccataagtgaaattataaaatggtctttggtcgcctccaatctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcccacaaaaactgcaaggtagttgcagttttctaaatcatattttttactaatcagggaagtgatgctcagagatgttaagtacgcttccccaagaccctaaaggtgataagtgatgtagtctcaactaaaactttggtttgtgtgattagtgcatgttctttccactctatcagtagtcagcaagctacaacatacaagacaattccagcccaccacctgttttgataaatgaagttttattgggacacagccacactagttattgtttatgactaccttcacacttcaacagcagaattgagacatagatttttttttcttttttttagacagggtatcactctgccacccaggctggagtgcagtggctcgatctcagctcactgcaacctctgcagtgagctgtatggctcaagccatcctcctacctcagcctcctgggtagctggcaatacacatgcatgctaccatacccggctaatttttgcgttgtttgtagacacagggtttcaccatgtggcccaggctggtctcaaacccctgggctcaagtgatccaccagcctcgggctctcaaagtgctgggattaaagacctgagccacggcacctggccaagacatagatctcatggcttaaaatacgtgctatctgattccttacccaaaattttgccaatccctggactatactattgtgtcttcacatggtcattttttatcttaaattctgtgtgtaagttcaactctcaattagaactcagaatgtaaccaataaaaaatttatagaatgtgctatgtgttaaatgccatgagagacattgaaaatgatttcaatgaacagttaaaaggtaactaagtcaaagaaacttgtgcttgcagaacttggaaatctgaggacaaacggaaagatattgataaactgcatgtcactgattcagtattccaaattccatctaaaaaggtataattcacacttcataaaatatttaaaattaactcatcaattttttcctcttgtaacaccctatttcaatgactttctgaaaatatgttttaaggtagaaaaaaagtaatttaattgaagatttgtgggaagattaagtcaacataagaaaagtctaaataatgaggcagtggcacatgcctataatcctggctactcaggaggctgaggtgggggcatgacttgagcccaggaattcaaggatgcagtgagctatgatagcatcactgcagtccagcctgggcgacagagcaaggccctgactctaaaaactgaaaataaaaaactgaaaaaaaaatgtgttgtgaactttgatgagatgcattcatataaatcatcccaagtataaaatttcccccactgatctatgttgaagagatagtgtagctttctttcactttgcagacatagacggagcacatgtttcagctaggcaactcaatgtggtcatcctccacctgactgttcatcctgtgactcttactgctatagttgccaccagagaatgtgaaaaagctcagaggagaaagaagagaggaagaatgggcaatgtgtctgtgttgagtgtgtgtgtctatgcctgtggatgagagtgtgtgtctattcttttccaaggaattcaaagtggtttgtaaaataacactcaattgaatacagttcaagttacagaaaagagagtcagagtttgggtgtataccccaaggtggaactttaggaacaagtaggtaataagcatcaatttctttattcttttagtatgtgtgtcatttgatggatgaactatacaaatgtttctgagagattagtagcagccctcaagcacttttctctgtcctcagtgttcacagagaccaaatgatcacatgaagtaactctatcaaagactaatctgttctttccattttagggccacaaataggtctctttatacacatcacaggggcatatcaaagtcatattttaaaaatcagaatggattaaaattgacaaacatttttcatgatggtaaaagaaatcacagatccatcaatgattttgattcttaagaatattcttgattattttttaaaagactatgagtttttaaaactgttctctgaaatagaattatgtaggtacagaaacattcatttttaaaaagtcataaatattagggcaaaattaaaaatctggaaaagcaaacagtcgcattttttactattagctcaaatacacacgttcacattcacctacctacacatacctctgactcagtccacctttttgacaagcaatgatgcaaaaatgaatcaagagagagaactaccagcatttagagtattgattatcctaacccatcactcatgaacaagcaccaaactgacatttggggtttacctacctacatagagaacaccctcttttgtctttcctgctgcttctgccacaccctgtttggttttctcagcagcagccacaactccctccttggcctttgaaagtcctttcatgaatacatccatggctaatgaattcctttacaccacactggaaaacataaaatacactttgaatgagaactttcggggaaaaataaacaaaaaacactgaaaaatcatgagaaaccctccaaagtgtgagactcttttaagtgtacactcatttaaccattggacaaagcagacatttttagctctggcattaaaaatttagcatctcccatccatcttggctagtaaaagtctagccacctaaccacggattaggatgaatcctctgagttgttattactgcatttcagaagtggagttgcatgaaaagattaaccccttttttaaattcccggggtctaaagggtaacagtatgagttagaagcatggaagctggaggcttagggtcaggggtatccttaacatgaatcccagaagaaggctaacaggttgatggtggaaaggcgtaggcaacagaactaactgctcactcggggtgtggttcaaactcaggcaaacagcaggcccaagtgtgatggttctaatccatccaacatccacccccgccctcagctatctaccctgagcaggcgccgctcacactcgcgggccgtctccaaccccgcgccagccacccgagggggcgttctcagcctccaccctagcggaccccgcgccagcacttgttaacccgttaccacctgttgacttggcctccttgcacttccatttcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcct

SEQ ID NO: 2024 - DNA, 112878 bp, Homo sapiens
  source 1..112878: mol_type = genomic DNA
tattttcatatatgtatatatttattatgtcacaaatagctacatactggataagccagaaagatgaggaaacatgtttgcatctcacactagtgcagagattctgaaaaagaccccacttggaataccaaaccacacattagattgttctgttcccaattgtgtgccaaagtgcactctgaactgttttggtaaagccgaccgtggagtcatatgaggctgaataacttgggagaatgtaagtctgcaaaataaacctaggactggattgatcctcaggccacttggcaggtgaatgtctcgggagtgaatatgagacaagcttcctgaaaaggcttatatgacttaaagaactttttgtttaagtgtttggtcccaaataaactattaagatatataaagtaattcactgctcaaaaattaccgtcagataaatattaagggaagaaacactttaaaggagaatttgtatccacataaatccttaaattcatggtcacaactttcctaatctcaaattgttctaggtcactgctatcagtctagttctgtcctctatttcttaatttaataccaatacttttaaatttttaaaatatgctgctttaggtagatttaaaatatatcctaaccgccactttctaaccttcctgaaatatactgttcaataacaaatcctttccttgcttaaacataacttaaataaaacaagaaacttaccatttctctctagtgtaagatgacacatgcagcttagcactctgtagtagtctctcttcaattaggtaaaaaaggaagtttctatggtaaccatccttatagtcactcattcctccttccttcctcaccagcgcccaatatatatcacattactcatgaatacatataaactgctagcatgtctagaatattctgtcttgaaattatactttctactagtgacttttagaaatgactatgccccagaataattaaaaagagaaaccaaataatttttaaattaatttatacagagtttttcaccatcaagtttattttcagcacccatggggagttaatagatcttccctgaaagagaaaaacctttcctaaggaaaaatcctagaattcatatatttggcaacatttaaaggaggccatgaaatttttatcagtctagagaattgatctcctttaaggtgactctggtagttccaacgatgtttaaaggcatttcctgtaaaaaaaaaaaaaaaaagagagcgagagaaaaagagagagagagagagagaatttctgatgattaaaaaaaaaaagtgaggaatgctgagttaaacaaagttaaccacattctctcagagccttgaatgtgctaatatgtgctaatgtgtcttatggctctctaaggagggtgtagtcaaaatcatcttctacactgcttagttcccgggaacccactttttttttttttttattcatggtcgaatattatttattgtcagaaaggtacagcattcacaccaatatcagacaaaatagattttaactaaaaaattatttcgagacaaaaataacaatatatgttaataaaaggctcaattaaaaatgtataacaattataaacacatacacatcaaacaacagttccccaaaatacgtaaagcaaacattgacaggattgaagggagaaatagaccactctacaatagtagttggggtcttcaacaccccactttcaataattaatcacagccacttaaggaaccagtgcataccaaaacacacttctggcagtgttgcttcagggaattccgagtgtagggttaatgttccattttctctacctcttctaaaattcctccttcttcaaatggctattaataactttatatttttgtcctttgtgtcagttcttaattcatgttgcttataagcatgatttttattattaaagtgagatgggataaaaataaaatatttttgcaatgagataacgttttattttaattctcaccatttatatacaaacacaagtgaataaaacacatcgcaaaatggtaaaatttcatatttagtatttataggtgcatagtttcatgctcacatatttttaagtattatatatattaacaaatttcacaatacgtcattattcttagacagtatcattaaaagacacctaaaaatcttataatatatgatagcaaatcactaacaacttctgaacaacagcaacaaaaaaatagtgaggatttagaaataagtggtagtcacttaggtgtttttaatttgttttaacatcgtagattgaagccacaaaatccacagcacacaaagaccctgctaccatgtattcacttcagtgaaagggaagcaccgaaatgctgagtgggggcaggtacagatacttcaatcactgctgatggaagacttcgagatacactgtaaaaactttgagaaatgtcatgactgggcacattggaactgagcacttgtacaggatggaacatctgtcagcagatctcaagaaactgggagcaaagatatttcttaggcttcaggttcgtagtcttgatacccttcctaatattagaaaaatcaaaaagacagcacacactgttagtataagtttcaattacgcatcagcactgacagccaatgagataggaaatggctccccacttacactaaaatttacaatcaatgtttttgcaaatattctgcagcaaatattatcttatttttaatagttgtgtctttcttgtctgatataaaagtgaattacagtagtagtcagagttaaaatatctaggttctgatccggatgcaccatttaatgatcatatacctagtttggtaggacaaataagttggactgtctggttctcagtttcttcacctgtaaaatgtgagaacaaaatcaagctgtctataaagccttttccagactaagatgctctaattctcagaaggaaattaagatgtttgaaggcaagatacattttccctactttcactctcccagttgaaaatttcgtcttcatctatggcttcaattattacttgtatttcaaacctcaagctctccatacagtatctggatagcatccacaacacaaatattaatggatttaattaaagggatcagattattcctcctaaagagcaactctaataatatcaggattctgcttaaaaacaaacaaataagcataacttcaataactcaagttgttttctgaatagaatacaagctgaaatgacaagattatcctaatactctataacttgtctttgacccatagctgcaaattcaatctatcaccattttccttgttcctaagcttgagtcataattattcactgttctcagacatatccatttgcatgctcagacatacatgcctttgcttctgatattcccttgtgccagaatgtcctctgtttgttttgacctactatatctcttaccttttcccacccagatcaacattacctcctcaataaaacttctcctgattgattgaaacagatctttaaaatgttttactttttagtatgtcttatatatttttgctcctgtgatgcctggtacatcgaagacaatcaattatgtttgttaaaggaatcataatgaagaaatgaatgaatgaatttctattttttttcatcaaacctaccagactgtaaactccttatgtcctggtaatgtcaattactctatagttttccattgtgtttagtactgtgtcttgcataaaagaccccaaaatattggaaattcttattaggcaaacaaacaatttaatctcaatttctataagttgaattattatcaatatgcctttcgtgtgtctgtgtgagacagtcttgctctgttaccaagattggagtgcaggggtgccatctcagctcactgcaacctctgcctcctgggttcaagtgactctcatgcctcagcctcccaagtagctggaaccataggcgtgtaccaccatgcccggctaatttttgtatttttagtagagatggggtttcaccatgttggccagactggtctccaactcctggcctcaagtaacctggccactttggctcacaaagtgcgggattacaggtgtgaactgctgtgcccatcctcgacatgccttttaataatgccgtgaggaataatacataaccaaactacaacatacttgaactcaatttttaatggagccattatatagtttcttttcttgtgatatcttcatttggttttgattatcagggtaatattggtctcacaaaattagttgggaaatgtctcctcttctgttttgtaagagatattaattggtgttaactaattagtattaattcctctttaaatgtttggtagaatttaccagtgatgccatctcggcctgggattttctttgcaggtaggtttttttttttattactaatttaatctattcgctgtgttacaaatctattcagatttactgtttcttcttgggccagttttattcatctaacagtattttctaatttcccttttgatacattttctattaaagatactttcattttcaatcaaaataaaattaacaatcatattgtgttgtttaaaacattatactggaatatatcaattgtcgcaaatcatgcatttatctttttattctataacttgtgtgggtaacttttattttactatgcgtcatcccattggacatgtatggcaaaaaataataaccttcctttggcattccattgatttccctaactttccatttagaaatttattttagaatgtaaagtttctaaaaatatattctctaatgcaggggttagtaaacttttcctgtaaagggtcaagtagtaagtatattaagctatgtggactacatatgatttcttttacatcctttcttcctcttcttcatcttcctcctcctctttttttttaaggaccctttaaaaatgtaaaaactattcttaacttgcaagttgtccacgtaatgagcatgtagagagcaaatgattctcactaagcactaatgaaagagaaatgtgacaatgacaggtttttggtactgtcttgttagaaagattcagcttggactcctacctcagaaggcatttcataagcctcattgtcaggatccacaggcatatcttccagaattccttcctgtggggctccttcttcattctaatatttaaagtaagaagcacaaaaagaacatgatgaagtagcatttttcacttttaaaaatcagaaccatgttttggaaaaatcttacatatagggatgttggccacggatcttgaaaatggcacaccttaatattactactggcattctaaactccacaatgcctccggggaaacattgcggcaacatgggttatcaaccctcaaagtatgtaaactttttgctcaagtaatttactatttaggaaataatccacagctatagtccaaagatatttttcacaagatcaatgacagcaggaaacaaaatttttagaattgttaactaaatgttcaatgaataatgaagagttaaaaaattattgctgggtgcagtggttcactcctgtgatttcagcactttgggaggctgaggcaggtggatcatttgagtccaggagttcaagaccagcctgggctgttacaatgaaaccccatctctactaaaaatacaaataaatagctgggcatggtggcacatgcctacagtcccagccacttgggaggctgaggcaggaggatcacttgagcctgggaggtagaggctacagtgagccatgtgcatgccactgcattctagcctgggtgacagagggagaccttgtcttaaaaaaaattatcattcaactactcagtagattatgataaagacctgtattactattacctgagaattatgtaacaactacctatttatggtataatatttagcaggctataaagtgttgtctatattatagatacaacctacacagaattcagacgcaaaggtaaaaagtttggaagaaaacacaataaaatatgaaagttattttgttggatagtatgtatgttattttgactttttttctaagtgtttaacttttataaccacttataatgtaaaagcatacatatttaacacattaattttaaatgacaatgaagaaacaaattcttttctgaaatttgaagactgagactatacatattgaaggaaaataatcaaatacatggtcagaaaatttttctaggtatctcttcctagacaaagaatactacaaaactcagcctgaaatggtcatggctttgttggtattcttcactaaataccttttgttgctttgcatttatttcagcaaagtaattataagaagataaaggtaagtgaaaattcaaagaacagagaggcaatgtgagcctaaagggacttggagaaagagatcaaataatccctcagccaacgcggctgattttcaacaacatgtctgatgtaaaaaagcttccccatgtcttcacatggaagtgactgacagggacgcagaagtataagaaaatggctaacagtaagaaaaggtcacactaaagatcatgcttatggtaggtgggcagagaagcttacagatcattctgcccttgccaatgccctttttataaactaaaaaaaatccaaataatatataaattaaataaaatatgaaccaccccaaactacctcactttaaaatgtggagtaaacatactgttttcgtagtgtttcacttcttggtagatacgcctctgctgcaggatggctaggcacaaggccttccatgtcacaggacttgagctcaagtcctagcttctctagatgacagagcttttgtgatgctgagaagtttcctatgctttttctgagtgtcaattagtcttagtgatcaaacgggacagcaaaaccttctttacaacagggagaaggaaacgacatcattaactttctcattaatatttagattactgttaggatatccaagtataagggaaataaggcaaatttttttccatgattttgaaactgacagagatttgattttctaatataatttgttagaaaattttgatatggaccagacaagtaaatatggcagacctaccctgtttgttgtttgatgatcaaaaaggagttgttatgacggaactaagactgatggatattactggatttgtttatatgttatttggctgaactttgaaggatgtacacagatgtgtaggttaggtgagtgtgtgtgtctgcatggttccagcctgggtgagtgggtgtgtacaagagcaccctgcagtaatggaacagcgtcctgtccggggtgggttcccatattgctccctgagctgccaggataggctccaaccacctgcggcctccaccgaaataattaggtaagttatttgacttgtttgtattaatctttcttaaacgtatatatagctcacattaatttcaatgtttaatgtcagaagtgatttatctttatttaggagtttgatggtgtttttgtgtccagaaatttgccataggacttaattcttgcttatatcaattagccaatggtaaaactggttttgttatatgttgttttgcttcaagtcacagtttccagaaactattgatgaagttaagtgaggatttactgtattatgtgccctctgatggaagtacatacacatcaccatcttaaactaagactgtactagtttaagtgggctattgttcactgatccaataacttcatcaagtgggaacaagctacactagggatgacagcacaatcctattctagagtccaaatcgacaatagggtttacgacctcgatgttggatcaggtcatcctaatggtgtaactgctattaaaggttcgtttgttcgacaattgaagtcctacatgatcggtgaggtcaggagatctatagcatcctggccaacatggtgaaaccccatctctactaaaatacaaaaagttagccgggcgtggtggttctcctatagtcccagctactcgggagactgagccaggggaatcacttgaacccgggaggtggagattgcagtgagcccagatcacaccattgcactccagcctggtgacggagtgagactccgtctcaaaataaataaataaatatataaatagaaaaagaaaacaaaaaaagaaaagccctacgtgatccgaatttgaatttgattaacatttaactatcactgacaacttacagcaaatataaggtggtgaaaaacatgttcattgcttacaacagtggctacaatcagcaaattttgcactgtgagaaactacacaagacaaagaatacgtctaatttcaataagtaaattgcaactaaaaagaagttagtgggaacctgccgcttaaagtagaagtgagagagcattagccaattgcaacctaagaactttatttcattctcattgggaaccctacataagcaaatggaaaacacatatgaggtagttggggaaatttgaacactgacttgatatttaagaattattgtttatttctttaggtgtgatgatatattgcagttttacttcaaaaagttcttaacttttacaaattaattaaatgtttacagatcaaataagatatctatctaggtttgggtgggggaaatgggtgggatatagaagaaacatgagtttaatatttcatcagttttaaaaagtatatacagtagtctccttttatccgtggttttgttttccatggtttcagttgcccaccaccaattgcaaccccaaaatactaagatatttagagacagagagagagggaaagagaaagcgagaccatacccacataacttttattacagtatattattataattgttctcttttgttattagttattgttgttaatctcttactgtgcctagtttataaattaaactttttcataggtacataagcattggaaaaaacagtatatgtagggtttgctactatccgcaatttcaggtgtcctagtgggggtttcagaatgtatccctgtagataaaggaagactgctgtatgctcatttcaatagttagttctctaactatgtttttctgaatatgtgatctaaatttgttgactctatcacattcgtagattttaagcatactaaaatatttggcagctattccaaggagaatataacaacaaacacttcatatgaccatcagacacaattttatccctatacctgtatatttactgtttcataaacctatttctaaaaacattgttatctataaagaaatattaaatttcaactccaatttacaactgtgcctaatatagtttggctgtaacaaaaaaagaacattaaaatttgcattttatgagtattcatgacttgttttcaaaatataatcatacttgaaggtgtgaagtgcaccttctatttatttttaccacaaacaagaaaaaaaactaccaatataacaaatgttaaacacttttgaaaaaatcaattttttctcaaattttcattatgatattatattaacccagaatatgttagggcaataaaataaatgagaaaaacgtctggattttggtatatgcctgtatgcttaataagagaacctacagggtaggatatagagacatagtaagaaaataccttttattctctctctactaggccctatccctggaatagctgtagacttttttttttcaaatgggattgttttacgaacagtgaaatagactcagttcagtatcttatatctgcatttgacacacagaaagaaaaatggttatcaaaaaattacaatggaatgaccctcattgctaataaggaaagacttaaaagctatattaggaaacagaaatggctgagactgacctctttctccctaaaaagcttattcaagttctttttaaataaacctgtagggttgaatagctgatataactgattatcatttcgtactcgtcccagctgaagtgctctataaaacagatcatgagacgaagcttccttcactgctaatagcttattgggaagtacaattccagggaagtgaaagtgaaggaaaagggaagtgatacaaggagaagtaggaaaaaatttcagctactgtctttaggaatacaactacagaatttacataatctttttaaatttcctgttttgaaccatattgtatttagatacctagtaatactttctgtaaggaaattatctttattcaattctatgacttataactttaattttaaatatatttaaaatgacacataataaaggcaaaaattgctttccaaaccacactcttctagaatcatctagggcccttgttaaaaatgcaggtttgtagggccttgtgagtgtcttgttaagtatgttccttggaaaccactgcccgacatcaccaattgtttgtaaaccctgtggtataatttaatatagagtataccaatgtacttgctgtcagtgtgaataattttttttaaaaaagatatgctcattttgaagtccatcaaatgttggcaaatgttgagggttatctgaagacactgggaagtaatccatggtgatcgttaaaatagcaaggtttcatcaattatctggtatctatgctttgtcaaagttagaaatgtagagatacatttctaaattaaaacttttatgtgggaagaaaaattgaaattcaaggctggttggtctttggtatacccaaagaacaaagaggaggttggaggtgttctgaaaaagagaaatgatacacgctgctctttgagaaagttcattggcactagaaaggttctggggagctagtaagcttcaattggtgagtgacagtggtgggcaaaattagtcctagagctgcagcaagttttttcagcagttacagaaaaaattggtcccaggttacaacaggcagcctcagcatgcggacttgtagaaaattacacttttggagcaatgtgatgtttcttgaatgcttttcctcccaggcttcttgattgttttagttgggtataacaagaatgacccaatttgtgtgatcaactttcacagccttaaacattcaaagcagcagaagcgcactttctcttttgcccactgcttttacacttgaagatattttgggtagaaccattgttttgctgcattattgaacaatgtcacttagcctcaaataatggaattaataccttcactcaacaactcacaccaggaggatgaaggagagagatagtagccaaaaagataaaagaagaaactaaaaaagaactttgacttaagaggaaaaaaaggttcaacttaagcacacacccgtgttccaaaatgaaatcaagcccagaactcgtatttaaataaaaatagcatagacgtttcaaaaatgtgaatattctctacttctctacctcagacaggggagtgtgtacatagtgtagatagtatatttcactaagagaattaccatgtattttattgatgcacttaaaaatgaaggcgatagacatgaataccttgttaaaaagcaaggtaaagatatatttcatatgttcaattttctattatcaattcctagtctgctcataatgccattttggggtggggagcaaagggcatctgattcaaaatcaaactaatctcaatttttgataaaatctaaggaattttatttttaaaacattgaattaaagcaaactttggatactctgatttctcttgaggtcataaatcctctgcctttttaagagatctatgtggagaggaacaactctgggtcttaaacgaattattgaggtcttgttttggaaaggctagatattttgttaaaaaatataagatttcaaaaaacctaaaactttggacaatgttatttaatcatcaaaagcaaaacaatatgcatatttcagaaataacactatattttcagtcttactattatgcataagaaagaacaatataaaaataatgtaatgattacatttattgtttacatactctgaggagtatttaattgcatcctagtaagtatattctgtcacatgagaagccatagaaattggcatgttctgctgtatccaatgcccaaaggataataaagcatgataaaattacacttaacgaacccaacctccttttccaattatatatggttaagttaaaattcaaactttaatttttgggaaagtatagttatggcttagatctaaggtagaaataaaatgaccaaaggacttggtgcatttaacattctataactttagaaatgcatcaaagtggcaagcccagcattaagagctatttgtcactaagggcctgtggttgaagtctgttggatccatctgttctttctgaggcaatatgcagacgaaaggtaaggggagttgcaacataatttgtaatatttgatacattataatacatgataaattataatatattagaaatataatttatagcattacatctagtaagatagatgtaaaagggaacaggtaagtgaaagggcaaggcataagtcttgtatagagtgacaggtctggtacagtcctactaccaaatctataactatagtattttgaatattttgcactatttcaatgtagcagtattttaggtttggttggcctgactttacaacaagataaaaaattccaagttttaacaatgtagtgacctactgtgttttagatgttgaaatctataattttctatcaacattttctactaacctgtaaaagacatgccttagaatgtgggaacacacacaaacacatacatactcacagacacatacacacgaagtacagtagaccactgatgatctctggtgccacttcctgagatcattttgaatgttctaattaaaaagtgcaaagtataattttttgtcataaattatacatgctatgctattatatatgctaagccaaacctagcaacaaggctgagtgaagatgtggctcctgggtcatatgctaggctttctttcggcaaatggacttgctctccctcagttatgttacatacctactcagatcaggtctcagcaaatgtacaaattactatgtcatcagccatctggatcacttgggaatagtcacattggtgaacgctgtaagtcatatcttaaatacattatacataatccatacctacagattgagaatgcaaatctattttaattaaatgatacctttagagaacccagtcttacacataaataacatatatttagaagccatttatgctctactttgtttatcttttgtttagaggcagggtcttgccctattgcccaggctgtaatgcagtgatacaatcatagctcactgtagtctccaactcctgggcccaagtgatcctccagcctcagcctcccaaatagctgggactataggcttacaccaccatgctcggctatttaaattttttttttttatagagatgaagtttcattatgttgcccaggctggtctcaaactcctggactcaagtgatcctcctgcgtcagcctccgaaagtgctgggattacaggcatgagccactgcacctgagccgtgctctactttggataatctgttactatcttactgattttcttgtcttttgcccttctagctgtttctttagtcttggcaatcaccttagagagagagaaaaagagaaaagatgaaataaaaacaatttatttcagtttttaaaggtttggcagtggaggagagagtaaagctaatatattaaatatatttggggttattttggggagctatttactagttttatctctgaattcaggtttaaatacattcaaccataaattaaaaaataattggtggataaatcaggaattggtgcaaaatcatttttaagaagaaaatgtcattatatagcaaagaggtagtatgctgctttaaatccttattttccttggcaagcctaacaagcagggcagtgcctgctgtatttatggtagtgccatataattagctgactcacctaataagacttcacagcgcagcaacaactgccagctttttttgtcctgttacttggatagactcggttgaatatactaatgcacaaagggaaatctgggaataaactatttttacttttcatgtctaagggctgatcctcctcttctagaaataaaatttattatgtatgttaaactatattcaaatttgtttactattttaagctttcatggattagaatcttgaaggtcagccccttgggtagtgactgaataagacattaacgatgtgaagatgggtcaagctgagaaaggtttgctcttgtgctgagctcagaatcaataagtcatttcatgtttgcaaatacaatgatatttggaggcaggtctttttttttttttttttttttttttttttttgagacagagtctcgctctgtcgcccaggctggagtgcagtggcgcgatctcagctcactgcaagctctgcctcacgggatcacgccattctcctgcttcagcctcccgagtagctgggactacaggcgctcaccaccacgcctggctaatttttttgtaattttagtagagacagggtttcactgtgttagccaggatggtctcgatctcctgacctcgtgatccacctaccttggcctcccaaagtgctgggattacaggcgtgagccactgcgcccggccagaggcaggtcttaaaactagcaactgggtgagaaatcagtggggagggtaggctttgacaaagtaagagataaagagtctgctttcatattttagaaaaacccagggaatgctgaaaagcccataggaaagaagaaatatgctgtcaagatgttagtgagccaaggcccaggagtttgctctcaaaaacagatgagaaactggacttaaaatctgactgggagaaagtactttaggcaaaacaaactactcatatacaaaaggatgggctctgaagcagagagtgaaggcaatagcttcaagatcggtggatttaaaacctagaagtatcttctctaaaagataaaagattaagaaaggctttaagatagctagagcaggaataaagtagtcaagtgaatgtgataccacaaggttccagaagtttccatactaatagaaacagatactaagtgaagtttgaggggccctcacaatctggatagaaaactcttcaagtagatctcaaccttcaggctggaatatctttgcttagctatcccagccagaggaccatagtggttgatttcaaaaggagttgcaattattctatcttgtaaattctctcattgttaagttttgtcacagtttgttgttgctactttctttcagttacctagaaaatgttttctctgaaaacctctatccatgcctcaacagatcggagataaaaaaggaatcatcttacaagattatcaagaaagataatgggctaggtgtatccttaaaaggtcattcaaatgaaatattaaaattcttacttttctgtgttattcggacatggaataacaataacagttaatgtttatttggtgcttactctgtatttggtaccatttcaagagttttatatgcattatttgatcttaaaaaacaactctttgaggaagttactactgtctccattttatcagtgaatgaacagagataggaagtctggctccaaagcccacactcttaactattatgcaatattagttgtcaaatgtcttgaaaaaaaaatctgtgtaattactaaaatattacgctgggctacttattaaggtaaaattacgtttcaaaaaaattaatcctttccaaatgcaatgttaactattcatgatgaaatatcagaactatctctaataccaatatttttattggaataaaataggaggttaaaggaaatgtttatatatataaatgtgtgtatatatatgtatatacatatatatatactatgcacacacacacatacatatctatgtgtatatatatgattttttgcaagggcaaaaaccagattttttttaaacacataatcattaaatctgcaaatatcaagtttatcaattttttgttacaggaaaaaatagtttattataaattcaatgcatagcattttctggtttagacctttccattattgttctgacagaacaaagactatgaggttgtcagaaataaattgttcattttgtttcctaaatatgtggcaaagacattgtatgttttttgtttgtttgcttgtttgtttgttttagaatagtttgaaatgtcttcaaaccttttgaccaaccaagaaagcttttgcctgggcacaggctttatctttcttagcattacactagagatactaatccctcccaacaatttcattatgattatcgcaataaaatataacgatccattaagtccatggggcagatgtttatttatttataaccatgccttattccacagagaatttaaagaggaataaaagattatttcctcattgcatcaaatgaatatcttttattttgtctaatgttgtatttctttttctttaattggcactaaatgtttatttgcattcttttaattacttttaaggcatccattatttctggattacattactgaactctcaataaatcaatacatagttctgtatataattttttcaacattttttccttctttaatttggttcatttgtatctccctttgctgtttattgagtagaaattctgatttttgtagcaaagggagaacaaacaaacaacacacagaatattctgtatttaatgctgcaattgtctctatggttgcaatgtgtaggtggggtgcattcaagtgggcttgtggtatttgtgtgtgtgtgtgtgtgtatgtgtgtgtgtgtgttggaagaatatatattgaggatgattcctaattttatcactttgttgaggaactgaaattgtggctacacattcactctaaatattttgtctcacagtcccctcccttcaacaattatatacagtacactatttgttggaagctcaggagaaaaagggcatttaagagcatgagatttggtggcagactgacctaatagtagatggtaccagtgagatcttgagcaacgtaaatgtttcaactgaaaaacggtaacaataaaacatttttcagagtgatgttgtactaaatgaaatgatatacataaagtagcctataatgacccatgcacagtcataatatcaaatatttactgagcatctactatgtgctagattattttaagcacttttgaaaatataagtattttgataaatgtatatcatatattgtcttaataagattatattgttgttatatttcatcttattgctaattttatttttttaagaaaacctttttttggaaagaatcgaaactaaaaacccaactatttaaaaaatggaaacttttggccgggaacggaggctcacacctataatctcagcactttgggaggccgaatgggcggatcacaaggtcaagagattgagaccatcctggccaacgtggtgaaactccgtctctactaaaaatacaaaagttagctgggcatggtggcacatgcctgtagtcccagctactcgggaggctgaggcagaagaatcgctggaacccaggaggcggaggttgcagtgagccgagacagcaccactgcactccagactggcgacagagtgagactccatctaaaaaaaaaaaaaaggaaccttttgccttacttcgtttgctagctacattcaagtctgcaattaagctcggtgttttgcctttctcaaactgtgcacaggtcctcttgtttgttccccttctctctgttgcctaggaatacagccaaaaacttgagtaatagatgatagatgggtctgtcactaagcacatcctagtgacatagataagaagcaaatgctacaaaattataggtgcaaactacaagttgtgttttaattggttttaacaagtacttataagcagaagaactgtgaaaaatctaacattttgtcctacttgcaagcctgccagtcttttgagtgctgggcaaagacacaatagtgctgggtcagagacaattaactttactactcacattaatagcattagcaagagtatcatgattttcttgcactgattcctcaagccgcaattcccacagaaaagctcaggtgacacctacatgctcagtgggttgcattagaaaagaggaacgcagagctcaggaaacatggatattttataatggccagtaaagatgtccctttgctttagaaagaggcactacctctatccaaggctgcaagcacacctgccttttgttttagaaggagaaatgatttctatcttccaaggctgttcactatatgaaaagacagtcccaaacaaaaggcagttactgacttgcttgaaaaatgtgcagaaatgatacgctgcttgaatgtggacagctgacacagggacaaggagtaaaaatgattaggttttgagcttgaccaactaggaagataattattagcagtagagaaaaaaagaacaaagtagattttagggcagataagccattttttaggtaggttgagtctgagatgcctccataaatataagttgaaaatatgagattggagttgagacttcagaaatacatattttgagtagttacactacagaggtaagtcatcagagttcataaaattaaagtgagaaaaagaggcaagtgaagaaaaacaagatggcattgcatgaagaactttcttaggaaggaaggcagcaaagaggtaaaattggaggtgtagtcagagatggaagatgaaaaaggaaaataacaatatttcagaaatgaaatgaaaaaggtcttttactaagtaattggtactactacttgtcagtttcaagtgctgtaaaaaaaatgggaagaaccacacatgtgcactttcagtactatgtattttatgcttcagggatgcatacctgtttaacaaaagtatgttttttctcaaagtgtgttgaatagtccagaaaaagatggaggtagaagtcagacttcaggagataaaggaaccagaaagatcattgaaggctgtgatggtagaaaacattttgacaaagagttgtgcaatgagaaagctaggggtgggacaattaattttgagggtaacaattggggatttgagtagattttttgcttctgttctttaattgttttgtcttctttttaaagaaaccaagagactgttaatgtagtaggagcagagtttcacaatacagagcagagagggtgttggttgataaagaattgtctcaaatgagaggaaaagaatggagccaataacagagatgatgtttaatttgggaaaggtgggacatgttaacatgagtccagagaactaaaatgagcttatggcatgcagatgctgaagatgaagaaaggaaaggaaggaaaaggaggaatttatatttatttattgaataatcttgtaaaactgttaatcacccctttttactgacgataagacataaatgtcagaggtgttttgcctaaagtaaaaaattcgatagtcaagctgggtttaaaaccatatcagtcttacgtcaaagcatgttttaattgctgttgtgtggttgtgattttaagggaagaagaagagttttataatgggttctctgaaaaataaaatatcaattagaaagaaacaaaacaactgctgagaagcagtgaatccaagcagaatctgagtatcatcactttttagttaaactaaccagtccaatatcctgatttttctttaacaggcaaagaatttttgagtctttcccatagactgagttcttgtgaactattttacagcaataatggcatccaatcctatagataacaataacaaagctgcagaccattttgttgccaggtttctcctccagggtggctttccagctagtttgtaaacaaataactcaggtggccctgtcatgttacattaactaaaaaccaagtctaaagcacacatataataacatatgtgtgtgcaaactggcttgctttcaaattcctaaatcatacaattaaattttaaaaataactgtatttggaaacaagaaaaaagtcactttgacacccaactgatgtatataaaggagactgtgcatatgggttttaaaatgagatgaaaattgaaatttgatctttgagattaaaaacaatgttatgtaaatctatttttatttaatttttctgaaaaatattgtatttgctttataccctcttgctatacaaacttatattgttttgcttaccctctttttttattcctcctactttttcttaattttgatatctctgaatttaaagtctagagaatgattcatcttcactagttctatcttttccagtgctagtatttttgtttttgagctgtggtttccctatcccatttttgagatctcaaactataatttggtgtcgagtacccaggtatcttatctttaaagtgaagacgtaggcagcacaaaggtgcttttattagaacgtccactagatcagaatgaccagtgcacaaaatttattttcctagcagactcaccaaatttaacctggaagagaatgtctgactctgttgaattttcttaggcaaatacaatatttgaaagtcactgaatgtttcaaacaaaatataacaacattcagataacagaactgtgttattgttctcatgtgtttatgcccagaaaataagcagactggagcttctctaagattaaaagtcaaaacagtattacaattccagcccagatttgactatctaatcatttaaaccttagtatcatcatcatcaccaccgtcactgcatactcattaagttaaaaaaaattcctttaaaataaatggaaaagaaaatatctgtgtaaatagattaaagcgattcctgctcaccactccctttctccctggggcaggagacttgagcacatcaaaggaactcatagcgttcttggagtaagtgtgaaagccaccgtgatgaactaaatgaatgcttacatctaaagaaagatgtaaacatattacattaaaaggtggcatgacataatggtatatcactgattaagaaatgtgaggcgactttcatgtgccactgataaatcattataatttgacatagtagataatgcccctatatttcatctgcatacctggaaaatgaggactttcaaaacatattcctgccagttacagtcaggtattgcaaaacaagcatttagtgagcatctaaactgaagcttagaacttcagttttgtggcggggcgcggtggctcacgcctgtaatcccagcaccttgggaggccaagacaggcggatcacttgaggtcaggagtttgggaccagcctggcccacatggtgaaaccccatctctactaaaaatacaaaaattagccaggcatggttgcacgcacctgtagtcccagttactcaggtggctgaggcagaagaatcgcttgaacctgggtggtggagattgcagtgagctgagatcctgccactgcactccagcctgggcaagagagtgagactccatctcaaaaaaataaagaactccaattttattttcttcatggcatagcataatagatgagttaacaaattaatgaaacagattgacatgtgttaattgcaatcatatacagaacagaaatcatttccataaaatatttaacctgcctgttacttcccctaaatctctctgtagctgatgccccaatttcactattagctcttcagacttggatgttaagcactgtgccttcccctggacctctctttaaatgtcacagctatttctggcaggtaagactattgctttggttagtgtgaacacacaccactgtggatcacaaggcacctgagagaaaaggctgccgaaagcaggaaaataactcagaaaaaagaaaaaaaaacacatggtgctgaaaaatacaacagatatgcatttgtatacttatgatctaatttatgtcagtcattaaaagaaaataaggtgtttagaaaatacagtgctgtctatggttatatttaatattgtgaccacttaatacaaagcaaagcattcttgcttgctctcatggagagtgcaatttagaattgagagctcaatttctaaggagggtttatgtactctatcttgaggcacaccaaggagattgagtttaccagtttagaaagcactgccataattcaagtcagggagagggctgatggaagatttttaaaagattttaaaagatcatgagggcaagctggcttttaacaaaacaaaatatttccatgtggcttctggctgactgaattaataaggcccagagactgatctgaaggcaaaagcctttattttttattgcaatggagaaaaactgaacattatttgactatcagttgtgaagtttagtaaaaagattttcactaatgggtggttttaatatttatgaatgtgatggttcagcaaattttctccaatgttttgcaagaccactaattaataatcatctttacaaatggaacatgtaattgtctgctactattttttctttgccaatgcttaatacttattttgaatacgttttattttttttctaaatttctctatttatttctacctgagcatttcttaatttttttattcagtcctgttattctcactgtaggatttttaaaagctggtatattatattaaaatccttcaactgtgaattcagcaatgttttgagttccagggattcatctggcattaggctgaccttgtcaagcataaacatcaacattaaagaaaatatttaagaaatgaaaggcctgaatcaaaataagaggtcaaattttccagggtgttttgtgtcttgaaaatctttctgctgtaattacctaaagactgtggttagataattattgagggacttttgcaattgtcccttttctctatatagatcaccacattaattaaacgagagtctcactgggaacaggttgctgttctgcatctttaagtatttttagtactttattttcaaaagagaaaaagaaccactaagaagaagattgcttctcagccaaattttctgatatacagatattctcaaaagacaagcacacacacacacgcacacacacacacacacacacacacacacaccccccaaggctctggaatgtgccttaacaatcttatttttgcacattttaaaaggaggtcattatgaaatttgcacatattttatgacctgtaatgtacttctctgatctgatttcacttgagctaataaaaaaatacaaatcaggtgcttgctgtgatcaagatgctaaagttatatttacactgcttcataaatgtaaggtgttaaagcttagtgagacaagaagtaaactgataattgattaaccagggtgctatacaaatctacctagagggtgccttcccaggttaatgcaattatgggagaaagatcctggctcctggctacagaaatgccaactaaagtgttatccaccccatccttcactttggaggatgcgttaagatgacactgtgctgtgtcaaaatgaaaatacaaacaaaagcaaataaaccgagtgataataaataaaccgagtgactcagtttccttatccattttccagttacctttttttttttaggccagtctgcatgtccactagaagaaaagggacctgggttcttcatcagcccatccttagatcttagtgcacatatgcacctagtaagtgccgagcaaatattcaatgaatgactgtacctttcctaagaattcttcgttgattatccttcaacagagctaacttctctccctatgtgctcagtcaaatgctctcccattggactgagttcagcataaactgccatgttttgagatgattggtgtaagcgaatgtcctctcctgagttgcgagaatctaagagcaggacaacatcacatgcttctctactttctatagttcttttgtccactgtctaacaaataatgccaagtgaaaaagggaaaaatgaatgaataaattttgtaagatgccaatggaaaaaaacagaaaatcaagagttactaaaaaaaaccactaactccatttaattgttttagactaagaatccctcagtgatacctagccaaaattaggattcagatccaaaataaaagatactgttgccccaagtagatatcataatttgttacaataagtaaaaatgtatattattcaatactaaactgttataccacatttcaagtttttaaaactttatcttccttttatgcatagatagtagtagagcattaagaacatgcatggctatcacctgaggtgttgattgtaaattcacattcctaggctttgtctcttaactactgaatcggaatctttgggagtgaactgacaggaatctgaattttaaaaataaggtcttcaggtgattctcatgcatctaaagataactgctttaatatataacaaagaaacccaaagagggacacttgaggattttttcaatatatcttcttttgcagagattaatagtgaatgttgttttatctgctgtttagaattttacatatgcattggatgatacatcttcttttactgacaaaaaggcttttctctggagaaaataaaaaggcagctttccctgagagcacacacttctagcaaagccccaatccatatgactctaagacagagtgatttccaccttctagtccttactttcttgcaaaaggggctttcaaatctcattactgatggtcccatcttttattactggtgttatcaatgggatgcttgcagcagcttaagtatgtggataaagaaggaatgcacaatatacggtactgaatatttttaaaaagtggtctttcagaatgtctgtatgtgtgggggcccatgcttaggcatatgtgcatgccagtgtgttatttatgttgaaaccaatgttttacattaatggctggaattccagaaaaataagaaaatatttgtattttctaaaccattaaaagtttagtggaactcattaatagtctgtatcatctctctgtatatttcagaagtacattttaagtgtaacagctaggggtaaactttcataactgtatgatttgaacacaagtacaagaaatattcaaggttttcttttcttttttttttttagatgaagtctcactcttatcgccgtagctatagtgcaatggcgctgtctcagctcactgcaacctccgcctcctaggttaaagcaattctcctgcctcagcctccgtagtagctgggattacaggatcctgccaccacacccactaatttttgtatttttggtagagaatgggtttcaccatgttggacaggctggtcatgaactcctgacctcagtcgatccacccgccttggcctcccaaagtgctggattacaggtgtccaccgcgcctggccaatattcaagtttacacaggaaaaagaatactttctctgcataacctttacttatttactcataagcctctagttctctctggatttgactgtaaatctcaacacatttcccagaaactaacatcttctggctgacttctattaaaaattcagacaaagaaaaaaactgaatacaatggagagagattataatactgctattctcccattctctctctctacagcatatcacctcctccaaaatcagttcatatctaactcctagcacatttttagttaaaaatatacatgcacaaaatatatgtgtaaatacacatgctgatatcacacatatgtgtgtgtgtgtgtgtatatatatatacacaaaagcagatatatatatatatatatatatacacaaaagcagatatatatatatgctttcttgcaggtgatagaatgcttttttggaggtggttttgtgggcctatgtaatgtctctattgttatattttaaaagtttcttttttgtttgtttgtttgtttgagatggagtctccctctgtagcccaggctggagtgcagtggcaggatctcggctcactgcaacctctgcctcccgggttcaagtgactctcgtgcctcagcctccagagtagccaggattacaggcgcatgccaccacatcccacttttttttttttttgtatttttagtagagacaaggtttcaccatgttggccagggtggtctcaaactactgatctcaagtaattggccagccttggcgtcccaaagtgcaagactgcaggcttgagccaccacgctccaccaaaagtttcttagcactcattctcatgagaaaaattgctgaaaacttggcaataaagaaacagaatgactacatgtcctttaaatgttatttttaaggggctcaatcaatgactatgaagttatctaagataaaacaccagattttgacattgccattaacttttttattagagcccccagatctacaggttatatgtgcagatgtgcagtggctgctttatttcccttttcaagagcttttcttatacagcatctatccactctcctatagagatgaagttaactcccttgacaactatcacttgtccccaatccccacccttccacttgacatacaaacccaaagagattcatgctcatttatgctcagtagaaaacataattccataggttactgctattattaatcaaatatttactagatttatatctattagtcaattctctttagaatttctttgactgtttctataaatctttattcctcagatattcctttaaaccagtcttaccagcttattggctccactactaattaattagttgaataaaatctttgaaatgtgtttatgtttgtataaaaaccatcttctttacttttcaaaaactatacttgagcacactgtgaaaagataaattgctaggttcaactgaggaactgaataattttttcctcttttagttttaacattctacacaatctaaattattttaaaactcagaaaatgctttaagctcatatttatagacttcccaagtagtacaatctgttaactgaggtaggtaagtaaacgtccttgaaaacttccataaatgatggtgaataaattaaaaaggtggaaacaattttccaggtctctgagccatattcaatataatgaatcctgaataggagttcaatgaaaagattaggtagattttttttaaaaaaaacccatatcccatgggatcctgctgtaaggtacttttataaattatactgattatactgtctcatttctctgtctatttgccatgtgttatatactttggtgatctttgagaaagcatttaacctattacaggcatttttttcccctaaagtacaagtaggtaggtcaaaagaacagcaaggacaatgtctatccacccaatctggtggcctccgaaggacaaaagccagagttaatctaaagcaatcaaggagtctgaccaccatggaagccctgaggaagtggctgctgtatttcccttttcaagagcttttcgtatacagcgtctatccactctcctatagagatgaagttaactccctagacaactatcacctgtccccaatccccacccctccacttgacatacaaacccaaagagattaattaacatttgttccaggaagagacacagacaaaaacatccgatattggaatattccttcgtgaataaatataaaacttatggagagggaggaagatattttgaaaggaaaaaaatcattggactttattgctcaaagccaaaagaaattgttttttgtggcaaaagtaaaacaaggtaattttgtactgtgtgctgtatttctggcaattatctgttatcttaagaggcttatatagaaagaacaattgtacctactttcacagcatgctctgaggatctaaggaccctcaacaaatagttttcatgctacaagcaggcacttatttaggcacaaataggatgggattctttttttaactgtagtataaataattttatataatacagttatataggcttttttaaacaaaatacagtcagattttaaatctctctattctaagatagacacttcacaatttaaattcaagactccttgtttcttgaagacatctatgaaagcaaatgtttttgagaacttggctgaatctgagtccattccgattagcagattccacattcacttttgagccatgacttagaagctatcaagacattatgtagcaacctttttctcagtattccaggaaaataaaaatgtgcatgcattaactcaataggtattcagatgtttcccattagtaagttgtgaccatgcaataaaaaccatgctcaccaatattccccaataaacttcaagatttgtaagctcatgcatacccacatttatgttaaaatttgaaataatgaaatatttttgcattgtgaaaaatagatatatatgcattttgtgaccaaaaccatcaccacagttccattgctgttgttgttcttcttcttattattattattattatttttggtttgtttgtatctggcacatttggggttataaatcacaaataacataaataagataatgttaatctccttcttacaaaatccaatggcttcccacaagtctatatataatatgcaaatttcttactatagcttataagatctggaataatttttcctatctccagccttcacctcttctcacattcatcatattctagctaatcaggactcttttatgtcataaaatatgctagatttgcacacccttaaagccttcatatacgagtttgttctgccttggatacctctgttccacattcccgaacattctctctctcatcacacagctggaccctttcaccctcctgatctcaattgaaatgtgaccttcctgtataaactttccatgagctggcttgtctgactgaacccaaatggctaatggattttctttcccgttacatgctctctaatttatgatgctttgcttggggggaaaatgagaggtgggagtctgtttacggaacatggaagtccttttgcagaggtacaagagtggaaatggctgttccccagcctggctctctgagtcagacctgacatccacagagagagcactgcagtaactgcaaacgcttctgttttgattgtggtaattggaacaatcagggcacaaactgcaaggtcactggcaagggtagcagcaggcatgattcctcccttagtaattttaaagcagcagatttcaaaagggaaaaccaagcagatgaaagtgagcagatttgttcttcagcacatgtgagatacccttggagatgccaataaatcactggagagactgtgaaggaggcttaggccctgcagatgaagttagtgatggagggaaatcgtgtttatcctcgggctgtcaggtctgaaatacctgggttaagtaaatggcctctgggatggtcacagtcggcaattattagcagttacagatccatctctatgccaaaacagataacagcatccaggaattatccaaagtcacaaatcagtgtcagtgtcttgtcactcacccacgtagtgcttttcccttcctcctagttacttaatggataagggcacattgtcaaataaacaaacaagtgaggataaatgttgctccgaaatttaaggtgaatcattagtcagacttggtatcgtcatggaatttggtctgttttctaactagctttattttagcacagccataaatctggctgtaattgtctttaactccgatgactcatacatctaagcatttcatttaactttcaaccgtgaaaaattccaactgatttggcaatatgaatgtgctcttacatgcatatgatcatatgatgctgtcagtacaacatctgtttttgttcttgggatgttgatggactatcatgaaccatcttataactttcccagtcccctttaagtccaagaggatacaactgagaaggcaggtagagtttttggtcagtggctaggtttttcctgaatatcaaacaaattgcctggtatgagaatttaacagaatatgaccacaatttttttaacagatttatctacttgaaacatcgcctcagtcaatgaagaaacttatgttctataactaataataaaagatcatttgtaactgaaatatgacaaattgctgttttaatcatgaggattaccatttagaacagctaggtaaacatttactttttaatccggaaataagttaaagcaaataataaaaatttatatttaaatcacacaacatgttttatcatgaataataaatgtttttaaagtttaaaaatgtacttgttaccttgtgggtattcctgaacatgattaggatttttatttctccaagtatttttattcactcacagaatcaaaatgtcaaggctatataagttttcatcaagtgctaatttagcatctaagtttttattaattaatttgtaaaggaaataataatgagagtcaaaggaagaagcatctcctgtggtgagctccatttccagattccaacgaaaccattaaaatatttatggcactgaggctgaatcagacgggtcttgtgtactctcttgtgtggccatattgtgtagcaacagtgggtttcgaataataagattcagtcatccatttagactccaattggagctcaggcaacttcaatttgtgattataatgattaacttcaaaaagatgcactatttgtagacctatgttgaaacttatgcagtggaactaaaaagccacctatttttataataaaaaggcacaaatacgcaaatgcaaaagaaattcattggaaaatcttgaacgtttcaaatataattatcacaaatgcaaatataaaataacaatatgtttgttaatattatactttcatttaatcagttcttctaagtaaggcaaatatatgaattttttaatatacaaaaatacccccccaaaactccattaagtatatctatatgaccattgggtaagattttttatgattattagtatgggaaaattgtgactgtttagatatattaaatatattaagtaatatatttaatgatttaagattgttaaataatttatattaaaattgaaacctcattttgccagtattaaaaatttcaaaatttaaatacatatgacaccaatgcatacaatgttactttgtcctgaacataagttttaaaagaatttaagtttaaatattctcctaaatgctttgtgagacttaagataaaaaacagttcctcagaactcctgacaaaggggggcagtaaagaagcaaaaagatttttatggagttcagggaaagctgaaaggcctttgtgtacattccctattttctaaacagtaaatgatggattgcattttaggcagactacaaaattgctaaaattaaatgttgggatggaaatgtggaatgcagagtttgcaacccccttttaatttaatattttcaaagaattaagagaaattattatattttattttataaaatattatatttaaaattactcaattctaaatgaatgttattgcaaacctaggcttataagaagaatgcatttagaagccctagataacatacaatataaaaataatatttgcaaattatgcatttgttttcttttctttctttttttttttttttttgagatggagtttcgctcatgttgcctaggctagaatacagtggcacaatctcggctcactgcaaccaccgcctcctgggttcaaacgattcttctgcctcagcctccccagtagttgggattacaggtatgtgccaccatgcccggctaattttgtatttttagtagagatggagtttctccatgttggtcaagctggtcttgaactcccgacctcaggtgatccacccgccttggcctcccaaagtgctgggattacaggcctgagccaccgcgcctggcctgttttcattttaagtgtagttgtctagcattttcaatacattcccccccgtttgacaaattttatcttgccatttagctaatgggcaagcaaaaaattaagtggaataattggacagaacaattatctggtaacctaaacaatggtaacatgagataggtattttatgcattgtttggacttataaactatctagtgttctaataatagacataatggtttattcaactaatagctactgtcatccttagaggttattaacaactcaaagtagtgaattacatccaactaaagggtgcttttgtatagacatttgttcttattgctggtcacttattcttcaaatatcttttaggcaccatttacaaagatgaccagaggtacaaaatctgcatatataatagaaagagccaggtagtcattcaataaaagaaggtatatagtaccaggaaaagatttttatcttagcctaaggcagtctgaattctcaagcccaaagcacataaatttgttggaattatttcaatttctagtcactaaaaatgtgacgcacatttacaccagtggttcggttgattacttctcttcagccctagtctcttaagcacaggtatacacacttacagcaatatctctgcatacaatatttttgacagaatgaaaaagttaaaaatattgatgtttatttcagcgattctgaaatggtttataaaaattctatgactataagaaattcatgaggaatgcaatatatcaggaaagaacaatgtcatctttacataaaaaggatgcgtgtcagtaatttgagaggctggaatctagtgacaaatgtgtcactttttaaggtgtgcttgattcacagctgacagctttgatttgaaattgcctttaaaacaatgtctatgtatcagtgcaatgaattctaaccaaaagcttgttggagctaaccacagtacctatatattcaagatgttcatgggaggaatggaagatttgatatttaggcactgaagggttgctatgatagttattatacacaattgagtttaaaatgaatatatgtgtcagttctattattaaatgttataaaatatgagggaataataaatgctatgtaatttataaactacaagaaaatttatatcaggaaactgcttatttcctaatatatgcactgtcttcagtgtctccaaaactgtcaactctgccaatgtgactagcagatgatgagcaggcagtccgtgtgatattatcaattacatagtcagaaatctgagtctttctttcaccttatgagctgtttaggaagaaggtgtatatgtgtgtaacagggagcaagaggagattaacttgtaagccattatctgatgcaaaggcagacatttactaagtcatctgtgaagagatggttcgataatagctaagcattcatataaatcttcagggactcgaattctctcaagtgtgacagaatactcctctcaactgccagcgctcctgttgtaaaaaatcacatttggcaaagggctctggtgttttgagttctgctcagtgacaggtttgttttaagtaagattaatactgaggacaataaaatgaccttcaattaagactccttttaaattttgtctacctgatttccactatggttcgtgtctagctgtactctatctaagaatgatctttaaaacattcaggattatgagagagatatctaggaagtcataggaaataaccactattcaatgctgttctgtacaccattagtaaaccataagagaggacaaacatttatccaagaaagagactattacatagccaccaggacccaatatggattcagcacaattgagcaatacatgtaacagatttgtggtgaaaaacaggtgctgctcaattgcttagtctaaaattctccctcaattccttcccatcacctaatttgtttgacatctagtctttttacattataatatagtatattaaaaagttcttattatggtttttttttttgagatggggtctcgctctgtcgttcaggctggagagtaggctcagtgcaaactctgcctcctgggttcatgccattctcctgcctcagcctcccgagtagctgggactacaggatcccgccaccacgtctgggccaattttttgtatttttagtaaagactgggtttcatggtgttagctaggatggtctcgatctcctgacctcatgatttgcccaccttggcctcccaaaatgctgagattacaggtgtgagccaccgcgcctggcccttattatagaatttttgggcatacattgcacatttttctaattgtgcttcaataataccaaacaagtgggcaaatgcttcactgggctacatttgcatccctgagtacaatttcacattggttttggttttgtgaattttggaggaatttattttgagagatgcccctggaaataaataatgctgatgttttggtgtaattttatttattgcattaatggaatatgtaaatacaatctatcagcattaggcagaaaatatttaagagatatcaaattcttttgccgagaaaggtagtagtttgccaggaactacaagctttctaactgaacttttaaaaataaattttaatttttaattttgatagatcatcatagttgcacatatttaagggctatctgtgatattttcatacaatactgccatgtttactgccactattcacaatagccacgatatggaatcaacctttgttcatcaacagaagaggagacaaacctgactttggtctgtgctggctgcaggttctggagagctgtttgaagtgacaagatggcaaatgaaagggtcagttggttgcctggtggattattcgtcctcataacactttacctagaaattttgccttttctcacaaaaccataataatggacaaacagcatgaacctagatatgcacccccagtcactatcgtaaggtcaagttggtatgagtcacataagtagaggactagaagttttatctgaatagtattgtcatagtggctaggaatgagagtgaaaagtagactagatgtgtgctttgatatggcttggagcaaaaggtcaggtattggggcacttctgaaatgatatctattatttaggaactgggtcaggaaaatctataattacattcctactgtatttacataccattcattcctaagagagctcttccaaaaaaaaaaaaaaagagatgtcagtgcataaaaaataaactccatttctttctcaagcccaaagtacataaatcttgaaattttccagctaaaaaataggcatatgttctagcatcagctttaatttatcccacattcattctctgctacaataaagtgacaaagccattcatattttatgttacatctaattatctgtttttcagttagataaatatgctttatatcctaggtaccatcagaatttcaaagctcagaaaatcactaatgagaatggaaggaattaaccatcatgcaagcagaagcatgcggctaccatgctacattgctcagagttcatgtagcagtttaatcagggtagcagctgtgcaatgagctttgttggaactggagtctcgcatcctaaatgtgaaatatctactgtttgaaagggtgataactttatgccttgcaaagaaaacagtcctcaagtgttattttttaatgaattaaccctttatctttcctcacaccttttctcttctttttttttttttttttgccctcagaagtatttaaaggataatcccatatgataactcacactgcctagcttcagtacaatgtctcatacattgcaggcactcacaaacatttgtttaatgaatgaataagtgaaagtccaatggaaaattacactgttgaatttacaatggttttagaggtacatctctaaatttgttgatttatttaggattgtacattgtcacattttcactgctaaatttcatattattcattaaagaaaggcagtgttggagagttttatagttgacagatgaattatctataacttctaatatactcagacatcatgtttttctagcatgtaacttttaaaatataaactctccaacatttaaagttttaacactttttagtaattttttaagaaatgacagatcaatagtagctttccataaataaaagcctattaatttgtataacataacaaaattcagtgcaacataaattcatatagtactcctacaagaaatctataggagtaaaattatgattataaaaatcaacagacttaaacaaacaaataacagctttcaattaagtttatagataccaaagacattcaacctttaacatcccactgtgtaaaatcaaatgggaaaggataaaaggaccaaagctatggttagtaatataattgattgctgccctacctacaaactaatttgttttaatatctgtgctagaaccagtatgttaccccttttaactttagctaaataatgtttatacaaaccttactatgcagagctatctttaacaagagcatcccattgaggaaaaaagaaaatagaaagatatgaaaattttcacttttttctaataccaacagatatcactttattgatattgcatttctgtatataatgacatagaatatgagcattccctgtagttcagttttactgacagtaacattgcacaaatcattttagggctatgtgctatgcagagacattgtacagttaattggcatcattaagtaacattttgaaatgatgaggtgttcaaatgtagtagttaaaggcttgattggacattgctaaattgggtactagatctctaaagagatggaatttaccccctagtaggctttatcctttttcacttgtctcagatttggaactcatttcttttaggttgaaaattttatgttcatgttggaaacttaaattttaacaattaaaagattacttgaaatgcaatgctacccacggctgcctgtcattttgggagtttcttatagattctttttagggataagaattatgttaaaaccagatgctagaattgctttaatttttattccccagtttctcatttccattttgacaaagaggcccaaaacatgaatagccttttgatctgtttttttctcccatatcagttcccatgagaccagtgacttcattctttctgttattgcaggtttacattttgcagtcatcttttattcttgtatcactatcttcaatcattgtggccaattctttccaggtcattctcaaacctccatatcaaagctatagatcaataactatcagaacaagttaaacattaagataaagttaatcatcttttctttataataataaccaccactgaattgcaattgttatgaggtattatgctaaacactttatcaaatcttatgaaataggggtaatttttattctcatctcacatgagaacttgaggcacataaaaattaaggcattttgccccaggtctcatggctggcaagtggtctgtctgacagtagagagccagcttcaagcactgtactatagggccactgtgtcatgactataaacctttcatggcatggtctatacatttgggctcttcagcttcaaatttatctatcatgcaggcatgacactaggttttcacttgcactggaagtcaactgctggaaaattagtctgtagaaaaccgtaggccacagagttcctgaatgtgttagtaagaggcttagattttattttggatgggctgggaaataattgaagggttgtaacagggaatgtgcagaattgcattgtggagagatctaattggagattgggggaaagatgagcaggccctaaactgtgataatgttggcaagcttgaagggagggacagaatcagaaaatatttgtaagtgacatttctaggcccctgtgatttactggctggaggatgagcaggtgagaggtgtttgttttgaaaaaagtgattttgaagagaggtcagaaaaagattttcatttttttacttcatgtgttcatgagttggggagtcagggtacagaaggaaagacacatgaagccagggactgacacagagaccagacacacagtgggtgcttcatggatagctgttgaatgatttgtgaaaatcagatagcagtggtgagggtttttatgcaagtgaaatacaaatgaacttctcaaggtgccatatctgagttgtggctttgatctggttcctgactttgaattattttgttcctatgaagtacaggactttgtaataaaaatccaccatacacaaaatcccctggacttaagaatatctccacaagttataagaattgaaactgcttagaaggaacaattgcttgtactcagccagtcatcctcagctgcatgagtctcaaaacgggggtggagagtgtctacctcctccagaaaaggtttttagagcgaaatcaaagagactgcctcttctccaccaaaattatttgtcttaagatggggacaagaaacctggcacccaggagtaaggacacagacgtgctctctcattttaagctgaagctgaactgtcttgtcctaaaaacatatgcccagactctagaaaagctctcttagacagactgctaatttctccatttctgtcacttaagaggattttagggacatataactttgagaattccattctgcagctttcagaggtaatacaatccaatactcatagtgggcttatggtgtacccggcacttttccaaacattctacttgttatagcttctttaattgaggtacgtattcttatcattctccatttgggagatttgagagagaggcaaagtatgtgccttaagatgacacagttggtaagtaggaaagcagaactttaacatcagcagtaaaaccctgagactattgttttaatgtgtttaataaatgccccactaagaaaccagagcaaattaaaagtatgctgtgttctattaatttgatacaggcagaagaaatctaaaaacagcaaagaatgatatttaagaagaactctattttaagtagttataggacatatgcttaaactgagtgaactttttatgaacttttcatcagagatttttttttaattgttgtttttctcctgtgtctgtgactgaataaatggcctctgttcactggaatgcttcacatgcttcctctctcagttgtaggtgtgtttatttctattcagacaccaaaggcctatgggtatctgcaaattaacagtttcatttgctattatgttccatcattgtgaagcagcacaggaaattaacatatctgtaaccacgcccttactatataatatgaaagtgtaaattaaaacatgccgtgttcattaaactgagataaaaccacattttgaaaataaagtttagtaagtggatacttagtatcacattggcgatactaagcttatgacttgcttttaatatttggattgcaaataaatttggaagctaatgtatggagtacaataatagcgaaaagcatgggctttgatattagacatggctatgcatccgaatatcttattattggatattcgattcaagaacatatcagaatagtaattatgttgtatttgattcagtggctgagattgaagggcaactaaccaacagaggagaagatattattgattgttctaaagatttatcctccaaagctttcctttaccctatcttgttacatcttttttaaacaatgctaattgtgtcccttgtacatattcttattcaactcctcagcaaacatcttctatgtgaccaacattctgagaggtgctggagatgcagggaagagtaagatgctatgcttgacctgcagtatcttgaagctagttggggcagcaaaccattaagacattcagcagcatagctgttgtctgcagaaacagatggggatccaagggttggaaataatacagaggagagatggattcatttgaagagttctcttgttgcatgcttaatataattaaagtgcctagccactagtagatgacagttttctaattttacacatcatgtaatccccttagtcttgaagatattgatggtgttaatcacttgaatgcagtgacattaataatttcttagataaaaagtatactgtttccaatcataaattccctgcctcccagactctctgtgagcctcatgtgcataagtggagggaaggacctgctgatctaagaatacccctagtgtcaaagaagtaaatggtcaagtaaggttgtcctaagaagccatgttaccccttctgctggtgagcacagagcccaggtataaaattttttttttttttttttgagacagagtctcgctctgtcacccaggctggagtgcagtggtgcaatctcggctcaccgcaacctccacctcccgggttcaagcgattctcctgccttagcctcccgagcagctgggactacaagcacatgacaccacacctggctaattttttgtatttttagtagagatggggtttcaccatgttagccaggatagtctcgatctcctgacctcatgatctgcccgcctcagcctcccaaagtgctgggattacaggtgtgagccaccacgcctggctgcagaatctttacctaggttactgttgtccatgtgggtaacaatcttgacatctgaagtgttcattgaataaaaatttgtattgaatattcttctaacaaaatctgaaaaaagtacagagctatttttgaaatggatgagaatgtatggtaatttagctagttcattgtatgtgtcctgttttcagttatcattgctactgaattatttatctttaggtgtataaattatagtcaagatgcttacaattgatgaaggaagaatgattttaaaacacagagcaaaatgttattttaaatacagaagtctattcttctcctccatgaataactggcattctgtttctattgtatattaggttgaaatatgtgtttttgtcattaccagtgtttccacaggataagactgaaggcacaagcatttaatatttgctgaaagcacttaaacagaaaaaatattggctagtgagattaagaatgaaataaggtagacaaatagctggctgcaaaagagaccttaaaaagtttctcagagcctggccaaaatggcaaaaccccatctctactaagaatacaaaaattagtggggtgtggtaccatgcacctgtaatctcagctactcaagaggctgaggcaggagaattgcttgaacccaggaggcagaggtaggttgcagtgagccaagatcatggcactgtattccagcctgggcaatagagcaagactctgtctcaaaaaaagaaagtttatcagtctattaagaatatacttgatttttacaagaagaatcaattgctttacaaagttatttatctaaaatgtatgaataaaaatgtataactataaacatatctataaaactagtaaagatcaaaagctcaggtatctttaactttctctgcttctactattcacaaaaatatttgctcagagacacagaaactcatcttcaagatttatttttatctgggtggagttacagagttgccttggtaacagcaactatcaccaaattaagtgttaagcacacgtttttaaacatttttaacattttaaaaatgcagatgccaaaggagagcaatgtcaggagagaatgttgtaaactccctttttcccacatctacttgacattacaaggtttgtactactttcagaaattctccagtgtttaaaaaatgcgtctataaacacacatatacacagagcacttcttattgaagtaatcaccttaaaaattatgtaatgcaatgaaaaccacaatggttttcctaccattgactaagaaagcaaaggacctttcttctgaaagtgaggaggacctcttgcctcctgtcatttgtgaatagaactctgtagtcagaaccagagcatttctggcatttggtctagaatcattctgaagggcaagcctggtgctgtgttgctaagcacaaacaatttggtatttggctccaaaaatatgctcgagattagttcttccctcagcaacaggcgctcagccaaataatttttaaccaactctcagagcccagtattgcttgagctactgagatcctatttcaagttattgctatcaagatatggaggagagtgaaatactgacacttgtgagatcccaagacttacactaaatccatacaatttctgtcctgaattaaaaatttttttaaaaaagagatgaaaagtgtgacatttccaaaccacgtaattggtttctttcaccttaaactccaagttagagaagtattttgttgttgtttgttttgttttaaaactagacttggtggaatacagaacataaacattttaaacaaaatattaaacttctagaacagtggatcacttaaaatgaaaactttaagactttccttagactgagttttttattcttaaaaaaaattaaaaggaagttgaattttatttctaaacggtgcaggacaaatgaataaaatacattttgcctctgtcttaaacttagaacagatacgcaatctctttaacagtatgtaaaaattcagtcttttctttctttggtttccaaattacagtgaaatgaaacattttccttttatgtgtaattagtgcagtttaactaagagttatggagcatctttccacctcatggtgtatccatgtagctgaatttcttcagcatttgcttttttaatttgtataaggagtaactgttccatatcttagaaatctttgaaattagaagttgatctaatagcatctctaatgtagtctctccttgaattttaaatataatagatatgacctgttatttaaaagatatagtgtttactggcatataacagttgtgttgagaatttttcattgaataaaatatatttcccttgaaatttttgttttatggtcatatctcataatccacctctgaatcaatgaacacttgtattggtggagaaaacaaagatccttcagacagactttctgtgtggtatgttctttctgtttcttttctaataacattaacttacatttaaaattattataattcactctattttcacaaatcatcaaatcatactcagatatttaaaaataaattttattgtatatatttacagtaaacaacatgctgttataagatgaatgtatatggtgaaaaggttattatagtgacaaaaattaacacatccattgtctatctcacgtagttacccactttttcccctgtggcaagagcagctataatctactcaattagcaaaaatcctgaatacaatacactattactaactatagttgtcatcctgcatgtcagctttttagttcctcctacatatctgctactttgtatccttagatctacatctcccaatctcctccctgccacctcactcatggtaaccagtgtgtggactgtgttttttgtttttttattttgagacagagttttgctcttttgcccaggctggagtgaagtggcgccatctcggctcactgcaacctatgcctcctgagttcaagtgattctcctttctcaactgcctgagtagctgggattacaggcacctgccactatgcccggctaatttttgtacttttagtagaaacaggatttcaccatgttggtcaggctggtcttgaactcctgacctcaggtgattcacccacctcggcttcccaaagggctaggattacaggcgtgagctaccacatccggccggtaaccactgttttattctaactttatatttgaactttttctttttagattccacatataagtgagattatgcaattttgtgtgtggatgtgtgttggacttatttcccacagcttaatatcctccaggtccatgcatgttgtggcaaatgacagggtcttctccttttttaaggctgaataatattccattgtatatacatataccacagtttcttttatccattcatgcaccaacacatacctaggtggtttccatatcttggctactgtaaataatgctgcaatgaatatagcagtgcagatatctttatgaggtgatgattttatttcctttgggtacatccagaggagggattgctgggtcttaggtaattctaattttaatttctttaggaacctccgtactattgtccataatgactgcaccaatctatatttccaccaacaatgtacaagggttcccttttctctacacacttatcaacacttaaactgaacatgtagactttttcttttcattattctctaaacaatatagtataaaaactatttacatagaatttacattgtattgggcattatcagtaatctagagattatttaaagcagcagtccccaacctttctggcaccagggactggttttctggaagaaatgtttccacggacagggatggtgaggggaaggggaatggttttgggatgattcaagcacattacatttatcattagattctcataaggagcgcacaacctagatccctcacatgtgcagttcacaatagggttcgtgctcctatggcaatctaatgccaccactgagctgacaggaggaggagctcagctcttgctgtgcagcctggtatcgaacagcctaacaggctatggaccagtactggtcatggccctggggttggggacccctgattgaaagtatatgagaggatgtgcataggttatatacaaatactaagccattttataacaggggcttaggcatctgcagattttagtacccaagggaggtcctgaaaccaatcccctatggctactgaaggacaactgtgtatcattcttaacagaaaaaaacaaaatctgttttgtaaataaaattttttcattattatttccatttcactctggaatttagttagaaattaagattaacaaaatattaattgactactaaaatgtaccagcactagcagcacataccaaaaactaatacaaatattccaataatattaaataatgactgcatttgtatttcatctgagagtggtttatggttcttccccataagtggctgatttattgatggccactttttcttaactcctggtctttctcacaatcacagaaaacagtcccttatcacacaaataaaaaagtcatctcaccattcctctgtaccttttatcttaacagacttgtgttttgaaatattatttatactattttttaattttttgagaccgggtctttctctgtcacccagtctggagtgcagtgcgcgatcttggctcactgcagccccagcttccgggttcaagcaattctcctgcttcagtttcttgagtagctgggattaccagcgcccatcaccacacccagctaatttctgtatttttagtagagatgggtttcaccatgttggctaggcttgtctctatcccctgtcctcaagtgatccctgcaacttgacctccaaaagtgctgggattataggcatgagccaccatgcctggccttatttatattatattaactctaataatcactatgccactttctgttgtaattctttaggcacttcttctttgtatgtttttaattagcatgtagttatatagttatatatttacgtttagatatacctccaagtagccaatattctacatgaagtgataaaggatttatttatccctgaaattatgaaaagtctgccttgttttttctttcttgcattgtgctacagtacacacatacacggacacacgaatgcacacacatgcacactgggttctgctaattatcatttccttagttccatatcattccccaacccctaagccacctgtgtccataccagtcttcccactgcctaccagccccatgtcagatgacctccatcagtagtatctccatttatggtgtctcgcctttctgacacatagtaacaagtgaggtgttaagactaacaagagaaagaaggcattattcttatctggctagaaagaaaacaatcagcaacttgtcttttatttaagggaagaaggcttcactctactatattttcaagatattccaaaactgcaacagaccctttcaattattttactttcatctattaccaaaaaggccaacttttagattgaggcaatgaaaactcagaaacttttttggaatgaccttcagatttgagatgaccactgtttcaacaatatttcagttataattctttctctatattcatttagggaaatttgattctgaaaaatacaaatagcttcctttctcctgagctaggactgtatttagaagggaataaattgtagattttattaaaatttgatcacattttctttttttgtgctacgacacagtagcaatgtagattgaaggcttttacatgtatttttaaaattgccatagagaattatttgtattaatcatagatttccaaggctgcaaaagctaaatagtaaagcatataataatggtagcgttaatttgaaaaaaaattccagctagcaaaacatgagtctagatgtagatatcatgttcaaaaatcacaaagcagattgccagcaaaaaattgaaccaagtttttccccttcagaaaactagctttatttaaaaaaatttcctaatatttaaattgattcacacgtttataactatacaagggtttccttgtttcatcaaagaaataagtatgaatgagcagaatgttttagtataaaagtttacaaagtttattcacactcggaacaaaggaataagtaggaaaaaaagagcaactaaaaacaaatgaattcttttccccatccctctcgtttgtctccaatcagttaaatccttttaatgatatatcataagtagcttcatgctttagttcacattgacgatattcttatatctacatcattaataatcaaaatagtctttctgtctttagttttgctgtctctaagtcagaactcaatactgttgctctaaaatacaaatgttaagatgattcttcaggagcttctcatcacctgtactataatgctactagcatgagagcacccacctagccttcttatctcaagtcctgccctgccactctgtacatatatcccctctttaattcacccttagacagagacagagagggccacgcatcttgtcttttcctgaattaatatgtggtttttgccccatgctttagcacatgtgaatccatttgtccagcatgcctttgctcacctgtgtacaagaagagctacataacagatcaaaaggaacatcaaaggcgctggttcttagagtctcatgtccattcctccaattctcgccacttctggatgcactgtttcttatgagcttccttaaatatgctgtgcctttttgctttctgcgtatgggcatctccagtgccaaagtaagaggagatttctgcagaatttcaggaagttaatatcctagtggcagctctcagacaatgggagacaggagctaatggctgtttcttcgttttgtccttcaggctgataatccagaaaaccaatctgcacaatgcttgagaaggtgcagagaattagagccctcattgccctcaatgcagtacctttatattggctttttctccttattcatcacatgctcctgtttcccgagattgccacccacatatactacttgcaccctacactatatttcaggctcttccttcaggataatgaaaccaagctaaaggcaaaatccaacttttgtttaactcatcctgcttctgagctcccaagatccctgaacctacttctcttatataatttattatagaaagttatttaagcatgagatttctctagtttatctttgaatctccactgtcaatatagtctctggccaatgaaagctgttcagttaatgtgtggtgattcaatacatgcactcctaattctcatttatgaacattttgttaaatcgtggcctataggaaataggcatgtaaaatgcacctgtaagttttatagcacctagtacagagtgacagctcaaaactatttgcagaatgaaagaaaaaaggaagttgactctccaaaacaatacacatggccaaagcctggaaaaaagtaatagtgtcccagtgtaacttctaggaggtgtgaggaagaaagaaaaacaaaattggcaccttttcccaggctttagactgagagatattaacttggagaggggaaagcatagtctaaagagaaacagggctaaggaaggtatcactttcttttactatctctcagacagattgcaatgcaatctcaaggcagcactacactggacaaggtactaggactctgaccattcttgtttttattcttttttttttttttgagacagagtctcactatgtcacccaggctggagcacagtggcactatcttggctcactgcaacctctgcctcccgggttcaagtgattctcctgcctcagcctcccaagtagctgggaatacaggtgcctgtcaccacacctggctatttttttttttgtattttttttgtaatttttttttgtatttttagtagagacagggtttcactatgttggcctggctggtcttgaactcctaaccttgtgatccacccgccttggcctcccacaaagtgctgggattacaggcatgagccaccgggcccggcccatatttttattcttaaagaaccagaactatatgcatctagtgttccccaagttttcttctttgtcttttaacattccaggaaaacagatattgagtgttttgctggatcatgcatagttccatatccttttgaccctctgtttgctgtagccagctttgattctttggattcatggtcaccctataacatattcactaatccaccaatgaaaggttatgtaatgtataacaatcaactcagggttttctaatgacaatctttatcaatgttctataagcttgaaaattaatttaataatttataccattgtgcataaaatataataaaaactttaatttaataacgaaattcatgcatacttttacaaacttatcagtcattcagaagtaaatgtggacttcagttttgtgggcaggggtttacagaagtatgttttactaaagtttggagaaaagatcagtataaaaatatgaaattataccaatagcattattagaaatagttaaaagacaaagtttaagtattttcataatcatatcactttttaagtgactaaactactaaagaaacatttagttaactctaaaatattgttgtaaaatttctatgtgttttgaggaaaaatacttttattccatcataaaattttcaacttagagaaacaatttgtttacttgaaaaattataatattttcaagtaaaaatggttatactgacaatttattaaaacataaataaaagttcttcccacactttgacacatgattagaaaaaaaaaggcagtaagattttcatacagaattctggggttaagtagaattcacttgtgtttgctggtctaagatgcaatggaatttggaggcaatggggctggattctatcaaatcagacacacggaagaggttataacgtgagaatttatattttttcattttctcagcccacacttgaaataacaatttgcaagagttttgctttgctcaatattaggcctgattagctaaaatgctcaaatttccattcaatccttaaaaacagatccacacttagtcattcttcacacctctctccctcgccctttcacacccaaattgttaacttttttctctattctcacatttatagtctggttcagacttccgtgatctgtcacttgctcttgtggttaaatttctgaagtgaaattcctatctctaatctcttctcctatgtatgtcatcagacttgcaattttttctaaacccaaaatgtgttttcactagtcccctgttaaaaaactgtcaacacatccacattgcccactggctatagagttcaattcaaactagagtcattcactacttggacaaccagcttcccagctccacctctgggtattctttctcttgccttcagaatggtgttgaggatataaggtgaatgcaacagccattgctctcagtgagctcatagtctaagtgaggagacagatgagcagatcattataaaacaaattggcaagtgcaatgacagaagtgtgcataggtgctatgggaaccaagaggaaggatatataataagccagggaaggaagagaagattcagggagacttactggaggatgaattgccctcagaaagtattgaagtgtaggtaacagttggttaagagaagcagaaagaaggaaaaggagacagcagcacagggtgccaaaataagaaaagcctgggtaatactgccaagagaaatctacaattaaatgcaattcccatcaaaataccaccatcattcttcacagaactagaaaaaacaatcctaaaattcatatggaaccaaaaaagagcccacatagccaaagcaagattaagcaaaaagaaaaatctggaggcatcacattacctgctttcaaactatactataaggccatagtcaccaaaacagcatggcactggtataaaaataggcacacagaccaataaaacagaatagagaacctagaaataaacccaaatgctaacagccaagtgatctttgacaaagcaaataaaaacataaagtggggaaaggacatttgatgtattgtatgggttacataagatcgattaagtggagatggaaattttacaactttttgttgtatattgtaaactatttttaaatattagtggcaaaaagactaatatggataaatattcccaacaatttgatatttgatgtcccaaactattgtgagattggttataataaaaaatagcaaactaccctgctgatttcccatgaagcttaaccctctctcacatttcagaaccagcctgacttaagcctctacatacttaaacagcttcaaatgcctatctgagacagctttgtaatgggtctctgcccctgtttctctgtccacaagaggtactaattcacttctcttcagttgttagacctaggacacaatagacaccaagttacatttctgttaggtgcatcttggaagtgcctgagaactgaccactgggcacctacctttttacctaagtctctgttaatgttggtctgtttacctgttagtagtggagcctggtgcatagaattatctccttgccatctgtgtcccacaacacatatataaccccctgcatggcatatgaggcctttcctgagaggggtgcttttaagccaacattccagagacctagttcccctgccccaggtgcctcagtttttacacctaggatgctattttgaatcttctcctcaatgacaagtatctgtactcacttagtttgggtccatgccacattcctgaggcaactgaaacccacctactccttgatggccttccaggatgcttgtctgtactatagtggacatcccttcctgcctcacggatgtccgtgtgtgtgtgtgtatgtttggtttttactggattcctgaggaaggccttccactgaacttcattcatgtgctttgctacctgttagaaaatgtaacctaatgtaaatgtaaacctctggtgcctctagttttactgacttatgttatataaatcttggttcctggttctttctgttgccctgttatgagatgtatcactctaagccaagcccaaacactaagataacaagtgctaaagatgacgaatattctgaagagttttcaggacacacagaattgtttgtggccagcacctcagtaccaataacagatatttcatgttatatagtggggtcattaaggacttatttgagggaataatcaagaaaaacttcctagtcttgctagagatctagatatccaaatataagaagcacaaagaacacctgggaaattcaatgcaaaaagattaccacctgggcacacagccatcaggttgtctaaagtcaagatgaaggaaagaatcttaagagctgtgaggcaaaagcatcaggtatcctataaaagaaaacatagcagattaatagcagatttctcagcataaaccctgctagccagaagagattgggccctatatttagcctcttaaacaaaataattatcagccaagaattttgtatccagtgaaactaagcttcataaatgaaagagagataaagtctttttcagacaaacaaatgctgaatttgccactaccaagccagcactgagaaatgctaaaaggagctctaaatcttgaaacagtaacttgaatacatcaaaatagaacctccttaaagcataaatttaacaggacccataaaataataacacaattaacaacagcaacaacaagaaggtattgaggcaacaactatcatgatgaatagaacagtacctcatacctcaatactaatgttgaatgtaaatggcctaaatgctccacttaaaagatacagaatggcagaatggataaaaatccatcaaccaagtatctgctgtcttcaagagactcacctaacacgtaaggactcacataaacttaaggtaaaggggtggaaaaagatattccatgcaaatggaaactcaaagtgagaaagaatagcaattcttatatcagacaaaaaagattttaaagcaacaacaattaaaaaagacaaagagagacattatataatgataaaataattagttcaacaggaaaaatttacaatcttaagtgtatatgcatctaacacttgggctcccaaatttataaagcaatcactactagacctaagacatgagatagacagcaacacaataatagtgggggacttcagtactccactgacagcactagacaggtcatcaagacagaaagtcaacaaagaaacatggacttaaactataccctagaacaaatggacttaacagatatttacaaaaaatcctacccaacaactacatccttttcatcaacacatggaatattctccaagacagaccatatgaacaagtctcaataaatttaagaaaatcaaaattatatcaagtattctctcagaccacagtggaataaaattaaaaattaactccaaaagaaaccctcaaaactatacaaatacatggaaatcgaataatctgctcctgaatgatctttgggtcaacaatgaaatcaagaaagatgaaaattttaaaaatatttgaattcaacaataataatgacaaaacctatcacaacctctgggatacagcaaaagccatgttaagagcaaagttcatagcattaaatatctacatcaaaaagtctgaaagagcacaaatagacaatctgagcttacacctctaggaactggaaaaacaagacaaagcaaacccaaacccagcagaagaaaagaaataacaaagatcagaatagaaataaataaaattgagtcttagtgtggtggctcacacctgtaatcgcagcactttgggaggccaaggcaggcggatcaccataagtcaggagtttgagacctgcctggccaacatggtgaaaccccgtctctactaaaaatacaaaaattagccaggtgtggtggcaggcacctgtagtcccagctactcgggcagctgaggcaagagaatcacttgaacctggaaggcagatgttgcagtgagccaagatcatactgttgcattccagcctgggtaacaagagtgagactccatctcaaaaaataaaaataaaaataaataaataaataaataaaattgaaacacaaaatacaatacaaaagataaatgaaacaaaaacctgcttctttgaaaagataaacaaaatcaatagaccattggcaagattaaccaagaaaacaagaaaaaagatctaaacaagctcaattagaaatgaaatgggagatactacaactgataccacagaaataaaaaagattattcaagactactgtgaacacatttacgtacacaaactagaaaaccaagaagagatggacaaattcctgcatatatacaaacctcctagattaaaacaggaagaaatagaaattattaacagaccaataatgcatagtgagagtgaaacaataatagaaaaaatgtcaggaaacaaaaaaagtctaggaccagatggattcacaggtgaatgctatcagaaattcaaagaaaaattggtacaaattctattgaaactgttccaaaagatagagacagagggaatcctccctaaatcattctatgaagccagtattaccctaatatcaaaaccagaaaaggacataacaaaaaaagaaaactacagaccaatatccctgatgaacagagatgtaaaaatcctcaataaaatactagctaaatgaatccagcagcatatcaaaaagataatccaccatgatcaggtgggtttcataccggggatgcagggttgctttaacatatgcaagtcaataaatgtgatacaccatataagcaggagtaaaaacaaaaatcatatgataaactcaatagatgcagaaaaagcatttgacaaaattcagtattgctttatgattaaaaccctcagcaaaactggcatataagatacacaccttaaggtaataaaagccacttatgacaaacccacagccaacattatattgaacgggggaaaatttgaaagcatttcccccgagaactggaataagacaagaatgcctgctttcaccacttctattcaacatagtactggaaatcctagccagagcaatcagacaagagaaagaaataaagagcatccaaactgctaaagaggaagtcaaactgttgctctttgccgatgatatgtttgtatacctagaaaacctaaagactcatccaaaaagctcctagatctgataagttaattcagtaaagtttccagatacaaaatcaatgtacacaaatcagtaccagtgctatacaccaacagcaacaaaactgagaatcaaattaagaacttgagcctttttacaacagctgcaaaaaaaaaaaatgcttaggaatatacctaaccaaagaggtggaagatctctacaggaaaactacaaaatattgctgaaagaaatcacagacaacagaaactaatgaaaacacatcccttattcatggattggcagaatcaatattgtgaaaatgagcacactgccaaaaacaatctataaattcaatgcgactcccatcaaaatgccaccatcattcttcaaagaacaagaaaaaaaatcttaaaattcacatggaacaaaacaacagcccatacagccaaagcaagactaagcaaaaaataacaaatctggaggcactagattacccaacttcaaactatactacaagactatagttaggaaaacagcatggtactactataaaaatagacatgtagatcaatggagcagaatagaaaatccagaaataaagctaaatacttacagccaactgatcttcaacaaagcaaacaaaaacataaggtggggaaaggacatcctattcaacaaatggtgttgggataattggcaagccacatgtagaagaatgaagctggatcctcatctctcaacttatacaaaaatccactcaagatggatcaaagacttaaatctaagacccaaaaccttaaaaattatagaagataacattggtaaaactcttctagacactggcttaagcaaagagttcatgaccaagaaaccaaaagcaaatgcaacaacaacaaaaaagataaatagatgggacctaaaactataaagcttctgcacagcaaaagaaataatcatcagagtaaacagacaacccacagaatgggagaaatatctgcaaactatccatctgacaaaggactaatatccagaatctacaaggaactcaaacaaatcagtaagaaaaaacaaataatcctatcaaaaagtgggctaaggacatgaatagacaattctcaaaagaagatagacaaacagccaacaaacatatgaaaaaatgctcaacatctttaatgaccagggaaatgcaaatcaaaaccacaatgtgataccaccttactcctgcaagaattgccataattaaaaaataaaaaaataaacgttggcatggaagtggtaaaaagggaacatttttttacactgctggtaggaatgtaaactagtacaaccaccatggaaaagttatggagattccttaaagaactaaaagtagaacaatcatttgttccagcgatcccactcctaggtatctacccagaggaaaagaagtcattatatgaaaaagacacttgcacatgcatgtttatagctgcacaattcacaattgcaaaaatatggaaccagcctaaatacccatcaaccaatgagtggataaagaaaatgtgatatatttacatatatatataaagcataggggggtgtgtgtggatgctatggaatactactcagccataaaaaggaacaaaataatggcatttgtagctacgtagatagagttggagaccattattctaagtgaagtaactcaggagtggaaaaccaaacattacatgttctcatttataactgccacctaaactaaaggatgcaaaggcataagaatgatataatggactctggagacttgaggggaagggtgggaggaaggtgaggaatgaaagactacacattgggtgcagtgtatgctgctcaggttatgagtgtaccaaaatctcagaaatcatacctaaacaacttctccatataaccaaaaaccacctgctccccaaaagctattgaaataataataataaagttaatcagaaaattattgtctataacaccaatatattatttttattaatgcatttcttttaatgtattgttatttgtcattaattaaattagtagttacactattaagcgatctgttgttataattaattaattaacctccctttatcaattaaattataaagccctgaaggcaactgagtagaggcccaataagtgattgctgaattgaaatgctgaactgaattatacttcattatatagaaagcctcatatatagggcctcacatatacccttacacaaaatataagaatccactacaaatcacttcatcgattaatcaactggctgtactttgtaacaaggtttgcacaaataaaatatctttcaggaaaagtgtaaaatatatttcattaatctgtgaaaatgcaactggaagttttgtggcttcctagtttgaactccgcccaagaaggcaaaacctttatagacccatagtttcccgtctaggtactgctctttcacacatctctaagtctgactagacacattgtaacataagctgtggtcacatgacaggtaggtgtctcagtaacaggcaacaccagtcatggaaaaacaaaactaagtgtccaaatgagtgcagaatcctgattgcagctcacatttactcttaaacaagaggccctcttcttatattctcaggtaagtgactctgtaataagaggattgtgtagcatttacctaacagctttactttaggactgtatactgtccttagatatttttaaaactttttatatttcatttctaaataagaatattacaaaaaatttcctaacatttatataacataattctcaaagtagatagagccaaataactgacttctgctagttttttttccagatatttgtcttttatgtacatggccagaaaccacttagaacttgcataaaaacaagttaagaagcaaaatgtcagttagttcctttctctatcccagagcgcactgtttcattaggaatttttcaataaaaataataatgtagaaggtgtgatttttacagttttcatgtcttgatatatagtgaaattgagcaatgtgagaataaatgtgatctagaaaagaaaaatatctttcgatttgagaacagatggttaataataatcatgacagtgattcaaggttaatgacctacatgctaaacttgttttaatttttaaaagccattactaactgaaaactccctgctttagctgaaccaacacttaacaagtgttttttaaagatgtcttgataccttcagagaagttctcctgctgctagttttctctggagcaacagtgggaaaccccaggtggttactcctttgtgaatataagcatccacatgaaattggttgtttccgcatgcacgggcaaacatgttttgttatactaatgtctgaagtacaaattgttgtagaatcattttattccatagacttccaagtctaattctaatactaacttccatcaatagttaaattattatttatcttctatccaaaggctacctgaaggtcctatcactttggtgtgagaagaatcgggtaagacaaaaagttaggcttgcaccagttatcaatagaatattaagaaagatttttaagaaggagaatagcagttccaggttccacatatttgatacttttcaccagaaaataggaaagacggattgggtctgcaatgtattttcaaagtcaaacttctattcctctatttaatgtatttttacagagatgacttgagaaaacacacatttcttttgaatcttgatgtatatatttttgacggatcagacactcttacttgagctaggtgatctcacatcattatctgttgctatgtgctattgtttctgtagccaaatgaatgggccattggcaatcaagccaaacaaattttgcttttacacccgattttagcattaatctacagacacggcttttcaatagtagaaaagatatctcccattttagtccaaatttaagtatagttaaagctacattttgggaaaaatgttttatcatttttttgttcacttgtgggatgaaaagtaggattaaacagtccattatctctaccttctctaactgcctttactaaaattttaaaatatttcttttgaagaaacaaaacataatatttgccattaaatcttaaaagtatgacaactaaatggatgctaagacaattgtgtttcaactgtgggcttataaactctattgagaaactcatttatgatcatgagttttttccaggatggacatataaagatggatttttaaaacactggcctggagaatagggagagaagaggtaataaaaaagtatttatattacttatatgagacatatctttttataatatctatatttaaaacattttaaagtataaatatttctgtactataatacaatatacagtattatagtttatggtctgtgatttacggtaattactgtgggtcattttttctgaattaattttataagtgaacaagcaaagtgaccaagagaatgatctatgatccagaaataactttcaatgataaaaaacctgaagtacaacaaagaagtcagaggcagggctagacaaaatggaactaaatatactaagaaggtgcagaaaaagaagagaagagtatgttgtggcttaaccccatatttccccatggcagaaggacagaaactaaatctgagggcaactcaacagtagtcaataattatcagccaaatcaatggatgaataggtggatggatgaatgcatggatgaatgtttgtgcctgggaacccttctgtcatcatgcataagcagcctgagtcttagataatactatatgacatgctttcttcatgtgaataaacagacctaaagacaggcactaggagaccctgggaccacaaagctcagattgttataataaaaggagggaaacaaagctccctgttgaagaaaatttttgcacacttgatatacaatatttctactaatgaacagagaaagcttgacttgaaaggacacatttatattagatgtcatccctatctagaggccattactatcaagcatctgtcaggtaaaggagatgagatgcctgtaattttttctttaaatattgttttttctaagttgtgttggaaatggggagttgcaagtttgtatttccattgcttaaaaatagaaaacagatgaagaaaggagatatcatcagcagaacatagaagatttcataatacggaggctaaaactcttaagaaaaagcaatatttattctagtgcccaacctaccatgagaaagttgtgcgactttgggcaagttatttaattcctctgggtctgaagatgagtctgcacacaagagcctataatgatcccttccaacaccgggactggcgggtctgcagccacagttacatctggaaactccactggtgcttttggagcttcccaagagtatcaggaattcaatatgcagtcataaaaaattttgggtcatgttctctaagtacaacactgccatgtgtgtgaagagatatctttattaaaatttttcttaagttgttccttcctaaagtagtgaaagctgagcagatcttagaaattcatttagaattcatattactcaattacacttgactataacacttaagaatctagttattttccttttgtagtaaaaatatattttatttgaaatatgtgaatggttacttagtcattttaatctacatgaaaaatttaaccttaaagtaactctattttaaaaatatgaaatgagactatcaatcggtacttatgaagcaatgtttattcttctaatatagtgtgggaagagaaatgtaaaagtcttgcaacacaaaagggattgttctcacaaatcataggtttgtgagatggggtggcaaaatctcattgtttttaaagaaccaagctgttcttcatgagcaagaacactgaattccctggttttctttttctagtcactatacccctggcatcataacactactgtcaatcaactgcatccagaaggtagaataaaatgccaagtgatactttcggcagaattccagagattctcagatggttttttcttttccctcttaaaaactgtaccatatgagttaggtttattttgaaatgtccatgaaaaagaagtcagatatttcttaaaattggcccctcttagatatttctggggaagcttcatataattccatttgttcatgttattccttttcatcataaatcagtcctctataaagagcttcaaattttcactgcctgatgctactgtaaaaatatacctaatatgtttgatcgaaagacagtagtcaatatatttattaggagaaatactttattcactaatcttaagaaatactagaggaaatccagtacaatctgaagttaaaactaatgattattaaatgaatgttaccattttattaaaaattaataatagtaataaaaaactacaaagtactttcacatttccatttgactctcacaataactctgcttttacacataagcatatatacttacttacctgtatacatgtacacatattatgtataataaccctcttactatatgtaagattcagagagggtaaataacatgaataagaccacaggactcttaaattatgtgctagtgattataattcctacattatttctataggatcagctggcttcactgatatcaaaagattatatatagttatataattttataaagttctgctaacttagtgactttatatgcatttttcaggaaacttgcaaaaacaagaaggtgaataaacttcgaaatgagaagagttcactaagcataatgcatttattttgcatcaggatttttcaacgttttaatttttaattaaaaaattaaacatttttaatagccgacatacatctccaaaatttacttctccaatctttccaaaagaattgatgaaaatgtaaaccaagatttagatgtaaggatgatcattataacattataagaagcaaaaattacagaaaaacattgtattcaaaaacaggtgttgatgaaggtatttactttattcacaagtaaactgaaaccagagagatcacatgatttggtcacaggcacagcaacaggtaggagcagatctgggatccaaatccatgttagctatctccagacatagatctctctccaccaaaacacacttcagaccacactccaactatgggaccaatggtttgccccattgtttattgcctatggtaatgggtttatgtataatcgtgactaaaatcattatccttttaaattgaaagaaagatgggatgggtgggtaaatagattacagcagaaccaagcagtagattgctattttgccacacataccaaatattagataatgaacttcatattaaatatcttctctaggtctttatcttcatcatagctcacaatgttgtatgatgctctggcagaaactaaaaactatgcttgtagaatgtctcatttatatgacaacagaacgactgagtgaaatggagcttaatattaagtctgttaagaggttagggacaagccaaagacagagtgagactctgtctcaaaaaaaaaaaaaaaaaagtaactcagagataaataaaagtaagttctgagctgacatccataaatgctttgtggcattagatgctgctaagagtgaattatttccatgaagccaagatcaagctgttgcacaagctgtacattaattacttgaaaaaaattcccagtagggcaatgtctaaatatatttccatgagaatagtatatatatttgttataaaggtgatgatctagccaagagggtgtctgacctccaaaatatatccactaataaaaaaaatccaaggagcatttggataacagtggttaaaaaaaattgcaaaacagatggacttcacattttgggcatgactacacacgtggccagatcaatcccagtgattcttccatgcaaatatgttagtgtgattagttgattgtaggaaatgtggcatttgcattactaatatgttttgttcttgtcatggttgtaaaaacagtctttacttagcaagtataaatgttagcaagtataaatatgtttaaacataaaaaataagactaaacaagaataaaaactgtttttaactataattatcaagtctacaacccaaaagtctttttcccatccttgacacaataacattcaaacatgatttttaatgatctcgtagtacatttattgctaaattgtactcaaaataatgtttcattttacttaagtggcacaagccccctgtaggtatgattacattccgcatactaattcttcttgagctcactgacagaagtgactatgtcttcttataaaatttctatactcccatgatctagcttagtttcaaccaaataaacggcattcagtttatatttgctgaagggaagataatctccttctagttagcatctatccacacacagtgcttaataacagattgtatcagagtttgctagttgtccaccaaaatctgttctcccttctttgtcagggcatatggctatatactacaattttctgtctaccttgaataaattgtggctggtatccaaaggaatgagaaaggaaataatgtatgctacttcgaagtgggtatggatgcatcccctcagaagacggtggggctgcaacttgggaggagtctgggttcctcaatctccctaagggagaaactcacccacctgccaaaaacacctaccatggacttatgtgaatgagaatcaacctctactgtgtttgagcattttaattgacattcatttaacactatttaatatacagatgttcagtagatgttcactaaatgaattaagtttttgtagtttgattttctgaagaatttgaaacagatcaaatgtatagagaagtttcaagaacagtcaaagagtccctctatccacttcacccagaattcctaattgttaacattttacctcatttgctccctctgcctaacacatggatgtatttgtgcgtgtgtgtgagagtgtgtgtgtgtgtgtgtgtgcgtgtgtgtgcgtatctttttccagcacaatggtgcattaaccctaagtacttcagtaagtacctctctaaagcaaggattctcttctacactaacactgtaaaactgtcacaaccaggaagtcaacactgatagaacactgccatccaagccagaggatgattaaattattatgtgcttattgggtgctcaattgggtgttcagcatgacaagtatcataaccaccataatcatcctggctttctctttcatccaccatctctgtctctctctcttttccctcctacttcctaggctgctgggcacactgccattgacctctgcttgacatctccttcctccccctgtcagcagccttgctcagacatcaaccaccagtgtttgcatgtccccatggcaagaacaagggggaagggagtaggagggaaaattagtaaggacaagggaaggtggatgaatgaattcatttttaatataatgctacgtgaaaagaaatgccagaaagtaacattctgaaaatcactggtaaaagcatccccaaagtctacctgatatggacatttaaattcattaaaaattctgagtttaagaaaacagctaagaggttgagaaatcagagttggctgcccaacttacaattctccttgctgaccagcatcttttggctgcctctcaaaataacaggataaggcacacaaaactgaattcttcacttggattaaatctgaatcttccttctcttattcctttgcttataaaatatcttcctaggcttgagacagtctagagaccacctgagaacactgaatgttccttttgagtatccagtagcataactcacactgtcaacaaggccttacttacgtgtgctgaacatttttatatttttgtatcctttatcacaaaccaaacactgcttagttataaaatatatgtgtaagtcaacataattttttttgtcaaagcaaagatttttctccaaaatatagctacagaagaaaaggggcttataacaagtgtatagtacacattcagaaacattttgtttcatggatgtttcagtaaatgcttcatttctatgtaggaggtataagattcctgctaaaaatacattcccttccctgaatattcacaatagcttgccaaaaattctcacaaatgaataaagacagaactgattaactgtattaagtgtcctacttaatacaataataattcaggttttaaataatttcaacatcagttcattatattaattaatctcataaaaacctcccaattaatgtactatgtataaattttatcaagtactttgatgaattaagaggaaggtaaaggttttcatcaatatctgcaataatattattaaattgggctaaaaggaaccaagacaaatgaagatatataagaaaactaatcattattttagactaaaacaggaaaagaacatagttatctaggacactgtctccttagtttttaatgtttcttccccagatgggtttgcacatcttttgcctgaaaaaagaacttatttccaccacacaagttacattaaatacgtcttttagctcctagggagctgaaaggcaagtccaaaatgaacttttttattcgttatgtcatgaaactataacactgcattattaatacacctctaatcaataaagcctaaaaatccattcccaagagacccagatttctctaccagttctagttgtactagttattctcagcggtaagttttcctagttcttaatattaaaatgagaggtccagaggctctaggtggtggaggggttgctagctaaaaggagggtgtcctacagaaagggacagagtctccatgagcaatgctggatggtacctgtggtccagttcttggcacatggtgagtgctgcctaagtcttggtgccctagacctgcagcagcaatcggcggggaaaggaccatgactttggtgacaaaagtgatggcagaagagtggaaagaggtatgagtgatgactaaggacaaagaaacaagggtagaaggacaattccagcagcagcctatccgaataacaaaatccttatctcaggaaaaccatctctgctatgaatacatacacacacatatattcatcaggtatcaatttaattactgattggaacactgtaaacttgttcaaaatagaggttattattcagtatcttcagctgtccggattcaccattttatagcatgctctctgacattagtgagaatgaattgtactctacatatttaggtaatggtttggtatacagctgctattaacgatttgtgtgctatgcaatatttgtggtctcctgtcacccacctcaggagacacaactgatgtaagtgagacagctcagcatatcctatggaaaaatctcttattaaataaaggtcaatgattaagtagtatagtcattgaattaatttgttttccttaagaggagctctcctcaggtcaaaattaaagtcagggatagataagtctctcatatggttcccccagtgtgagaggagcaagctgttggtttcctttggtggcttttttcttgtctcagaagaataaattaataaattctgcatagctgtgattttgtgtgacaaaaatgaagaacctgtgcctctgtttacaaagcaatgcaatgggaatcacctcccctggtgtctcttccccatcaccaccactttgcccgctgaaatgttcttaaccccacccaccataaaaggtgatgataaattgttgcttcaaactcatgctgattgaaattttccagctatttttaaataacccccactactggatttcttgcttctatgttatatgacaatgcttctttcaggtgaaaatgtcctggaaacaagtaatttttacctggctacctttttttttttttttttttttataaagaaagaagtttaattgactcaccgttctgcatagctgaggaggcctcaggaaacttacaatcatagcagaaggggaaggggaagcaaggcacacctcacatggcaggagaaagagagagcaaaaggaagtgccatgattttaaaccattagatcttatgagaactcattcactatcatgagaacagcatggagaaactacccccatgatccaatcacctcccataaggtccctccctcaacacatgggggttacaattcaagatgagatttgggtggggacacaaagccaaaccgtatcactatggatggtagtatcagggtgcacatgcatctttttttttttctctctgattttctttttttatttaaattctttttttttaaattatactttaagttttagggtacatgtgcacattgtgcaggttagttacatatgtatacatgtgacctggctacctttaaagatggatattgactcctccaaaatgctttcacttgaaaaaaaaaagaagaaaaaaacctcaaaaatgagaagggctttccgacttgaggaaagcaaatctttttaacttgcactaggaacatcacgacattttcttgcctcttagatggtttgtattttggatgcttctgaagagaaacaaagacatatagaatttaaacattatctgtgtttatttgtagaatacttattttttgtattttgttttttaaatgagtatgtctgatatctcatacatttagaatatttgtaatagaatagcaaatttccaccatggaatcagtggagagctatgcaatttaacaactgcaaagaatcttagagatccttagagtaacacatcctcttatttacaaatggggaaacagggtatacgagtagaagtgacttgcctaatccataagctaggggtacaacagggtcattagggccatcctgttcaatttctccctgatatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgttgttgttgttgagacgggatctcactctgttgccaggctggagtgcagtggcacaatcttggctcactgcaacctccgactccttggttgttcaagtgattctcttgcctcagcctcccaaatagctgagattacaggcacgcgccaccaggcccagctaatttttgtatttttagtagagacagcgtttcaccatgttggccaggatggtctcgatctcctgacctcgtgatccacccacctcagccttccaaagtgctgggattataggcgtgagccaccgcgcccggcctcttgtagtttttaaaattaaatttaatccaataaaacatttagtttgcctttatttggaatttgttatctattgttatatactctattaatacctcctcttcagcaaggaaattttcttacatctgcttacacgtacatcatttgttagagcccctaaatattggtaatgatgatgatgatattatagcatgaattactttacgttgaacattggcctaagtgctttaaacacattatttgcctagcatttacaacatttttgtaggtattatttgtcacaattacattttcttgttctatgatataatttgttttgatatcgtattagttttctattgttcccctactgaattaccacaaatttattacattgtgggattgtaagtctgaagtccaataggggtctcactagcctaaagttaaggtgtcggcaggactgtgttctgttttggagactctaggagaaaatctgtctccttgccttttccagcttcttgatgccattcatagcttctttcatgatctggcatcctatacgttatacttattttctgattatattttgcctaacctctgtgagatattaattatttgagggcagagatttttatttgtttgttcataactatatccaggtgccttaaaatgatgcctgacacaaaataggtactcaatcaacataggttaataaatgaatgagcaaaaagttttattgtgcatattaattgttacctgggggaatatactcagacatcttaagtctcatatgtaaacttggggtattgatatcaacatgccattttgaggattaattgaggttatgtctataaatacctactagcatagtgtctagcacatagtatgaaaacattgtattattattatttattaaaatggcattttgttttctttatagcacctgacactatccaaattgccttttctgtttcttttctttttacttatttcttaattgtttcacaaaggcagagtcttgtatgctttgcctctatgtctttagtacctagaatagtgcctgtttaaaagtaggagctgaataaatgtttgctgaattaatattaatcatgtgtaggaaaagaagcttgggaatgttattctaccacccacagctgtgcccactattatgatggttgttttgtgtgttctttctcaaggattcactttcagaactcaaaatggggtgtagggtggtggtggtgccagcagtggggatgggagaagctcgatctctccctacagtagaagtgcttactgctctatgtgttcttcagccctataagaaccaatgaaagccatccacacttccctcgatactggacatccctacatactcacagcagtctgcaaaacatatccaagggcccactgagacactgaagatgacccattgatttaatacatatttgcaaggctctgattgagaacctctggacaggcgcttatctagaggttacagtgtgtgactaacacgacacagtttaggatttatgtaacaggaatatgctatagggagagaaagaacagaagacctcagttgacacggtggaattggagtgagagagatttccatgaagccaagtaaatagtattttggagagtgaaggaggagacatcatccttaacttcaatattattatcctgtgtagattcatactttgtgtattttttacttaagagaaaaaatagtaataatattcgctaggagaaacactttgaagaaagaaataagtccaggagccctgtaatgtacttttcctctatttatttcccacataaaattaaagctgttttagttctcatcgcatttatcatcttgaactcatttgccacattattttatttaaatattccttaacctacagagagtggacttaactgctaaaaagtacttaatacatgttcccaaggaactgcttcaattaccactgcacaaaggtttgtttgtttttaataatacagtattattactagaagtatcatcaagtcatggaatggtcaaaatattcttacttctattgctagggtgttagaaaggactctggactacttgatgtctagatgcagataaaaaaagcagctgttcacttcacataaagtagccgctactgcttaaaggtaagggtaaatcttgttcactgtggatgaaggttactaaagagaaggactaacatataaaataggttcaaatatatacggagatatagacttaaaaaattaagacttctccttcaattaatattccaagaaaagaaactccatattgccatctaaacacagaagcttttctgtaatggtattccagtgaaagtcatttaaattcgaatagaaaaatttaacttgagatctgcccttatgaaaagtggtgagaattcaaatagttctcgaaccctatttgtcatatcacttcctgaaaggatactcaatctcttaatttttttctattattttgtactttatggaaaaatatttaggaagattatagaaagaaaatttttaggaagtagcgtctctagttttcctaaaatttatgtcaaacccggcattatttattttacatataaaaagatcataacttttactctttgttaaaactatattaaaacaaaagagaagcaacccactaaataataattgattaatttcatttggaggtcttctatgtttagtatgtttatggactttttaaacactgaggattcactaattttttttttttttttttttgagacaggatcttacttttttgcccaggctggagtgcagtgatacaatcacagctcactgcaacctcaaccatccaggctcaagtgatcctctcacctcagctaccagactagctgagactacgggggtgtgccaccatgccaggctaattttcgtatatattttttttttggtctaactgtgttgcccaggctggtcatgaactcctaggctcaagtgatctgtccaccttagcctcccaaagtgtgggattacaggcatgagccaccatgccaggcgagaatttgcttttaaatgagaaagacacaatacctgccttcggaaagttccctgtcaaattttagaaataaataattaaacaaagtttataggcataataagtcataatattcttgaaaagatatgcagagggttccaaaggagcaccaaccaaccagaggggaaaatatgggggcaacagagaggcaagaggtgatatgagagagaaagcctgagctagaacacagagccaggtcatgaatctgaaggcaggaacaactctgtcagctgtgagacatgaatttggaaggctgctgggagagaaaagcagagattagtcgtgcaattatctacttaagatattttgggctggaagcagtggctcacacctgtaattccagcactttgggaggctgacgcgggtggatcacctgaggtcaggagttcgagatcagcctggccaacatggcgaaaccccatctctactgaaaatacaaaaattaaccaggcgtggtggcagatgcctgtaatcccagctactcaggaggctgaactaggagaatcgcttgaacctgggtggcagaggctgctgtgagctgagattgcaccacggcactccagcctgggcaacagagcgagactccatctcaaaaaaaaaaatatatatatatatattttgaagtctagagatgaattccagaaataaggtatacagaaagtgaaactgtaggactttgtgattgactagaactgagggacaagggagagggaaagggaagagttgaagatgatggaaacaatagattacaggaagaggatcaaatttagggggaagaagatcagatcataatcaatacaacttaattccacatgttctgaaagttaaatatctcctctagccaaaagacccttcctattttacttctctggacctcttaatgtttctttgatgtttattcccctgcacaaataatttaacccctttacagatccaaaattttatagtaggcaaatattgtaacccccttgaaaatgtatgttatgaatagcctttgtaggtgatatttttgcagtttggtaacttaggacaaggtccattttcctgtcccttgttaaatgtcacaagacttcatcttctctacctatatatcacaaagtaccttctgctctgctgatcacaaggtaattaagttttggagtggaggagtgtcttaggtttatgttcatgcattaaatataaagaaatctatgatttttaaaaaattaactatattgaggtataattcacttacaatcatatgcactcattttaaatgtacatttcttgagttttgatgcattaataaacccatgtaacgaccaccacaattgagaaatcatatatcttcattattttccccaattttcctttgtgcctttttctagttaattccttctccttctcctccacctccaccccagccccatgggggtagccatgaaggtacacctcttggatcttttctctccaattagctgccaggagtgctattggcctcctgctgcagcagcaatgggatccaccacagcacaggaacccagactggcctccagccaatgactgggagcagcaaggaaactacagcccagacatgtctgcctaatgcatgactcctcaacaagtaacctttgttggaagccaagactttcttgtaactgcactgtaatctgtggctattcctacccaattctccttccttctgcctccctttgaagtgatatcacaactacattgtggtttttccttgcctggtttttctcctgttctctttctacctttcatagctattgcctgcaataaatctcttgtggatggttgtaattctaacaccatcttggaatcagcttcctgaatgactgaactgatgcctctacctccagcaagcatggatcttgttgttaccatggatgacatttgtcttttctggaattatagtatgtactgatttgtgcctggcatcacacagcatgatagttttgagattcatccatgttgttgaggttatcagtagtccattccatttttgttgctaagtagtattctgctgtatgaatacagcacaattgttgattgattattgtgttgttaccagttagagctattaagagtaatgctatcgtgaataattctgtacaagtcattgtatgaacatatgcttccattaatcttaagtaaatacctaggggtagaacttacagatgaagaaacagaagtacagcatgtaagtgactttgcacaagtaggcagcacaggttttctgactttaaatctatgctcttaactcctatgccgtattgttcttcatgggaagaaaagctatttttcttgacccatttaaactttccataatgtttaatcaaaatattcaatatttaagttaaaaacagcaaaatctgggatacaaggtgtaccaacctcaagtaaacatgccaggtgtttggaaaagtagaagaataatgaaccttactacatgcaaactgtgcaatagttacatgtagaatgcatctcaaaaaaaaaaaggttcctggaaaccacagtgctatgaaaagataatcatagaaaacaaggataaatttgaataccacatactcattttaagaaaaattttcactgagagaaaaaatttaaagcaagttgatggcatataaacatccttgaaattcttcaagtgaatacaaattagttgagttaagcattcagataatttgggtccttctcaggtggcctagcaagttagtcaaaagataagacctgtaatcaagctgccctctctcattaccgtcgttaaactgcataggtagacataataatcgacttgaataatgtaccatcaaacaacattaaatagtctatcagatcacactgcttatagtacacattaactactcatatgctttactatctaaagcagggttgtccagtcttttggcttccctgggccatatttgaagaagaattaattgtcttgagccatgcataaaatacactaacactcatgatagctgatgagaaaaaaacaaaaacaaaacaaacaaaaaattcataatgttttaaggaagttcacacatttgtgttggatctcattcaaaaccatcctgggccgcttgtggcccatgggccacgggttagacaaacttgatctaaagcaataccatccattataattattctgtgagccaattatgtaattttaaattttctagccaccacatttaacaaattaaaaagaaccgggtgaattttatattttatttgatacaacttattcaaaatgttatagtttctacatgtaatctataaaaaaattactgagaaattttatgggtttttttcataatatgtcttgaaatctgttgtgtattttacccctatatctcaactcaggctagctacttttgaaatgcttgatagcaacatgtgtctagtcactatggtattgtacagagtaggtgtagagatcaacaggaaacatttattgagtacctatataagaaattatactagataccagggaaaccaaaaagaaaaaaagtcatctgtaagaagtttagcaggagcaacacagtgaacagattccagcagagattatggcagagattactgtgatcttgggcaaaagtgtgtatcttaggaatttaagatttaagaaagaattttaggcatgaactatatgacaaacatacataaaggcaggagaagcctgctatgctctggtgacaatggatcaaccagtattagagaattcacatgatagatactgaatttcctggatgctcagtggttagctaagtcttaagtttatgaatgaacaaatgacacaagatacaacattagaacgaggatggagaaaaaatataaaatctttaaaatatcagtcaaacgacaaattccagcttcttatgaatgaagagccagttaaatacgtttgaatgaaaaatgacgtgtgaagtgatatatgtggcagttaaagttaaccaggagagaaagctaaactaccgctgcacaggctcagcatctattgcactaatctaggcatgagttgtgtcctatccaaaccttcataatggaagagatgggggagagaatgaaagagagattggaaaaaacaaggatcctaaaatcatcttatggctaaatttgagagggagggaactatggaggcatcagtgatttatatggtttatattgtaggtcatgggaagtcataagaaaaattctggtgccaatggtgataactgatatgaagggactccttgcttgaaggaaaaattaagttaaactgagacctgttgaaatcaaagtagtagtgtgatatctaaataaaaatgtgtagcgtgcaaagagaaatatgagagtgtgtatcaggcaagagatctggctagaaatgtaggcaaagggataaatagtcataagactataaggcattgcggagggaagaggaaaagcttggagaatgagtcagaaatccacacaatagattaaagatttaagttgtgagaaagtttttatggagagtgttctggggaataaattagagattaataaaagaataaaaaatcaaccaggtagaaagggcatgcatcctggtgtgtgcaaacatgtatagctgcatgaatgtcaagtttactatcttacgtggctatatcactatgcaaactatagcctttcatagtacgtaagtgaaagcattagaggattatctgtgtagtcctaaaatcctttgtgaatacatcacattgtcctattacattcttgcccatgttttacataaccagactgactgtaatatgagtattgtgtgtgccctttgttaataaatccttgtataaaccccacaaggatttctctaaagacaaacctggcttgctaaatattactcactccaggctaaattttaataaattccataaaacactatcagatatattcctgagacttttgtattttaagtgctgtcttttcctatttggtatttgcattggttacttttgtggggtgtgctggtttcttccttcttccccttcagacactccaccccactcctgcactgtgcctggagaagatgaattgtactgactacaccacggtttttcaaccttggcagtaatgacattttttaactggatactttgttgtggaaggatgtcctgtgcattgtagatgtttaaaaaaatccctcagtgaatcatagtagcactccactcctctcccttcctcccctgagctgtgataaccactaatgttccctgggagcacaattggccctggattagaaccactgctacatcaatgcactccttttgtctacgctgtgagtttggccagtggaaacaccacaaagaggaaacagggagggaggaaagtaaggtcaggtgatccattttccagatattgactattctcgccctgctaggccagtgcaggcaggtggtatcagtccaaagatcacacagctcaagtcaggcagccgtcttcacataggacttgcttggtcatctctccttcctttctccctctttttctgataaatggtaatctccctgttcatttagttcattttggcctagtggttataacggtgctcgctgttgccatcctaaagtattgcactattccgtgtgtttttcctaacccggtctaaaccttcgtaattagtccctttataaagtctcctccaactaccaaatttgtgtgcactgtttgttttcagcaggagttataattgatatgatgtaagtacatatcaaagtatttacagaaaagcaaaattccaaatattgagatgttttctctgtattggccccaatcattggaatgttttgtgcatacaactttataataatcactgacacctatattattttcatactttgatttgctcaatgaatgctagttataaaaaacaagatcatttaaaatacttccttgcctttattattctcaggtgaaatggagatatgaatttataataaagagtgacaagttagtggaattgtaaaataacattatactcaaaaaagaagaatagagattgtaaagaaatgagattgagtccgtaagtaatgtataactgtctcagtatttcattgtcataccttataagtaagcagggaagtacaaatagatgtgtacttattaatttagtctttcagtcactcattgagtcaatcaattcttgaggccaattgtttttgaaggcactgattgtgctagatactgtggatgttacaaaggtgaataaaatgtcttaatctgaggaagaatttacaatctacacaggcatgaaaaaacaaggaagagtgtaggtgaaagggaaatttgaatgtgaaatcaccaaggtcacaaagcatgtctcctcagtgctagcgaaggactatataataggctcacaaaaatatttgtttaaaatgtaattaaatgaaatttgaagaaagcagaaaatgtctcacaatgctatgtggaagttattagaataacacccccttcccagttcctaattgcattcctggcatatcttatgtacattaatctataattaaatgaaacattaactgctttattaatggctactttagaaggagtgcattcattaaggattattttgaaatacaaataatttccccataaatcttacattcacatatttggattctgagttttacccaagtggcacacaaccataatttgtaggacaggtgaaataaagttcctactattctggtactgtatctagactgagctttacatatttttaatagctttttttttttttttttgagacagagccttgctctgtcacccaggctggagtgcagtggcgtaatctcaccctactgcaacctccaccttctgagttcaggcgattctcatgcctcagtctcccgagtagttgtgattacaagcatgagcaaccgcatctgtctttcttttctttctttctttctttctttctttttctttctttctttctctctttctgtttctttctttccttctttctttctctctttctctttctttcttttcttctttctttctttcctttctttcttttatttcttctgttctttctttcttttctttctttctttttttttttttgtatttttagtagagacaggatttcaccatgttggccaggctggtctcgaactcctggcctcaagtgatctgagggtcttgacttcccaaagtgctgagattactggtataagccatcacacctgaccaatagcttgtatttttgaaagaagttttaggtttgtggaataattgtactgagattacagtgcattcccatatactccattacccttcccccaattcccctattattataattttgcattagtgtggtacattattaaaacttatgaaataacattgataccttattacaactaaagtccatagtttatattagaattcactctgtattgtaaaattctgagttttaacaaaggtataaggtcatgtatccaccatgacagtatcatagagaatagtttcactgtcctaaacatgccatgtgcttcacccattcatccctctgcactttctcagagccccaggcaatcactgatctttttactgtctccagaattttgtctctttcagaatgtcatatattggaatcatatagaatgcaacctttcaaactggcttacgtacctaagttttctccatgtgtttttgtggcttgatagctcatttctttttatcactgaataatattccattgagtacatgtgccagtctttttgttcattcacctattgaggaacatcttggttgcttccaagttttggcaattatgaataaagctgctataaacgtgcatgtgcaggttttggtgtggacacagtttacatttcctttgggtgaatatcatgtagcatgattttggatcatatggtgatatggttaggctttgtgtccccacccaaatctcatcttgaattataatccccataatccccacatgtcaagggagagaccaggtggaggtaactagatcatgagagctgtttcccccatgctgttctcatgatagcgagtgagttctcacgagagctaatggttttatgtgtttggtagttcctcctgcattcattctccttcctgtcaccttgtgaagtaggtgccttgcttccccttctccttccaccatgattataagctttctgaggcctcctcagccatgctgagctgtgagtcaattaaataaacctctttcctttataaatttcccagtctcgggaacttctttttagcactgtgaaaatggacaaatatatatgttaagtatagtttagcttcgtaagaaattgtcaacctatcttccaaagttactgtaccattttgtattgccagcattagtgaatgaatgaaagttcttgttgctccacatctcaccagcatgctgtgctcttggtgttttggattttagtcattttaataagtgttttgtgagctttactgtttgatagctgagttacaaactggcaagtatccaagcaaagaacagagaactggaggtttgcttttctaccgaaggaaatatgttgagaatacaggaaagtttcacgctaaatgtaaataattttttacagttaaactaataatgagtgattgaaaaaagttgacttgtgacatacaaatgatacaaacctttcattgtcctctctttcatgggtattaatatttcatttgataaagatttaagtactaatgactatcagtatctgttgattgctagcaattttgagtagaacactttttctgatatgtatgaatatatagacaagaatcatatgatacacctggattgtgtaatagcctttatgatgcagtaaggcaaccactgaacttggaatcagtgaattacaatttgtttcttctgggtccctcactagccctgtgactttggtctatttgacttctgtgagcctcaaaagtgcatttgtaaaatggaaattaaatttttttctgcccatcttactgtgaagctgttgtaataataatattgacaatagcaataattatactaataaaaagcaatttactgtgtatttgaaattatgcaaacaatttgaaaatcatagcactatataaaatgtaacgtcacattagtgttggagtttacaatttggcagggaagctgtacaactaaccacggcacaatttgataagcaataaacttcctttagagtatacggagaaatggggaggattataaatattaagcccttttgtgccaggctctgggaccacaattatcccatgtgatctccatcacaccttgcagatgtaaattttcttattcttattttatacagatgatgcaactgaagaacgaagcaagttgtccatggtcacacagctaataatgatagtattttcctattcctcatagaaaactggagacggccacattatatatccttaactacagggaccatttctagaaatcaaatttctagaattcaagccacaccacatacaatatattaccccatagcttattgataatgctaaaatatgggatatctttgcatagagatccttaaattgtgctagaatatgagatctttttgcatagagatcctctcgcatagagaattcctgctactcaagaatcaatgttagacattcactctgtgctcacagtgttcttttctcttctgtcaaaaaaaaaaaaacaaacaaaaaacaaccaccttattttacttgtgaccttcagtaccaagtaagactggatagaatatcaagataaatttgcgacagatttagtgtcctttctgtcgcattatcatggttgcccagaagttaagaggtttggaatgattccagtctgataaggagaacaagacattgaagtaagtgtctggagtctaaaatagatctgggatagctattactttagcttttctgagatttaatatgggaatgaggtgtaaaagaagagttgaaataactattacacagagatgcttgttccttcttcctaaggcctaagaacatttctcactcattcttctatcctagaattcataatggtatatggcactgcacagaaattcattaaatgttagtgaaatattacatgtgaaagaaggtagtaatgtaaatagaacctaatataattttttatgggctcatttatgttctgcattttcttataaaattactttttagattgttttgctgctcgaatcattactggttgctatctagggatcaccttcaaacccctttcaaaatacaatgttcaaaaaaaataaaaacaagggcctggcacaatggctcacacctgtatcccagcactgttgggaggccgaggcaggagaattgcttgagcccaggagttcgaggccagcctgggcaacatagagagacgctatctctataataaataaataaataaatatttttggaaaaacaaatgctgttaaaatgcatttctagcttaggtcacataaaggatctgaaatgggcatgtaaacaatggcaagtttttatatatatcaattaacaggtcttgaaaaaagtattgactctactggcttgtgtgaaatttccctgaatgaaatcagacaatggtgttctcagaaacaatgcatcttagaagagttaatatcagccaaagacattatatcatactaacttctctcccaataaaatgcctagaaaacaatgtatctctaacaagaaaaagttcaatgctgtgttaactggcaattccatttaaaatattttcaaacacattccctaaggtaacaaatataattattaaaagcctaataaatcttttaataatccagaaagaaacatttagaagacattaagaaagacatattcagaattcagacagaagctcataaaagctaacataaaaagcaggttaaaaatcaatttctacaagaaaaatatagacatataatcaaacaaaagggggaaatacataacaaacactagacgaatgcaaattttcaaagctatattttaccaaattttaaaagttaactttaaaagaagaattaaccttggtggcagcaaaatccatgtctgtgtgtctggctgatttgggttcaattaaaatcttgggtagagaacacttaagtgaaaatatagggcaaaaataattccatacaaaatataatgaataaatagagcaaaatttcgcatataaccaaattccaacattttaaggaaggtattaatttcaagctaatatccaaatttgtctggtaagaaaaaggtgagcatgatccctatgatagtggttgccattacttctacttttgtgaggcagaataggtgggacagctctagggctcttctgattttattctatcaattataagaggtctgagaacaggaaatgaaaaaagctatgaccctcaagccatctagctcaaacgatttcactggcatctaggatctgatatattttggattggggaagagtaaacacaggcaaaatttgcattggatgtgaagctaatggcccttccacataattttgctgtaggatatcaattgattccctgtttcagaggaaggattgttaagctaaaatggtttcaaccagatcaaacattaaagtaagcagagtttttcagtagatttgactagattcttcatttactataaagatctgccacacccgaaataccacctgaaattagttttctagttaaatcagtatagactatggataaaagaagttacgaagacaaccctcttaatcttgatcaatattcagagatgactactccccatcacaaaagctaattcgtttttcacatttttctctgctcctaatgaaatcttttttgctgaagtttctgaagaaataaataaagaagcctggtgcctctcagagttccacacagctgatgagtctaggcagtgacaaatgacactatattcctcagcgtgcaacctttctctccctctcatcttcttgcaatggaacactgctacattccttgcagaggaaacgtactgtacatttcatagctgtcaccttggcataaaaggcagagggagggggaaattcttcttttggtctgcctaaacattttactttattttttatatatcaataaccatgagaaactattgagtaagtttagatataaaacagagaactttgttttggaaggcattacttttcaaaggaaatgcatcgtggagagtgaggagtgaagggtcaatgttttcaagagcgatcggaagctccctgccttgatattcctaatcttctttctggcatcttatgctcaccaactgcctaatagtggatgcatgtggttctgcccatctgtccaattgccattctaaattatgtggtttactaagaaaatacttaacattatatgaataatgtataattaattataagtagtttttaaatcttcaagatttatctcatgagtgaaatggttgctttgttcttaaggagaaaattaatttatttcccacgtatccatgtacaataagtagtgctgttataaacatataagaaaatgagctatcatgataagtatacagcatagagttaagtttattagaataccctcatattctataatatacaaaattactaacgtgcagtgaaatcatatagaattctgaagtagtgaattgtttccttactgtttaacacattcttgcagtttgtctttttaaaattaaaatcaggaattctgggcagttagttgtttttgaagacaatgtcatttatctttgctttaagaaggaaacagtctacatttaacaaacaattcattttctacatattaattgagcagtgaaaatatggttggcaggtctgaagaacagggaaaaagacagtgtagttagagtgtagttggagggtggcatacaaggagaaaagggataggaagtaagaagttactgaggtccagataatgtagggcctttaaaacacagtaaagatttgcatttcattctatgtatgataagaggtcactggatggttgggagcagagggggatgtgatctggtttctttcttaaaagaattattccgactgctcaagaatggactaggttgggtgtctaagtggaagcaggcagatcagttcagaggttagggaaggagtccaggtgagaaatgatgaaggcctagcctagggtggtaacagtagagaagggagacatggtaagactggggatacattttgaattacagtgtaggtaaaattattagcttaagggttagatataaaaggtatgaaaggaaaaggatcaaggatatgtatggtatatctgcaaatgctaggagaccaaagtgaaatttcacatagtgaaattactgtgtttcagcagttagggataactttttggagttctggaggcttgggctggacttttttgcatggataaaattcagacaggagacataaaagccttcttagtggtaagacagttattagataattgggaagtattttgaagatacttgtctacctagaatgaagaattttgttgagtatttgagagctatatggctgaaaagaaagaggccagataaaacaaggccctgagtaacaagagtaggccttgggccttgattctatagagagtgcaaaaccactggctaattttttgtaactaatctggctagaaatttccagatttccagcacactatattaaaggaagtactgccaaaaaacatttcatggattccaaaaatagagatcaatgtagatgaatttataagatgaatgaactctgggaagaccaagcagatttctgaaacaacactaccatatatttcattatatacacacacagctacacacacacacacacacacacacacacacacacaccataccctgaacataccctacaccctacataatacttatatatacacgttagtgctctgcagttaatttttataaaggcaccaattagtttctaataagaaaaagaaatgtgtaaagaagagaagaaatttcattctctccatgaagaataaaaaacacaaatatttgttagctgtaacaaatatacatttttttctcaaatcatttcatgatatttatcacatgaaaaatgggtactttggggagattttctcctaaagccttcattttttcatatatagtgagatctaaacaaccaatttctatttacagttgaattctacttccaaaaacatacaactatgactcaatccttgttacctttcaataaactgttaagcccaaagatataacttattttaaaatgtgaacctagacatttgggatgatcaggcatgctagttactattaagaatagcagtatgtactaataaaatggtattcagagattataagggaagcactaatgaataaaaatgacccaaactatatataaagtctttgttcatacacaaaataaacacatgcactatggatggggttctctaacgacagtagaagtaaacgggcagctaaagagtgtatcaaaaactgcacttttacagtttcctatatatcgtcagacaggttaacaaaagtatcgaaaagttggcatactgtggataaagtacattaaaatgagaaaggcaaagttttaaggatatatgaaaatgaaaggatggcaactagtatggtcgaaattcatgtgataaatcgtaataaccaacgtgatagtattaagtggtggggccttgcagaggtaataaagtcacgggggcagagccctgacaagtggaattggtaacattatgaaaggccttgagggagtgagttggccctttctatctctctaccatgtgagaacacagcatttggccctctggaggatacagtgacaagacaccatcttgggagtagagaaccggccctcgccagatactgaacctgaagacaaatgccttgatcttggagttcccagcctccagagctatgagaaataaatttctgttgtttgtaaattacccagtctcatgtattttgttataacagcacaaacagattaagacaacagctttctcagagcccaaaacatttataatagtaagaatttgcaaaatcaaacaatgagtaaggcctcaaatgatcagctgtacttgctaaaaatgaaagaacaactaaatcactcaattcacttgggcaagacaatccattattcgtctaaaatttttgttaataattttctgatttactatctaatagtactggataccatacaaccaattactcctacaaatttttttgttaatagttctctgttttgctttttaataatactggataccaatactggatatccaaaatggtttgatagttgggaacaaaggggataaaggaaagaaatgtactataaccagagatttttgaaaaataatgagactgtatgtactatgatacttcactcagaaaacctcacttcaaacttaatgggaagagaaaaagattggggaagaagtcttcaagcacagtccataatattgatagatagactcctacacatattaatggttgacagctagatgtcaatgcctagagcacaacaaataggtcttatatatcactatattttttatgatgcttggcattgtattttttttgtttgtttttgagacggagtcttgctctgtcacccaggctggagtgtattggcatgatctcagctcactgcaaactccatctcctgggttcgagcgattctcctggttcagcctcctaagtagctgggattagagtcgtctgccaccatgcctggctaatttttgtatttttagtagagacagggtttttccacgttggccaggctggtctcaaacacctgacttcaggtgatccacccgccttggcctcccaaagtcctggaattacaggcgtgagccaccgcaccaggctggtgtagtattttatacacagcatgcatcaacaaaatggatcagatggatgggtggacaaatggataattgaaagaataaatagcagaaatgataactctaacttttaagagtctatcaagctaaaatgacttttgaatcagtcgaatgaatgtacgtgggaactgggaacttaagaaagagaaggagcataaattgcaattgtggctaaagcagcagaatgcttatttacataagttttaaccagtgcggaatattgtaattaccatttatgttgtttttttatgaatccagtacatgcttattaaagggaattggagaaaataaaaataagaaaggaacgcaataatccagactgtaatctaggacccagtaatagttacttagttgcaaaatttcctcaagggcaatatgagagagaccattttgtgcttgttgccatgctgggggtgcctactggcgttaaagaggtaaggcccagggcttgtaaacatcctacaatgaatgagagttctccacagcgaagaattacccagcccaaaatgcaaaatgggcttcactgagaaaaactgagtaccttgtgcatttattccacgtctttatatgtacataagccacatacaggtttttaaaaaataaaaatattatgctgcacaaactgctttgtaatttgttcttttcacatactgcaacaatagcatccttccacaccattaataattattctacaacattttaatggctgttcagcaaaccactgcatggatcaaccataatgcatttaatgaggtccctatgatcaaacttctagcactatttttttcaattttgttttataatcaattctgtgataaacatcttcatatttaaacttatgatcatatttaaattcttagacatgcgactggtcagagcatgcataatttcaatgcttttgatagacttccaacatgtcctcaaaaatgacttttattagtttattctctaaccatattgttctgattgatggacatctctaacataaagttgctgaaaatatgaaacatcagctgaggcactgtgaccctgggaactggctggtcccttcctagcccacatcttagtagaagatgcaagggttattgtggaatacgtccgcgggttaaaaaccatgtatcaattctaaattccaagtgccagaccctttcattacctttcattagcgaagtataaaaagaaagagggagaagggattttcaaggaaagtaataagaagggaagtattagtggaacattagagtttgtctctggtccttcctctgagtggggactcatgaggcttggtgttgtctgaaagcaggaaggacttgggtcttactccctggtaggatgcagcctgaggagcaaggccggcagtcacagtgtgagcaaacattcatacagacgtgggggctgacatatcaagttggagaatgtatgctcacttcctgtcacccccatacaccctgattcccaagagttgaggcagttgtggtaggggttcttaggtttcccatgggctcagattaggcctcggacggaagtgaaggcagtggctggctgggtgaaatatggcggacagagtcggtgagtaacaggagagcatgttatcccttttagacccctgaagtattagagaggatcagccaggcacgtttagaccatatgatgtatcatattgtagattcaccccaaggcatttgtggctgtgcagtaaaagtgcaggatgaaaccagactctctgaagggtagggatattcccgtccctatccctcatcttttccccctttgcagataaaccatcccactttcaaatgaacttgggaggagggggctttgaactgtgcttggggttgtttctcctctggaaatgcttccattctaaaaagttctggcatagggaattggcctaaggaaaaactctgccctccttccccttaatggactgtcctgcctttgagtgtgagtaaaaggggctgagatcattcatcagccaattttacagctgcaatctacttagacctgcccccatctaggtcaccaaggatctttgtcagcatttggtacaaagcctatgtgaatgaagatggtcatttctttggtgttgtcccaagaaatgtaacagaaaatgactataaaagaatggattctgatatgggatgctgagtcctgataatctctctaaatgtctttcatctaggacctgcaatcagccattattaagaaaaagagaaaaggattgcaggggacagttccaattaacctgtggcatcccaaatctgtgttttactgaacacctagaactattctccatgggtttggcgtcaaagaggcattaggaaagatggtaactattcctcttacatacaatattaaggcctttgagatttgcttcagcttaacagagatacttttaaactttgttaatttaaatgtttcccaaaattatttgagcagagaatccattctaattataccatgtgcataatactcaatggaatcacatgactttggggaaatcagaggaaaactaatagtgattacattttatttagctaaataaaacggcatgttcagtgatgcttttccctctttgtgttatacaatttacttacttaatatcatcaaactacaaaggaatatggaaaagattttctgtgatcatgtatcgacacacttcttagagaaaatgtaagttcttggcaaaatattacaactgtataatgcactacaatttttaaaaatcttttgtctgcattatcttatttcattcacactccaaccctgggcagttggctggccagttacagatgagtagctatggtttagaaaggttacatgagttgccagggatctggcaacgcataattgaatacattgtcttaagattcaagctattaaacacagactgaaagcattttgaactcatttaattcaacatttttatttcacagataagaaaactcatgcttagagaggggagatgacatcatccagtagagtgagagagagaagaccaactctctgttccctgaattcaagcccatgccctccacaccatgccatgttttccctgtatatgaccaaacaaaatggtgcagttaaaccacgagccgtcatgcacaggagggccagctggccatcatgctggatcaaacagcagatatagaccatctctagcagaacacttgtgaattgcctttgtttcaaactcataaatgttagtatacctttgtaggaggactaccatgaaagatgaattgccactataagcagtcattagtatttagtggagattaacttttaaaggtgcctactttagatatgtcataatattagaaattaaggatgaagtatttctatctatctatgctttgtaggacaattatattaatcccaaagttacctgacataagtaggaagcacatgcctcttctgatatatagcaaataatatatactcaatccactgagcaaaaattggaacctcaaggcaaagctgtatgtacaacctcagaaaatctgtgtggcatgaaataccgtaacgtacactgaaagggcaattttcgatttttgtgaggattcccaatagccaaatagaaaaaaagtgtgtatacatgtgaattggagatgacttgatattaaggattgtcagacttatgtcaccccattgtaagcatagatagttaaaatctatttgatttcattaaattaaaagtgtacattattcatcacaatccataatgtaactgaattcattcctatgaactgaattccaattagatttatcatattgttgttgtgaacaccagagaaaagtaggacagtcccacatctaagcaggaagataaaatatatatccgttctttatttccattttttcacttacttgttcaataaataatctatttattcaacaagcataatttctggctcagtattctttgcattagtattcactatgacattaataagaattaaatgctactttggaattttcacaagtaactgcttagtgattccagaatcacctggtagaaggggatatttaaattgcaacttaaaaatccaaatgttgttaaaagttttaataaaatttcttataaaaattacttcatatacgagttgacaaattgttcattttctccttgtagaagaacaattaaattgatgagatgtatcatctaactctcatacacgtaattatatatttgcatgacaaatacaattggcatctcatttacctcatttctgtacccttgaatatcacgtaaacatattttgtcctgatttttaaatactttgaatagtttgagaaccaaaagacctcttttgacaatttcctcttgataaagcaaatagcatcatcaatgtctccctaaaacttaaaagctaacagcctatgcttgaaggggcagaaaagtcaagttatttcttactttttagggacaaacaggttgtttatcattgtagttggagacaagatatatggaataatatataaacacatcttatcctatttatgcccgtcacctaaacatataagtgctatttttccaagtttattatcaaattacaaagtggaaatatggctcagatggtagtagaggtaaaaacaaacctaagtcatgtaagatgagtaagtctaaagatctaatgtacaacatgaagattattgttaataatattgtagtgcatactggtaatttttcaagaaagtagattttaggcactgatagtaaaaaagcaaagataaccatatgatgatgggtatgttaatttgcttcaatgtaggaatcacttttatatacgtgtgtatattatatatatatataaataaagataagtatctcaaaacatcatgctgtacaacttaaatgtatacaattaaaaataattttacaatacaactaagtttgaagtcatcctacatttaacagtatctcattaatgaaaccagcaaaattatcatgccatctttgcaagtgaaggaatactaacaatagacgttagcacatgcacagtaaaaatgggttcacagaagtgtggtcattgctctcacgttgcagtccacagaattttaagctatgttaaacatttatgaaggaacaagggaagtgcacaaatatgatttaaacctatttgttggtgtaacgtgatgcagttctatcccactcatcctataatacatttctttgacaaacaaaactatcatcgcaatcagttctttgaatattaaaattggatgtatagtcatgcatatgttgtgggattgtaatgcttacagactattaaccactgatcctaagatttgggtggaagtatttgtctctatatctaagcagctaaaatatcatggctactatctgtgcgtgtatgtgaggtaatttcagtctactgacaaaaacacaatttaatgtatgatatttattgagagcatcagcctctctcatttctaagataaatctctttttttccatgatggatatatacttgtaacaaaccatattgttctcagagaccacagctgctccctttttcccagggtaaatatgtcagtctcccggcctgaactgcccatttcttgaaggcaggagccacccatatgttactcagttttgtatttctcatggtgcccagctgagtgtctggcacatattaagtactcagttaatgatttttaatgaaaacatagcagtaagcctattttccttataattttatacataattacagagtactttcccacctagaaccttacaggattaagggtcattagaattcactattcatccatcttgaacccagtgaaattttgtcagatacaaagaaaggccataataattgtgtttctaagtggggacagtttatgtaccattagtgggctctcatatgagtgagaaataccaacttttacataccacattgcaaaatgtcactgttacatacctttagaaacaaatcaatcttaaatttttctttaataatcacagtatgctttaatctaagattatagtgccagtaatagtatatgccactcgaaacacaaatacaaatcaggcaattcattgtgtctcaaagcttttaatttaggtctaaatatacctaatagtcatctggttatcttctgaagtcaagcacaaggacaagaaccaaacttttaattatttgaggcaatgtattatattaacaattattagacacttaaggggaaagcttactataaattaaaatatttctccagtcctgacatctcttattactaccttgttataaaattattttaagattatgcctgtgacctgtgtgtgcttcttcaaagaaatctgaaatgttgcctgtgacctgtgcttgtttgtgaaatcaacattaaatgattcagctgatggcaacatacatcatctgattaatcatttaatcagagggtccataacactcaagtgtttaaaaataaattttcatgaagcccaacatgacagccatagtaagtcaaaggaaatgagtaaaaggatacttagatattatattcacaatgtcaaacctgacattttaaaacctgctttttttttattcatctagcacacaactggctagctatccttttatgaattaagtcaggattattacagaatatacacgtgtcaatccatttgaaatcaagatttaaaaaaagttgttcataatatattgatgtaatttttccaaaatggcattgcttaggaacttcattctgattttgaacaacaataaataacatcgctgaacctggatgttttaagtatccaaggcaacagacatttcaagcttatttcttgcgtgaaaactattaatcatcatgtagataagtcgtgtctcaatgggatatgataacgaagctgactgctgtattatttgtcaggcagtggcttcacagtttattcaggacttttgctctctaaaactccagaaaattacaaaaatataaaaacttcaggatccaactcttttagagcattccatgtggcatgaaagagatgctcattagttcagcaaggatttatttgagcaccagccacaagcaagacactgttgaggagctgggatagaccaagtgttctagtggctactccacactgcacgcatagtagcattacagaataacgctgattcaagtcactttctttgtacaatattcttagaacaagcagatctttcttcttcaatagaagtaggaaatataaattttctctatataacatcactgttgctttgcacttaaaatttctgcctgtgcacttttaacctgtttctactctgccaatgaaaggtatgaacttcaagaaatgaattgtatgactgataacttcttatgtgcacatgagtaaaaatatggatcaaaagatctattattctaatgtactaaacacaagagttaatattgttctgtaaaacaaaatcttataattcaagataactcatttgtcctttaactagtcttatacttagaaattattactaagggcagctacattcatatgatcaaattaacaaaacaggtatctgctttgatttactctcgatttattggttgttcagaattatgtcatttaatttccacctatttgtgaagggagagggaactttccctccctcatcaactagagggtgatggaccagataccctcaaagggcatgaaaggtgaaaaccggtgccattactccctttcagtgttcctgatcttaaaagcagagccattaatccacttctacaagctagacatccagtacccctacttgtcacatccctcttcctccaagtttctggcacagtgtgagcaaacattctttcttgaatgatgaatgagtgtctcaatgcagtcattaataagcatttcaagcaaaaagagtttgcttatttctatttaccagggtcattttgatcaaagtttaaaaaatgaaataaattatttcaaagttcataatgaacaaattaaatactttcattgaaaccatccagattttttagcatcccatagatgtgaccacaattgcagacatttattagagtattctttgaattattatagaaactcagaactttattgctaaattagacttcaacaattttctagtagagcttcctcattttatgagaaagacttttaggagatctgcgaaaggttatccagtcaggtggtgtatgagcagagaggaagactagccattttcactctcagtccaatgtttatttccacaactatgctgcaatttctaggttctatggcttcattttcatattagaaatcagtaagaaactatactacctataagggaaatatctccaaatgattaattttgtcacatcacttagatttctgctttaaatattaaaataaatagaagtatttttagatgggtggaaagcaaacccagttttgtaaaagattaagcactttcatgctccatttgcaatttatattgtatgccttaaatgcaggtgaataaaagacggtacatgtttccctgttgcttaatattctgaagcaataaaatcctctagttaaatctagttgtccataactgaatgtataaagacccaaaggaaggtaagttttgaggaagtgcttggggaagtgatatagtggctggaaaagtactactggtgtccagtctattccaaatgactgtgcaatcttggactacccacttcctctgtagatttctgtttcctcatctctacaatcagaagattgatctgaacagagggtctgtcaatggacttcccattaagctctttgatgtgcgtatgtgagtgcgcatttttctgaagctaagagggtctatagcttctattagcccgtgaaaagggtcggagacacaaaactgattaattgcctgtgtactaatttaatctgaggtccctcttaacttgtgaaatcttacgaagctataaatagaattaaaattttagatggaaaccaggaattaatataattattatccctaataagattatttgaaaagcatattttgtacaaaggggtaccaccatgaccaaccatgcattcaaacattagctgaagaacttcactagaagcccagtaaggatttgccatcattagcatccattgcaccagacactagacatgtaagtacatgtagtaaatctaaatatatcacagatatttttgttctgcctttttattatcagagttttaatgggctatcaaggtaaggctgctacttaggattacatgaagtggaaacaacccagaatagtttgccagcaaataaaacttctttctcacaattttcaagatattcatccaaaatcattttgattgtaacttttggatagctgaatagcactgttcttatactaagcatatgattataaaagacccagaaatgaaagttgttgtgcttactcacttccttccctccttaatttaataaatgtttgttaattgtctactgtaagttggaaactctcccagacacttgtgaaatatcaatgaacaaaataaatatatttcactctcatggtgcctacattctagaagggagaaataaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaaggaagggagaaaggaaggaaggaagggaaaagaaagaaaggaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttccatatttaaaatgaaagttataatatctttggtataatcttattcgtgtcccatgtttgtcaaaaaaattcagtcaaaattcttctcagaattttaaaatctacctcaaaactatatctctggttggtatgtattttaagtctctcatttcccacaaatatgtatttggcaatgaactgttatgtaatatgcagatatgccatttaataagagatgatgtcactataaagaaataagtaaaagaactttattttggaaattaggaaattaggcacaaagggatttgttactccaaggaagagaaattccaagacttacaattaacatgaaagccctcattctttctgaaatgtcactgttcctttggcattttactacattttttgtttcattaactttcttccagaaattgaaacaatcataataattataaaatttgcatggcatttatctgggttaatgcctgaaacaagcaagaccaatataaaggtagcactttttcacaaggggagggtcaggtagccgttccccacagtaagtatcttgctcctgcctccaggcctcacatgaaaatgaaccgtaatctcaccagcttataaatgtaacacaaaacgtacacagccataccttgcccaactggtcctttttgacaaagccagtggctgctgcaatgctccctgctccctccactgtcttctgggctactgctgtcacacccgtcaccactgctcctccaacatttgtcacttgctctttggtcttctcagccactggtacaaataaagagcaacaacagattaaagggtggtagaataacagtgacttaaaatcattccacttccactagccatcggcttccatacacctgtatctacacatgccatagataactgagtggtcagaagaaacaaaagccaccaagatgtccaagtgagtgtggttcaaccaaacattgaatcttggctaagatattttggctaaagtcatgcagtattaaaaagtgcttcaagtttaacgatcaggaatgtaaagccatgagtgatttggatttggtttatactatggaaagtttacagaaagcaattcttacaggtgcagttatatttgaaccagactcagcatgaatatttctttatttcaattcagtgccaatcctttgatctcactcagcaagttaatttccaccacaccttctaagcaacacaatacatacttctatttatttatttatttgagatggagtttcattcttgttgttcaggctggaatgcaatggcacaatctcagctcacagcaacctccgcctcctgagttcaagctattctcctgcctcagtctcccgagtagctgggattacaggtgcccacaaccacacctggctaattattattattattattatttgtatttttagtagaaacagggtttcatcatgttggccaggccggtctcgaactcctaacctcaggtgatccacccgccttagcctcccaaagtgctaggattataggcatgatccaccgcacccagcccctacttattatctacgtgttcagacgtggtattatcacatatgtacgaataacagcataagaaacggttgtgaaggaacttggatctttttatagaacttcaggtagtgaaacaaagggttcttaaaaagctaaatttgcagtaattttaataggagcacaggagctagacagtatgaaaatgaagaggctattgagcacccttacaatttcttttcataaaacaaaatgagatacggtcattcagtagatttattaaaataagttaacatttttgagaagacagtgtaaatagtttgaattgagtttacaagcagaagtttaatttcatgtcaaaaactttcttgttcagttaaataagccagaaacagaaaggcaaacaaccacatgatctcactcatgtggaatctaaagaaaaagaaaagttgatatcatagaagcagagaggagaacagtggaggagagtggaggatggggacactcatctaaggaaatgaaggcacattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacacccggctaatttttttatatttttagtagagacagggtttcaccgtgttagccaggatggtctcgatctcctgacctcgtgatctgcccgcctcagcctcccaaagtgctgggataacaggcgtgagccaccgcgcctggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccagaaacggtccacagtagtgttgctccctatttgtcttttaggctagaattttgtacaactacctaacaactccgtgccacttctaaggatatggctgatgtctccttaagagcaagagctatttacaattcaaagttcgatttaaatgccagcgaaaagctgtactgaaaatcttatgttttaaaacatttctgaaatgttgatcctttaaaaatagtcaattatgtgtttcaagttgtcatttttttccttttcaaggacgtgaattgaaaattttgcttgaaacgaacattttcttgttataaaatctcaaagcgagattaaaaataggttttgaattttttacagatccagccataaattttataatatctagatagccttttatatatgtataaattttaatctagttttaatgcaatacactgcacagtaaaatgtactctacacattattataattttgttgttttattattataatcataaataaaatggctacattacaaaatgacagagtgtacatgtagcaataatcgacacatttaaaaacatttctgtagaactgatttctctagtagggtctctgctgacctttaacctctatttttccccttgagggcctttcacactatctctctactcactgacattccaaatgacgggtgacaaaacaaaaggaaaagagacacactcatattagtacattttgggtctaataaatggtaactgtttttcggcaattgagttctttgaaatcagggattctgctttatttttctttatattatttcatagtagataataaataatttagaatatactaaaatgaatttagtgtctacctctaatgtctgcattaatataaataataggtttatatttgactttagctactttaaaaataaaattccaaaaaggaaatgtgataccaacttttagaatagatatagccaaatctaacctttgacattaaacaaaattataaaattaatatatggttttgaattgttatacaagtaaatatgtatatttaaatatacatatgtaaatatggatttaaagaaaataaatttgaaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttatatcatagtttatttttaaagtacctgaaaaaacatatcattcagtaagtttaattaaacacattttcatatatttctataatatgatgcattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggggaaattgtttctttaatattagaagataatattaggtactatgtaataatttcttgtttccctgcattaagacttgtagcaagaacaattaacaattagttagcacttaatatgtacccataataaacattttacatcaggcataatatgcaaattattctccctctctttaaccattgaagtgtaattatcttatttcttctcataattagacttaagcactttatattaaataaccctattcaaaaagttaattcatttatctgatgtgggagaggaatgattatgatagcagccgatttatcccaatgtgtttctcatagccatactagttatgacagcatttttggttatttcactactgccagggtggtccatgggtgcaatcgctgtaaatattgcacatgctgaaatcaccatgtccttactgcctagcaacatttcccatagttttctgtggaacactagtttcattcaaccctagtaactaatgaagaaagttttcaataatcaaaaagtttgaataaccctgattttaactatgtaatgcaaatttctttactgtaggacatctcagattccttaatacgctaaagagaaaataaagtatacaaagtctcccaacattgtacaatgttagaaacttaagattgtgagccactgtccttcagaaaacattttataaaatgtctaattgtacaaacttcagtctctctctctctctcacacacacgcacacacacacacacacacacacacacacagatatgtgtttacattttggcattctggaaaagactaaaaaaatgcagcccatctccacagtctccattagatcatcaggtgacagtaatagttgggttctttaatttttaccactgactccagaacttgccacatgcttgtctgctttctaaacctcatgggttcttcctcaactactaaatggaacaccattcatctaggttgaccgtcttcagatagtggagtctccacctgtctgttatctagttcttattataatcatgcttcacaatatcatatttataggaggtccctagaaggcatcatagtccacttacttaactacttctctgttggattgcaacagagcccattaaaggtgcacaattaacttctaacagaactagtttcaaaggagtctgttttatttttacactctgatttttaaatcaaaagtattcatttaaagaaatatttttctccactagttgtaaaaatgttgcacaagaaagttcactataaaactataagtaacacttataaaatacatattgtttgcttttgttttccagatgttttgtgtacattaattcactgaattattttatagatgaggaagctaaatcacacagaggtgaagaatcttgcaaaaaacacacagctggtaaggagtaagcaggaagttgaaccaagaagatctgactcctgtgtttttagtcatatccacaacactgtattaagattcccatatcattgtcctcatttccattttagaagtcagtgataggaacattttatttgtataggcactattgtgtttaatgctttccgattatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattgtaaacctaattgacttgttcaaattctcggtaaatttaggccaaatgaataatataatcagaaatgtaataattgcacaataatatttgtacaaatagctataccataacaatacaaagataaatacaataaacattttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgtcaatacatttttggtcagaatatttaaatgcccacttactataaattaaacatagcttatcaattcaaagccctcattattcttggcaagtatattttttatttataatcaatatttacctatttaaaaatactttataaagaattcagtttcaataagactgatatgttcttagaatgctcagtgattgttttacaatttcataggaatcttgaatactgggccacactaatcactagatactttaaatatcatctttggatataagcacaatggagcttacctgttgccacaccatgcaccactccctccttggttttggagcctacaaaaacaaattcaagacataagtctcaagctagccttaaattgctgattagctagttttcaatacaactaatttaaaaatctcaatcttcagaagtatatatattattatatcttcagggaaagaaaaaaatatatatatatatcctaaaactagaagaaggaactccagtaaccaccacaataaatagaagaaagcccagctaacaggaggtcctctccaattacgattttagcacaaaataatgactttatcccctttgttcccacatcacatgtcaacttacagaggagaaaaaagaatgagataacaccggggcccagtgagaagataattttgaattcagaactgtagaagctttaaaagtacagcactagagacagatcagtcaacccatgaaacaaaagggaagaaggatggagagaaggctttaacatgtgctgaacacccattatgtaaaaaaaacattttaggctgggcgcagtggctcatgcctgtaatcccagcaatttgggaggccgaggtgggcagatcacgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaaaaaacaaacagacaaacaaacaaacaaacaaaaaacacattttacatatcatcttatttaatcttcataacagccatttaatatagttatattatgcccattttaaatagctgatgaaattaaaaatccgagttaagtaatttatgtaacattacacatgtaataataggctataagcacattcaaactagggtctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatgttttacagaattatcatactcctttttaagtttggatcagtttacaaaatgttatcatttgcactttaatgtcatgatatactgacagtgtatttaacataaggtgtatttttcagcaacacttcctctgggacaccttcactctttatcacaacctctttccccattatacggataccttcacctcactacgttcctctgactgcatatttagagtctcctgaattgcagcagtgacaacatcctcagggtagctacttcctgtatacatcaacttatgtttgattcaaattttacttccagaatgtttcacttcctttgtttgctactctttcatctttgctggccagtttcctcttttgattgcgcattttcgtgaaacatcacatgggctcaccactgggagacaatgtggccacacaagtccgggcattgctgtctgtatgaactgcataacagatgtgaagcaaccaatctccaaaaagctttgaaagaagtgctgtggttttgtcactgattataatgggtttctgttatttatgtaatgatttgaaggctgaagagttagcagcaaagtttgtactttatgcaatgactttcggtatactgtggtaacagaaatttgaattgtgttgttagtggctggtgttatttaactaaccatagtacctggaatttgtttgtgctggaactatgcagagtgagaacagctgatatttaagagaatatgtttcaatctctatctctcatcctcaccacctgcaccccatgttgtcttaaaaatgactagtagtaagaaatgtctaacagctggaatgcgatctttgttctttgccttagcagtacctaagaatttgacctttggttaaattatgaaacatattctaaatcaaagacaatgagatagaagtagagagtagaattatgattattagaggctgacaacggtaagagggaggggaggatatggagaggttggttaaagaatatgaaattggagccaaatatgaggaatgagttctagcattctgtagtactgtagggtgatatacttaacaatagtttattgcatatgttcaaaaatctagaagagagaatttttaatttttactgttcccaccacaaaggaatgataaatgtttcaggtaatggatatgttaattaccctaatttgattatcacacattgtatacatgtatggaaatataattctggatcccacaattatatacaattattacatattcactaaaaataaaagaaaaattaaaaatagagtagcatatgacccagcaatccctcttctgggtgtagatccacaagaaaagatttcagcatatctgtttccaagggccccaacacagtggctcttgcttggaatcccagtgctttgggaggctgaggcaggaagatcacttataactatataaggaattttaaaaacactaaaactaatatttatttatttagcaaaccagaatttaaaacattagaaattaaagtgttttatttctttgtaaaaaacttatcaagagtaatgtaaatagtgtttgtcttcttctcattgtataacttcctatacggagtggacatgttttttatattttacagaattgtcatactctattctaaatttgaattaggagtttgagaccagtctgggcaacagagtgagatgctatatctacaaaaaatattaaaaattagccaggcatggtaatgtatgcctgtagtctcagctacttgggaggccaaggcaggaggatctcttgagcccagaagtttgaggttacagtgagctatgataacaccactccattgcagcctgggtgacagcaagaccctgtctccaaaaaagaaaaaaagaaaaacataatagccacaactaaagtgtctactgatagataggtagataaaaagattgtggtacatagatacaatggaatatcagtcagccctaaaaaaacaagatcctaccatttacaacatggatgaacccagacaaaattatgctaagtgaaataagccaaacacagaaagaaaaatattacattatctcacatatatgtggaagcttgaaacaaaattcaaatatacagagactacgtaaaaaacagggttaataggggtggaaaagtaggtagaaaatagggacatataggccataggatccaagcaagtagcagatgtgtaagatgaaaaagtgtacagatctaatgtatgaggactgtaggtgataaaattgtactatatttgagattcatgataaataagtggattttagctgcccttgccacaaaaacaacaaaaaaggtaactatgagagattatgaatatattaatttgcttcaatatagtaattttttagtgtctaatgtatctgatagcatcatgttgcataccctaaatatacacaattaaatttatttttaaaaaagaatgccactaggccgggtgcaatggctcacgcctgtaatcccagcattttgggaggccgaggtcggggatgatgagatcaggagttcgagaccatcctggctaacatggtgaaaccccatctctactaaaaatacaaaaattagccgggcatggtggtgcatgcctgtaatttcagctactcaggaggctgagtcaggagaataacttgaacccaggaggcggaggttgcagtgagccgagatcacaccactgcacttcagcctggagtgaaatgacagattgagaccctatctcagaaaaaaagaaaaaaaaaagaatgccactaaaccacaccattagaacttataattaattattttttataaatatcttatgcaacatattttatatttttgtagtgcaaccccaaagagataggtatataacttaaaaaaacgagataaatgagagtcctcataaggttaccatgtatcaaaccaatcagttgttctttgaggtcataattatttactaataatctgtaattgatggttagcctttaatttatgagtaatctgtaattgataacgtacacctacaaaataggtgccaagtggttatgtgactagcaaggtataaatgctgtagggacaccagagctgatggcttccctgagcggaggtgtcccacacacaccctatcttgtcttcccaacctcaaaagagcacagagtggagaagaaggtcagaagtaatacctgagagttttgagaactcagttatccctgttgtgcatgttatgttgactttgtcagcttagtgaggtgaagcacattttgacttgagaatttgctatcaatttcactgatggccactgctgcttattgagcagagtggcattggaagacactcaaagatcatcattttcttgtatttattgcatttatattactgagcattatataaagataattaaatctttctgcttttggatttagatctaattaatttctgagtcatttgaagaaatttttgtctattaaattgaagtatgttgattgaaaattggtgtacgcagataacaaaaatggagggaacaaaacccataaaaataacactgatcattaaggtagttcttcaatgagttaaaaagtagttgttaaaagtatattcttataaaggaatgagattacttttcttatgaggcttctaccaaacatcttcagccataagtgaaattataaaatggtctttggtcgcctccaatctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcccacaaaaactgcaaggtagttgcagttttctaaatcatattttttactaatcagggaagtgatgctcagagatgttaagtacgcttccccaagaccctaaaggtgataagtgatgtagtctcaactaaaactttggtttgtgtgattagtgcatgttctttccactctatcagtagtcagcaagctacaacatacaagacaattccagcccaccacctgttttgataaatgaagttttattgggacacagccacactagttattgtttatgactaccttcacacttcaacagcagaattgagacatagatttttttttcttttttttagacagggtatcactctgccacccaggctggagtgcagtggctcgatctcagctcactgcaacctctgcagtgagctgtatggctcaagccatcctcctacctcagcctcctgggtagctggcaatacacatgcatgctaccatacccggctaatttttgcgttgtttgtagacacagggtttcaccatgtggcccaggctggtctcaaacccctgggctcaagtgatccaccagcctcgggctctcaaagtgctgggattaaagacctgagccacggcacctggccaagacatagatctcatggcttaaaatacgtgctatctgattccttacccaaaattttgccaatccctggactatactattgtgtcttcacatggtcattttttatcttaaattctgtgtgtaagttcaactctcaattagaactcagaatgtaaccaataaaaaatttatagaatgtgctatgtgttaaatgccatgagagacattgaaaatgatttcaatgaacagttaaaaggtaactaagtcaaagaaacttgtgcttgcagaacttggaaatctgaggacaaacggaaagatattgataaactgcatgtcactgattcagtattccaaattccatctaaaaaggtataattcacacttcataaaatatttaaaattaactcatcaattttttcctcttgtaacaccctatttcaatgactttctgaaaatatgttttaaggtagaaaaaaagtaatttaattgaagatttgtgggaagattaagtcaacataagaaaagtctaaataatgaggcagtggcacatgcctataatcctggctactcaggaggctgaggtgggggcatgacttgagcccaggaattcaaggatgcagtgagctatgatagcatcactgcagtccagcctgggcgacagagcaaggccctgactctaaaaactgaaaataaaaaactgaaaaaaaaatgtgttgtgaactttgatgagatgcattcatataaatcatcccaagtataaaatttcccccactgatctatgttgaagagatagtgtagctttctttcactttgcagacatagacggagcacatgtttcagctaggcaactcaatgtggtcatcctccacctgactgttcatcctgtgactcttactgctatagttgccaccagagaatgtgaaaaagctcagaggagaaagaagagaggaagaatgggcaatgtgtctgtgttgagtgtgtgtgtctatgcctgtggatgagagtgtgtgtctattcttttccaaggaattcaaagtggtttgtaaaataacactcaattgaatacagttcaagttacagaaaagagagtcagagtttgggtgtataccccaaggtggaactttaggaacaagtaggtaataagcatcaatttctttattcttttagtatgtgtgtcatttgatggatgaactatacaaatgtttctgagagattagtagcagccctcaagcacttttctctgtcctcagtgttcacagagaccaaatgatcacatgaagtaactctatcaaagactaatctgttctttccattttagggccacaaataggtctctttatacacatcacaggggcatatcaaagtcatattttaaaaatcagaatggattaaaattgacaaacatttttcatgatggtaaaagaaatcacagatccatcaatgattttgattcttaagaatattcttgattattttttaaaagactatgagtttttaaaactgttctctgaaatagaattatgtaggtacagaaacattcatttttaaaaagtcataaatattagggcaaaattaaaaatctggaaaagcaaacagtcgcattttttactattagctcaaatacacacgttcacattcacctacctacacatacctctgactcagtccacctttttgacaagcaatgatgcaaaaatgaatcaagagagagaactaccagcatttagagtattgattatcctaacccatcactcatgaacaagcaccaaactgacatttggggtttacctacctacatagagaacaccctcttttgtctttcctgctgcttctgccacaccctgtttggttttctcagcagcagccacaactccctccttggcctttgaaagtcctttcatgaatacatccatggctaatgaattcctttacaccacactggaaaacataaaatacactttgaatgagaactttcggggaaaaataaacaaaaaacactgaaaaatcatgagaaaccctccaaagtgtgagactcttttaagtgtacactcatttaaccattggacaaagcagacatttttagctctggcattaaaaatttagcatctcccatccatcttggctagtaaaagtctagccacctaaccacggattaggatgaatcctctgagttgttattactgcatttcagaagtggagttgcatgaaaagattaaccccttttttaaattcccggggtctaaagggtaacagtatgagttagaagcatggaagctggaggcttagggtcaggggtatccttaacatgaatcccagaagaaggctaacaggttgatggtggaaaggcgtaggcaacagaactaactgctcactcggggtgtggttcaaactcaggcaaacagcaggcccaagtgtgatggttctaatccatccaacatccacccccgccctcagctatctaccctgagcaggcgccgctcacactcgcgggccgtctccaaccccgcgccagccacccgagggggcgttctcagcctccaccctagcggaccccgcgccagcacttgttaacccgttaccacctgttgacttggcctccttgcacttccatttcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggc

SEQ ID NO: 2025 - DNA, 114198 bp, Homo sapiens
  source 1..114198: mol_type = genomic DNA
tattttcatatatgtatatatttattatgtcacaaatagctacatactggataagccagaaagatgaggaaacatgtttgcatctcacactagtgcagagattctgaaaaagaccccacttggaataccaaaccacacattagattgttctgttcccaattgtgtgccaaagtgcactctgaactgttttggtaaagccgaccgtggagtcatatgaggctgaataacttgggagaatgtaagtctgcaaaataaacctaggactggattgatcctcaggccacttggcaggtgaatgtctcgggagtgaatatgagacaagcttcctgaaaaggcttatatgacttaaagaactttttgtttaagtgtttggtcccaaataaactattaagatatataaagtaattcactgctcaaaaattaccgtcagataaatattaagggaagaaacactttaaaggagaatttgtatccacataaatccttaaattcatggtcacaactttcctaatctcaaattgttctaggtcactgctatcagtctagttctgtcctctatttcttaatttaataccaatacttttaaatttttaaaatatgctgctttaggtagatttaaaatatatcctaaccgccactttctaaccttcctgaaatatactgttcaataacaaatcctttccttgcttaaacataacttaaataaaacaagaaacttaccatttctctctagtgtaagatgacacatgcagcttagcactctgtagtagtctctcttcaattaggtaaaaaaggaagtttctatggtaaccatccttatagtcactcattcctccttccttcctcaccagcgcccaatatatatcacattactcatgaatacatataaactgctagcatgtctagaatattctgtcttgaaattatactttctactagtgacttttagaaatgactatgccccagaataattaaaaagagaaaccaaataatttttaaattaatttatacagagtttttcaccatcaagtttattttcagcacccatggggagttaatagatcttccctgaaagagaaaaacctttcctaaggaaaaatcctagaattcatatatttggcaacatttaaaggaggccatgaaatttttatcagtctagagaattgatctcctttaaggtgactctggtagttccaacgatgtttaaaggcatttcctgtaaaaaaaaaaaaaaaaagagagcgagagaaaaagagagagagagagagagaatttctgatgattaaaaaaaaaaagtgaggaatgctgagttaaacaaagttaaccacattctctcagagccttgaatgtgctaatatgtgctaatgtgtcttatggctctctaaggagggtgtagtcaaaatcatcttctacactgcttagttcccgggaacccactttttttttttttttattcatggtcgaatattatttattgtcagaaaggtacagcattcacaccaatatcagacaaaatagattttaactaaaaaattatttcgagacaaaaataacaatatatgttaataaaaggctcaattaaaaatgtataacaattataaacacatacacatcaaacaacagttccccaaaatacgtaaagcaaacattgacaggattgaagggagaaatagaccactctacaatagtagttggggtcttcaacaccccactttcaataattaatcacagccacttaaggaaccagtgcataccaaaacacacttctggcagtgttgcttcagggaattccgagtgtagggttaatgttccattttctctacctcttctaaaattcctccttcttcaaatggctattaataactttatatttttgtcctttgtgtcagttcttaattcatgttgcttataagcatgatttttattattaaagtgagatgggataaaaataaaatatttttgcaatgagataacgttttattttaattctcaccatttatatacaaacacaagtgaataaaacacatcgcaaaatggtaaaatttcatatttagtatttataggtgcatagtttcatgctcacatatttttaagtattatatatattaacaaatttcacaatacgtcattattcttagacagtatcattaaaagacacctaaaaatcttataatatatgatagcaaatcactaacaacttctgaacaacagcaacaaaaaaatagtgaggatttagaaataagtggtagtcacttaggtgtttttaatttgttttaacatcgtagattgaagccacaaaatccacagcacacaaagaccctgctaccatgtattcacttcagtgaaagggaagcaccgaaatgctgagtgggggcaggtacagatacttcaatcactgctgatggaagacttcgagatacactgtaaaaactttgagaaatgtcatgactgggcacattggaactgagcacttgtacaggatggaacatctgtcagcagatctcaagaaactgggagcaaagatatttcttaggcttcaggttcgtagtcttgatacccttcctaatattagaaaaatcaaaaagacagcacacactgttagtataagtttcaattacgcatcagcactgacagccaatgagataggaaatggctccccacttacactaaaatttacaatcaatgtttttgcaaatattctgcagcaaatattatcttatttttaatagttgtgtctttcttgtctgatataaaagtgaattacagtagtagtcagagttaaaatatctaggttctgatccggatgcaccatttaatgatcatatacctagtttggtaggacaaataagttggactgtctggttctcagtttcttcacctgtaaaatgtgagaacaaaatcaagctgtctataaagccttttccagactaagatgctctaattctcagaaggaaattaagatgtttgaaggcaagatacattttccctactttcactctcccagttgaaaatttcgtcttcatctatggcttcaattattacttgtatttcaaacctcaagctctccatacagtatctggatagcatccacaacacaaatattaatggatttaattaaagggatcagattattcctcctaaagagcaactctaataatatcaggattctgcttaaaaacaaacaaataagcataacttcaataactcaagttgttttctgaatagaatacaagctgaaatgacaagattatcctaatactctataacttgtctttgacccatagctgcaaattcaatctatcaccattttccttgttcctaagcttgagtcataattattcactgttctcagacatatccatttgcatgctcagacatacatgcctttgcttctgatattcccttgtgccagaatgtcctctgtttgttttgacctactatatctcttaccttttcccacccagatcaacattacctcctcaataaaacttctcctgattgattgaaacagatctttaaaatgttttactttttagtatgtcttatatatttttgctcctgtgatgcctggtacatcgaagacaatcaattatgtttgttaaaggaatcataatgaagaaatgaatgaatgaatttctattttttttcatcaaacctaccagactgtaaactccttatgtcctggtaatgtcaattactctatagttttccattgtgtttagtactgtgtcttgcataaaagaccccaaaatattggaaattcttattaggcaaacaaacaatttaatctcaatttctataagttgaattattatcaatatgcctttcgtgtgtctgtgtgagacagtcttgctctgttaccaagattggagtgcaggggtgccatctcagctcactgcaacctctgcctcctgggttcaagtgactctcatgcctcagcctcccaagtagctggaaccataggcgtgtaccaccatgcccggctaatttttgtatttttagtagagatggggtttcaccatgttggccagactggtctccaactcctggcctcaagtaacctggccactttggctcacaaagtgcgggattacaggtgtgaactgctgtgcccatcctcgacatgccttttaataatgccgtgaggaataatacataaccaaactacaacatacttgaactcaatttttaatggagccattatatagtttcttttcttgtgatatcttcatttggttttgattatcagggtaatattggtctcacaaaattagttgggaaatgtctcctcttctgttttgtaagagatattaattggtgttaactaattagtattaattcctctttaaatgtttggtagaatttaccagtgatgccatctcggcctgggattttctttgcaggtaggtttttttttttattactaatttaatctattcgctgtgttacaaatctattcagatttactgtttcttcttgggccagttttattcatctaacagtattttctaatttcccttttgatacattttctattaaagatactttcattttcaatcaaaataaaattaacaatcatattgtgttgtttaaaacattatactggaatatatcaattgtcgcaaatcatgcatttatctttttattctataacttgtgtgggtaacttttattttactatgcgtcatcccattggacatgtatggcaaaaaataataaccttcctttggcattccattgatttccctaactttccatttagaaatttattttagaatgtaaagtttctaaaaatatattctctaatgcaggggttagtaaacttttcctgtaaagggtcaagtagtaagtatattaagctatgtggactacatatgatttcttttacatcctttcttcctcttcttcatcttcctcctcctctttttttttaaggaccctttaaaaatgtaaaaactattcttaacttgcaagttgtccacgtaatgagcatgtagagagcaaatgattctcactaagcactaatgaaagagaaatgtgacaatgacaggtttttggtactgtcttgttagaaagattcagcttggactcctacctcagaaggcatttcataagcctcattgtcaggatccacaggcatatcttccagaattccttcctgtggggctccttcttcattctaatatttaaagtaagaagcacaaaaagaacatgatgaagtagcatttttcacttttaaaaatcagaaccatgttttggaaaaatcttacatatagggatgttggccacggatcttgaaaatggcacaccttaatattactactggcattctaaactccacaatgcctccggggaaacattgcggcaacatgggttatcaaccctcaaagtatgtaaactttttgctcaagtaatttactatttaggaaataatccacagctatagtccaaagatatttttcacaagatcaatgacagcaggaaacaaaatttttagaattgttaactaaatgttcaatgaataatgaagagttaaaaaattattgctgggtgcagtggttcactcctgtgatttcagcactttgggaggctgaggcaggtggatcatttgagtccaggagttcaagaccagcctgggctgttacaatgaaaccccatctctactaaaaatacaaataaatagctgggcatggtggcacatgcctacagtcccagccacttgggaggctgaggcaggaggatcacttgagcctgggaggtagaggctacagtgagccatgtgcatgccactgcattctagcctgggtgacagagggagaccttgtcttaaaaaaaattatcattcaactactcagtagattatgataaagacctgtattactattacctgagaattatgtaacaactacctatttatggtataatatttagcaggctataaagtgttgtctatattatagatacaacctacacagaattcagacgcaaaggtaaaaagtttggaagaaaacacaataaaatatgaaagttattttgttggatagtatgtatgttattttgactttttttctaagtgtttaacttttataaccacttataatgtaaaagcatacatatttaacacattaattttaaatgacaatgaagaaacaaattcttttctgaaatttgaagactgagactatacatattgaaggaaaataatcaaatacatggtcagaaaatttttctaggtatctcttcctagacaaagaatactacaaaactcagcctgaaatggtcatggctttgttggtattcttcactaaataccttttgttgctttgcatttatttcagcaaagtaattataagaagataaaggtaagtgaaaattcaaagaacagagaggcaatgtgagcctaaagggacttggagaaagagatcaaataatccctcagccaacgcggctgattttcaacaacatgtctgatgtaaaaaagcttccccatgtcttcacatggaagtgactgacagggacgcagaagtataagaaaatggctaacagtaagaaaaggtcacactaaagatcatgcttatggtaggtgggcagagaagcttacagatcattctgcccttgccaatgccctttttataaactaaaaaaaatccaaataatatataaattaaataaaatatgaaccaccccaaactacctcactttaaaatgtggagtaaacatactgttttcgtagtgtttcacttcttggtagatacgcctctgctgcaggatggctaggcacaaggccttccatgtcacaggacttgagctcaagtcctagcttctctagatgacagagcttttgtgatgctgagaagtttcctatgctttttctgagtgtcaattagtcttagtgatcaaacgggacagcaaaaccttctttacaacagggagaaggaaacgacatcattaactttctcattaatatttagattactgttaggatatccaagtataagggaaataaggcaaatttttttccatgattttgaaactgacagagatttgattttctaatataatttgttagaaaattttgatatggaccagacaagtaaatatggcagacctaccctgtttgttgtttgatgatcaaaaaggagttgttatgacggaactaagactgatggatattactggatttgtttatatgttatttggctgaactttgaaggatgtacacagatgtgtaggttaggtgagtgtgtgtgtctgcatggttccagcctgggtgagtgggtgtgtacaagagcaccctgcagtaatggaacagcgtcctgtccggggtgggttcccatattgctccctgagctgccaggataggctccaaccacctgcggcctccaccgaaataattaggtaagttatttgacttgtttgtattaatctttcttaaacgtatatatagctcacattaatttcaatgtttaatgtcagaagtgatttatctttatttaggagtttgatggtgtttttgtgtccagaaatttgccataggacttaattcttgcttatatcaattagccaatggtaaaactggttttgttatatgttgttttgcttcaagtcacagtttccagaaactattgatgaagttaagtgaggatttactgtattatgtgccctctgatggaagtacatacacatcaccatcttaaactaagactgtactagtttaagtgggctattgttcactgatccaataacttcatcaagtgggaacaagctacactagggatgacagcacaatcctattctagagtccaaatcgacaatagggtttacgacctcgatgttggatcaggtcatcctaatggtgtaactgctattaaaggttcgtttgttcgacaattgaagtcctacatgatcggtgaggtcaggagatctatagcatcctggccaacatggtgaaaccccatctctactaaaatacaaaaagttagccgggcgtggtggttctcctatagtcccagctactcgggagactgagccaggggaatcacttgaacccgggaggtggagattgcagtgagcccagatcacaccattgcactccagcctggtgacggagtgagactccgtctcaaaataaataaataaatatataaatagaaaaagaaaacaaaaaaagaaaagccctacgtgatccgaatttgaatttgattaacatttaactatcactgacaacttacagcaaatataaggtggtgaaaaacatgttcattgcttacaacagtggctacaatcagcaaattttgcactgtgagaaactacacaagacaaagaatacgtctaatttcaataagtaaattgcaactaaaaagaagttagtgggaacctgccgcttaaagtagaagtgagagagcattagccaattgcaacctaagaactttatttcattctcattgggaaccctacataagcaaatggaaaacacatatgaggtagttggggaaatttgaacactgacttgatatttaagaattattgtttatttctttaggtgtgatgatatattgcagttttacttcaaaaagttcttaacttttacaaattaattaaatgtttacagatcaaataagatatctatctaggtttgggtgggggaaatgggtgggatatagaagaaacatgagtttaatatttcatcagttttaaaaagtatatacagtagtctccttttatccgtggttttgttttccatggtttcagttgcccaccaccaattgcaaccccaaaatactaagatatttagagacagagagagagggaaagagaaagcgagaccatacccacataacttttattacagtatattattataattgttctcttttgttattagttattgttgttaatctcttactgtgcctagtttataaattaaactttttcataggtacataagcattggaaaaaacagtatatgtagggtttgctactatccgcaatttcaggtgtcctagtgggggtttcagaatgtatccctgtagataaaggaagactgctgtatgctcatttcaatagttagttctctaactatgtttttctgaatatgtgatctaaatttgttgactctatcacattcgtagattttaagcatactaaaatatttggcagctattccaaggagaatataacaacaaacacttcatatgaccatcagacacaattttatccctatacctgtatatttactgtttcataaacctatttctaaaaacattgttatctataaagaaatattaaatttcaactccaatttacaactgtgcctaatatagtttggctgtaacaaaaaaagaacattaaaatttgcattttatgagtattcatgacttgttttcaaaatataatcatacttgaaggtgtgaagtgcaccttctatttatttttaccacaaacaagaaaaaaaactaccaatataacaaatgttaaacacttttgaaaaaatcaattttttctcaaattttcattatgatattatattaacccagaatatgttagggcaataaaataaatgagaaaaacgtctggattttggtatatgcctgtatgcttaataagagaacctacagggtaggatatagagacatagtaagaaaataccttttattctctctctactaggccctatccctggaatagctgtagacttttttttttcaaatgggattgttttacgaacagtgaaatagactcagttcagtatcttatatctgcatttgacacacagaaagaaaaatggttatcaaaaaattacaatggaatgaccctcattgctaataaggaaagacttaaaagctatattaggaaacagaaatggctgagactgacctctttctccctaaaaagcttattcaagttctttttaaataaacctgtagggttgaatagctgatataactgattatcatttcgtactcgtcccagctgaagtgctctataaaacagatcatgagacgaagcttccttcactgctaatagcttattgggaagtacaattccagggaagtgaaagtgaaggaaaagggaagtgatacaaggagaagtaggaaaaaatttcagctactgtctttaggaatacaactacagaatttacataatctttttaaatttcctgttttgaaccatattgtatttagatacctagtaatactttctgtaaggaaattatctttattcaattctatgacttataactttaattttaaatatatttaaaatgacacataataaaggcaaaaattgctttccaaaccacactcttctagaatcatctagggcccttgttaaaaatgcaggtttgtagggccttgtgagtgtcttgttaagtatgttccttggaaaccactgcccgacatcaccaattgtttgtaaaccctgtggtataatttaatatagagtataccaatgtacttgctgtcagtgtgaataattttttttaaaaaagatatgctcattttgaagtccatcaaatgttggcaaatgttgagggttatctgaagacactgggaagtaatccatggtgatcgttaaaatagcaaggtttcatcaattatctggtatctatgctttgtcaaagttagaaatgtagagatacatttctaaattaaaacttttatgtgggaagaaaaattgaaattcaaggctggttggtctttggtatacccaaagaacaaagaggaggttggaggtgttctgaaaaagagaaatgatacacgctgctctttgagaaagttcattggcactagaaaggttctggggagctagtaagcttcaattggtgagtgacagtggtgggcaaaattagtcctagagctgcagcaagttttttcagcagttacagaaaaaattggtcccaggttacaacaggcagcctcagcatgcggacttgtagaaaattacacttttggagcaatgtgatgtttcttgaatgcttttcctcccaggcttcttgattgttttagttgggtataacaagaatgacccaatttgtgtgatcaactttcacagccttaaacattcaaagcagcagaagcgcactttctcttttgcccactgcttttacacttgaagatattttgggtagaaccattgttttgctgcattattgaacaatgtcacttagcctcaaataatggaattaataccttcactcaacaactcacaccaggaggatgaaggagagagatagtagccaaaaagataaaagaagaaactaaaaaagaactttgacttaagaggaaaaaaaggttcaacttaagcacacacccgtgttccaaaatgaaatcaagcccagaactcgtatttaaataaaaatagcatagacgtttcaaaaatgtgaatattctctacttctctacctcagacaggggagtgtgtacatagtgtagatagtatatttcactaagagaattaccatgtattttattgatgcacttaaaaatgaaggcgatagacatgaataccttgttaaaaagcaaggtaaagatatatttcatatgttcaattttctattatcaattcctagtctgctcataatgccattttggggtggggagcaaagggcatctgattcaaaatcaaactaatctcaatttttgataaaatctaaggaattttatttttaaaacattgaattaaagcaaactttggatactctgatttctcttgaggtcataaatcctctgcctttttaagagatctatgtggagaggaacaactctgggtcttaaacgaattattgaggtcttgttttggaaaggctagatattttgttaaaaaatataagatttcaaaaaacctaaaactttggacaatgttatttaatcatcaaaagcaaaacaatatgcatatttcagaaataacactatattttcagtcttactattatgcataagaaagaacaatataaaaataatgtaatgattacatttattgtttacatactctgaggagtatttaattgcatcctagtaagtatattctgtcacatgagaagccatagaaattggcatgttctgctgtatccaatgcccaaaggataataaagcatgataaaattacacttaacgaacccaacctccttttccaattatatatggttaagttaaaattcaaactttaatttttgggaaagtatagttatggcttagatctaaggtagaaataaaatgaccaaaggacttggtgcatttaacattctataactttagaaatgcatcaaagtggcaagcccagcattaagagctatttgtcactaagggcctgtggttgaagtctgttggatccatctgttctttctgaggcaatatgcagacgaaaggtaaggggagttgcaacataatttgtaatatttgatacattataatacatgataaattataatatattagaaatataatttatagcattacatctagtaagatagatgtaaaagggaacaggtaagtgaaagggcaaggcataagtcttgtatagagtgacaggtctggtacagtcctactaccaaatctataactatagtattttgaatattttgcactatttcaatgtagcagtattttaggtttggttggcctgactttacaacaagataaaaaattccaagttttaacaatgtagtgacctactgtgttttagatgttgaaatctataattttctatcaacattttctactaacctgtaaaagacatgccttagaatgtgggaacacacacaaacacatacatactcacagacacatacacacgaagtacagtagaccactgatgatctctggtgccacttcctgagatcattttgaatgttctaattaaaaagtgcaaagtataattttttgtcataaattatacatgctatgctattatatatgctaagccaaacctagcaacaaggctgagtgaagatgtggctcctgggtcatatgctaggctttctttcggcaaatggacttgctctccctcagttatgttacatacctactcagatcaggtctcagcaaatgtacaaattactatgtcatcagccatctggatcacttgggaatagtcacattggtgaacgctgtaagtcatatcttaaatacattatacataatccatacctacagattgagaatgcaaatctattttaattaaatgatacctttagagaacccagtcttacacataaataacatatatttagaagccatttatgctctactttgtttatcttttgtttagaggcagggtcttgccctattgcccaggctgtaatgcagtgatacaatcatagctcactgtagtctccaactcctgggcccaagtgatcctccagcctcagcctcccaaatagctgggactataggcttacaccaccatgctcggctatttaaattttttttttttatagagatgaagtttcattatgttgcccaggctggtctcaaactcctggactcaagtgatcctcctgcgtcagcctccgaaagtgctgggattacaggcatgagccactgcacctgagccgtgctctactttggataatctgttactatcttactgattttcttgtcttttgcccttctagctgtttctttagtcttggcaatcaccttagagagagagaaaaagagaaaagatgaaataaaaacaatttatttcagtttttaaaggtttggcagtggaggagagagtaaagctaatatattaaatatatttggggttattttggggagctatttactagttttatctctgaattcaggtttaaatacattcaaccataaattaaaaaataattggtggataaatcaggaattggtgcaaaatcatttttaagaagaaaatgtcattatatagcaaagaggtagtatgctgctttaaatccttattttccttggcaagcctaacaagcagggcagtgcctgctgtatttatggtagtgccatataattagctgactcacctaataagacttcacagcgcagcaacaactgccagctttttttgtcctgttacttggatagactcggttgaatatactaatgcacaaagggaaatctgggaataaactatttttacttttcatgtctaagggctgatcctcctcttctagaaataaaatttattatgtatgttaaactatattcaaatttgtttactattttaagctttcatggattagaatcttgaaggtcagccccttgggtagtgactgaataagacattaacgatgtgaagatgggtcaagctgagaaaggtttgctcttgtgctgagctcagaatcaataagtcatttcatgtttgcaaatacaatgatatttggaggcaggtctttttttttttttttttttttttttttttttgagacagagtctcgctctgtcgcccaggctggagtgcagtggcgcgatctcagctcactgcaagctctgcctcacgggatcacgccattctcctgcttcagcctcccgagtagctgggactacaggcgctcaccaccacgcctggctaatttttttgtaattttagtagagacagggtttcactgtgttagccaggatggtctcgatctcctgacctcgtgatccacctaccttggcctcccaaagtgctgggattacaggcgtgagccactgcgcccggccagaggcaggtcttaaaactagcaactgggtgagaaatcagtggggagggtaggctttgacaaagtaagagataaagagtctgctttcatattttagaaaaacccagggaatgctgaaaagcccataggaaagaagaaatatgctgtcaagatgttagtgagccaaggcccaggagtttgctctcaaaaacagatgagaaactggacttaaaatctgactgggagaaagtactttaggcaaaacaaactactcatatacaaaaggatgggctctgaagcagagagtgaaggcaatagcttcaagatcggtggatttaaaacctagaagtatcttctctaaaagataaaagattaagaaaggctttaagatagctagagcaggaataaagtagtcaagtgaatgtgataccacaaggttccagaagtttccatactaatagaaacagatactaagtgaagtttgaggggccctcacaatctggatagaaaactcttcaagtagatctcaaccttcaggctggaatatctttgcttagctatcccagccagaggaccatagtggttgatttcaaaaggagttgcaattattctatcttgtaaattctctcattgttaagttttgtcacagtttgttgttgctactttctttcagttacctagaaaatgttttctctgaaaacctctatccatgcctcaacagatcggagataaaaaaggaatcatcttacaagattatcaagaaagataatgggctaggtgtatccttaaaaggtcattcaaatgaaatattaaaattcttacttttctgtgttattcggacatggaataacaataacagttaatgtttatttggtgcttactctgtatttggtaccatttcaagagttttatatgcattatttgatcttaaaaaacaactctttgaggaagttactactgtctccattttatcagtgaatgaacagagataggaagtctggctccaaagcccacactcttaactattatgcaatattagttgtcaaatgtcttgaaaaaaaaatctgtgtaattactaaaatattacgctgggctacttattaaggtaaaattacgtttcaaaaaaattaatcctttccaaatgcaatgttaactattcatgatgaaatatcagaactatctctaataccaatatttttattggaataaaataggaggttaaaggaaatgtttatatatataaatgtgtgtatatatatgtatatacatatatatatactatgcacacacacacatacatatctatgtgtatatatatgattttttgcaagggcaaaaaccagattttttttaaacacataatcattaaatctgcaaatatcaagtttatcaattttttgttacaggaaaaaatagtttattataaattcaatgcatagcattttctggtttagacctttccattattgttctgacagaacaaagactatgaggttgtcagaaataaattgttcattttgtttcctaaatatgtggcaaagacattgtatgttttttgtttgtttgcttgtttgtttgttttagaatagtttgaaatgtcttcaaaccttttgaccaaccaagaaagcttttgcctgggcacaggctttatctttcttagcattacactagagatactaatccctcccaacaatttcattatgattatcgcaataaaatataacgatccattaagtccatggggcagatgtttatttatttataaccatgccttattccacagagaatttaaagaggaataaaagattatttcctcattgcatcaaatgaatatcttttattttgtctaatgttgtatttctttttctttaattggcactaaatgtttatttgcattcttttaattacttttaaggcatccattatttctggattacattactgaactctcaataaatcaatacatagttctgtatataattttttcaacattttttccttctttaatttggttcatttgtatctccctttgctgtttattgagtagaaattctgatttttgtagcaaagggagaacaaacaaacaacacacagaatattctgtatttaatgctgcaattgtctctatggttgcaatgtgtaggtggggtgcattcaagtgggcttgtggtatttgtgtgtgtgtgtgtgtgtatgtgtgtgtgtgtgttggaagaatatatattgaggatgattcctaattttatcactttgttgaggaactgaaattgtggctacacattcactctaaatattttgtctcacagtcccctcccttcaacaattatatacagtacactatttgttggaagctcaggagaaaaagggcatttaagagcatgagatttggtggcagactgacctaatagtagatggtaccagtgagatcttgagcaacgtaaatgtttcaactgaaaaacggtaacaataaaacatttttcagagtgatgttgtactaaatgaaatgatatacataaagtagcctataatgacccatgcacagtcataatatcaaatatttactgagcatctactatgtgctagattattttaagcacttttgaaaatataagtattttgataaatgtatatcatatattgtcttaataagattatattgttgttatatttcatcttattgctaattttatttttttaagaaaacctttttttggaaagaatcgaaactaaaaacccaactatttaaaaaatggaaacttttggccgggaacggaggctcacacctataatctcagcactttgggaggccgaatgggcggatcacaaggtcaagagattgagaccatcctggccaacgtggtgaaactccgtctctactaaaaatacaaaagttagctgggcatggtggcacatgcctgtagtcccagctactcgggaggctgaggcagaagaatcgctggaacccaggaggcggaggttgcagtgagccgagacagcaccactgcactccagactggcgacagagtgagactccatctaaaaaaaaaaaaaaggaaccttttgccttacttcgtttgctagctacattcaagtctgcaattaagctcggtgttttgcctttctcaaactgtgcacaggtcctcttgtttgttccccttctctctgttgcctaggaatacagccaaaaacttgagtaatagatgatagatgggtctgtcactaagcacatcctagtgacatagataagaagcaaatgctacaaaattataggtgcaaactacaagttgtgttttaattggttttaacaagtacttataagcagaagaactgtgaaaaatctaacattttgtcctacttgcaagcctgccagtcttttgagtgctgggcaaagacacaatagtgctgggtcagagacaattaactttactactcacattaatagcattagcaagagtatcatgattttcttgcactgattcctcaagccgcaattcccacagaaaagctcaggtgacacctacatgctcagtgggttgcattagaaaagaggaacgcagagctcaggaaacatggatattttataatggccagtaaagatgtccctttgctttagaaagaggcactacctctatccaaggctgcaagcacacctgccttttgttttagaaggagaaatgatttctatcttccaaggctgttcactatatgaaaagacagtcccaaacaaaaggcagttactgacttgcttgaaaaatgtgcagaaatgatacgctgcttgaatgtggacagctgacacagggacaaggagtaaaaatgattaggttttgagcttgaccaactaggaagataattattagcagtagagaaaaaaagaacaaagtagattttagggcagataagccattttttaggtaggttgagtctgagatgcctccataaatataagttgaaaatatgagattggagttgagacttcagaaatacatattttgagtagttacactacagaggtaagtcatcagagttcataaaattaaagtgagaaaaagaggcaagtgaagaaaaacaagatggcattgcatgaagaactttcttaggaaggaaggcagcaaagaggtaaaattggaggtgtagtcagagatggaagatgaaaaaggaaaataacaatatttcagaaatgaaatgaaaaaggtcttttactaagtaattggtactactacttgtcagtttcaagtgctgtaaaaaaaatgggaagaaccacacatgtgcactttcagtactatgtattttatgcttcagggatgcatacctgtttaacaaaagtatgttttttctcaaagtgtgttgaatagtccagaaaaagatggaggtagaagtcagacttcaggagataaaggaaccagaaagatcattgaaggctgtgatggtagaaaacattttgacaaagagttgtgcaatgagaaagctaggggtgggacaattaattttgagggtaacaattggggatttgagtagattttttgcttctgttctttaattgttttgtcttctttttaaagaaaccaagagactgttaatgtagtaggagcagagtttcacaatacagagcagagagggtgttggttgataaagaattgtctcaaatgagaggaaaagaatggagccaataacagagatgatgtttaatttgggaaaggtgggacatgttaacatgagtccagagaactaaaatgagcttatggcatgcagatgctgaagatgaagaaaggaaaggaaggaaaaggaggaatttatatttatttattgaataatcttgtaaaactgttaatcacccctttttactgacgataagacataaatgtcagaggtgttttgcctaaagtaaaaaattcgatagtcaagctgggtttaaaaccatatcagtcttacgtcaaagcatgttttaattgctgttgtgtggttgtgattttaagggaagaagaagagttttataatgggttctctgaaaaataaaatatcaattagaaagaaacaaaacaactgctgagaagcagtgaatccaagcagaatctgagtatcatcactttttagttaaactaaccagtccaatatcctgatttttctttaacaggcaaagaatttttgagtctttcccatagactgagttcttgtgaactattttacagcaataatggcatccaatcctatagataacaataacaaagctgcagaccattttgttgccaggtttctcctccagggtggctttccagctagtttgtaaacaaataactcaggtggccctgtcatgttacattaactaaaaaccaagtctaaagcacacatataataacatatgtgtgtgcaaactggcttgctttcaaattcctaaatcatacaattaaattttaaaaataactgtatttggaaacaagaaaaaagtcactttgacacccaactgatgtatataaaggagactgtgcatatgggttttaaaatgagatgaaaattgaaatttgatctttgagattaaaaacaatgttatgtaaatctatttttatttaatttttctgaaaaatattgtatttgctttataccctcttgctatacaaacttatattgttttgcttaccctctttttttattcctcctactttttcttaattttgatatctctgaatttaaagtctagagaatgattcatcttcactagttctatcttttccagtgctagtatttttgtttttgagctgtggtttccctatcccatttttgagatctcaaactataatttggtgtcgagtacccaggtatcttatctttaaagtgaagacgtaggcagcacaaaggtgcttttattagaacgtccactagatcagaatgaccagtgcacaaaatttattttcctagcagactcaccaaatttaacctggaagagaatgtctgactctgttgaattttcttaggcaaatacaatatttgaaagtcactgaatgtttcaaacaaaatataacaacattcagataacagaactgtgttattgttctcatgtgtttatgcccagaaaataagcagactggagcttctctaagattaaaagtcaaaacagtattacaattccagcccagatttgactatctaatcatttaaaccttagtatcatcatcatcaccaccgtcactgcatactcattaagttaaaaaaaattcctttaaaataaatggaaaagaaaatatctgtgtaaatagattaaagcgattcctgctcaccactccctttctccctggggcaggagacttgagcacatcaaaggaactcatagcgttcttggagtaagtgtgaaagccaccgtgatgaactaaatgaatgcttacatctaaagaaagatgtaaacatattacattaaaaggtggcatgacataatggtatatcactgattaagaaatgtgaggcgactttcatgtgccactgataaatcattataatttgacatagtagataatgcccctatatttcatctgcatacctggaaaatgaggactttcaaaacatattcctgccagttacagtcaggtattgcaaaacaagcatttagtgagcatctaaactgaagcttagaacttcagttttgtggcggggcgcggtggctcacgcctgtaatcccagcaccttgggaggccaagacaggcggatcacttgaggtcaggagtttgggaccagcctggcccacatggtgaaaccccatctctactaaaaatacaaaaattagccaggcatggttgcacgcacctgtagtcccagttactcaggtggctgaggcagaagaatcgcttgaacctgggtggtggagattgcagtgagctgagatcctgccactgcactccagcctgggcaagagagtgagactccatctcaaaaaaataaagaactccaattttattttcttcatggcatagcataatagatgagttaacaaattaatgaaacagattgacatgtgttaattgcaatcatatacagaacagaaatcatttccataaaatatttaacctgcctgttacttcccctaaatctctctgtagctgatgccccaatttcactattagctcttcagacttggatgttaagcactgtgccttcccctggacctctctttaaatgtcacagctatttctggcaggtaagactattgctttggttagtgtgaacacacaccactgtggatcacaaggcacctgagagaaaaggctgccgaaagcaggaaaataactcagaaaaaagaaaaaaaaacacatggtgctgaaaaatacaacagatatgcatttgtatacttatgatctaatttatgtcagtcattaaaagaaaataaggtgtttagaaaatacagtgctgtctatggttatatttaatattgtgaccacttaatacaaagcaaagcattcttgcttgctctcatggagagtgcaatttagaattgagagctcaatttctaaggagggtttatgtactctatcttgaggcacaccaaggagattgagtttaccagtttagaaagcactgccataattcaagtcagggagagggctgatggaagatttttaaaagattttaaaagatcatgagggcaagctggcttttaacaaaacaaaatatttccatgtggcttctggctgactgaattaataaggcccagagactgatctgaaggcaaaagcctttattttttattgcaatggagaaaaactgaacattatttgactatcagttgtgaagtttagtaaaaagattttcactaatgggtggttttaatatttatgaatgtgatggttcagcaaattttctccaatgttttgcaagaccactaattaataatcatctttacaaatggaacatgtaattgtctgctactattttttctttgccaatgcttaatacttattttgaatacgttttattttttttctaaatttctctatttatttctacctgagcatttcttaatttttttattcagtcctgttattctcactgtaggatttttaaaagctggtatattatattaaaatccttcaactgtgaattcagcaatgttttgagttccagggattcatctggcattaggctgaccttgtcaagcataaacatcaacattaaagaaaatatttaagaaatgaaaggcctgaatcaaaataagaggtcaaattttccagggtgttttgtgtcttgaaaatctttctgctgtaattacctaaagactgtggttagataattattgagggacttttgcaattgtcccttttctctatatagatcaccacattaattaaacgagagtctcactgggaacaggttgctgttctgcatctttaagtatttttagtactttattttcaaaagagaaaaagaaccactaagaagaagattgcttctcagccaaattttctgatatacagatattctcaaaagacaagcacacacacacacgcacacacacacacacacacacacacacacaccccccaaggctctggaatgtgccttaacaatcttatttttgcacattttaaaaggaggtcattatgaaatttgcacatattttatgacctgtaatgtacttctctgatctgatttcacttgagctaataaaaaaatacaaatcaggtgcttgctgtgatcaagatgctaaagttatatttacactgcttcataaatgtaaggtgttaaagcttagtgagacaagaagtaaactgataattgattaaccagggtgctatacaaatctacctagagggtgccttcccaggttaatgcaattatgggagaaagatcctggctcctggctacagaaatgccaactaaagtgttatccaccccatccttcactttggaggatgcgttaagatgacactgtgctgtgtcaaaatgaaaatacaaacaaaagcaaataaaccgagtgataataaataaaccgagtgactcagtttccttatccattttccagttacctttttttttttaggccagtctgcatgtccactagaagaaaagggacctgggttcttcatcagcccatccttagatcttagtgcacatatgcacctagtaagtgccgagcaaatattcaatgaatgactgtacctttcctaagaattcttcgttgattatccttcaacagagctaacttctctccctatgtgctcagtcaaatgctctcccattggactgagttcagcataaactgccatgttttgagatgattggtgtaagcgaatgtcctctcctgagttgcgagaatctaagagcaggacaacatcacatgcttctctactttctatagttcttttgtccactgtctaacaaataatgccaagtgaaaaagggaaaaatgaatgaataaattttgtaagatgccaatggaaaaaaacagaaaatcaagagttactaaaaaaaaccactaactccatttaattgttttagactaagaatccctcagtgatacctagccaaaattaggattcagatccaaaataaaagatactgttgccccaagtagatatcataatttgttacaataagtaaaaatgtatattattcaatactaaactgttataccacatttcaagtttttaaaactttatcttccttttatgcatagatagtagtagagcattaagaacatgcatggctatcacctgaggtgttgattgtaaattcacattcctaggctttgtctcttaactactgaatcggaatctttgggagtgaactgacaggaatctgaattttaaaaataaggtcttcaggtgattctcatgcatctaaagataactgctttaatatataacaaagaaacccaaagagggacacttgaggattttttcaatatatcttcttttgcagagattaatagtgaatgttgttttatctgctgtttagaattttacatatgcattggatgatacatcttcttttactgacaaaaaggcttttctctggagaaaataaaaaggcagctttccctgagagcacacacttctagcaaagccccaatccatatgactctaagacagagtgatttccaccttctagtccttactttcttgcaaaaggggctttcaaatctcattactgatggtcccatcttttattactggtgttatcaatgggatgcttgcagcagcttaagtatgtggataaagaaggaatgcacaatatacggtactgaatatttttaaaaagtggtctttcagaatgtctgtatgtgtgggggcccatgcttaggcatatgtgcatgccagtgtgttatttatgttgaaaccaatgttttacattaatggctggaattccagaaaaataagaaaatatttgtattttctaaaccattaaaagtttagtggaactcattaatagtctgtatcatctctctgtatatttcagaagtacattttaagtgtaacagctaggggtaaactttcataactgtatgatttgaacacaagtacaagaaatattcaaggttttcttttcttttttttttttagatgaagtctcactcttatcgccgtagctatagtgcaatggcgctgtctcagctcactgcaacctccgcctcctaggttaaagcaattctcctgcctcagcctccgtagtagctgggattacaggatcctgccaccacacccactaatttttgtatttttggtagagaatgggtttcaccatgttggacaggctggtcatgaactcctgacctcagtcgatccacccgccttggcctcccaaagtgctggattacaggtgtccaccgcgcctggccaatattcaagtttacacaggaaaaagaatactttctctgcataacctttacttatttactcataagcctctagttctctctggatttgactgtaaatctcaacacatttcccagaaactaacatcttctggctgacttctattaaaaattcagacaaagaaaaaaactgaatacaatggagagagattataatactgctattctcccattctctctctctacagcatatcacctcctccaaaatcagttcatatctaactcctagcacatttttagttaaaaatatacatgcacaaaatatatgtgtaaatacacatgctgatatcacacatatgtgtgtgtgtgtgtgtatatatatatacacaaaagcagatatatatatatatatatatatacacaaaagcagatatatatatatgctttcttgcaggtgatagaatgcttttttggaggtggttttgtgggcctatgtaatgtctctattgttatattttaaaagtttcttttttgtttgtttgtttgtttgagatggagtctccctctgtagcccaggctggagtgcagtggcaggatctcggctcactgcaacctctgcctcccgggttcaagtgactctcgtgcctcagcctccagagtagccaggattacaggcgcatgccaccacatcccacttttttttttttttgtatttttagtagagacaaggtttcaccatgttggccagggtggtctcaaactactgatctcaagtaattggccagccttggcgtcccaaagtgcaagactgcaggcttgagccaccacgctccaccaaaagtttcttagcactcattctcatgagaaaaattgctgaaaacttggcaataaagaaacagaatgactacatgtcctttaaatgttatttttaaggggctcaatcaatgactatgaagttatctaagataaaacaccagattttgacattgccattaacttttttattagagcccccagatctacaggttatatgtgcagatgtgcagtggctgctttatttcccttttcaagagcttttcttatacagcatctatccactctcctatagagatgaagttaactcccttgacaactatcacttgtccccaatccccacccttccacttgacatacaaacccaaagagattcatgctcatttatgctcagtagaaaacataattccataggttactgctattattaatcaaatatttactagatttatatctattagtcaattctctttagaatttctttgactgtttctataaatctttattcctcagatattcctttaaaccagtcttaccagcttattggctccactactaattaattagttgaataaaatctttgaaatgtgtttatgtttgtataaaaaccatcttctttacttttcaaaaactatacttgagcacactgtgaaaagataaattgctaggttcaactgaggaactgaataattttttcctcttttagttttaacattctacacaatctaaattattttaaaactcagaaaatgctttaagctcatatttatagacttcccaagtagtacaatctgttaactgaggtaggtaagtaaacgtccttgaaaacttccataaatgatggtgaataaattaaaaaggtggaaacaattttccaggtctctgagccatattcaatataatgaatcctgaataggagttcaatgaaaagattaggtagattttttttaaaaaaaacccatatcccatgggatcctgctgtaaggtacttttataaattatactgattatactgtctcatttctctgtctatttgccatgtgttatatactttggtgatctttgagaaagcatttaacctattacaggcatttttttcccctaaagtacaagtaggtaggtcaaaagaacagcaaggacaatgtctatccacccaatctggtggcctccgaaggacaaaagccagagttaatctaaagcaatcaaggagtctgaccaccatggaagccctgaggaagtggctgctgtatttcccttttcaagagcttttcgtatacagcgtctatccactctcctatagagatgaagttaactccctagacaactatcacctgtccccaatccccacccctccacttgacatacaaacccaaagagattaattaacatttgttccaggaagagacacagacaaaaacatccgatattggaatattccttcgtgaataaatataaaacttatggagagggaggaagatattttgaaaggaaaaaaatcattggactttattgctcaaagccaaaagaaattgttttttgtggcaaaagtaaaacaaggtaattttgtactgtgtgctgtatttctggcaattatctgttatcttaagaggcttatatagaaagaacaattgtacctactttcacagcatgctctgaggatctaaggaccctcaacaaatagttttcatgctacaagcaggcacttatttaggcacaaataggatgggattctttttttaactgtagtataaataattttatataatacagttatataggcttttttaaacaaaatacagtcagattttaaatctctctattctaagatagacacttcacaatttaaattcaagactccttgtttcttgaagacatctatgaaagcaaatgtttttgagaacttggctgaatctgagtccattccgattagcagattccacattcacttttgagccatgacttagaagctatcaagacattatgtagcaacctttttctcagtattccaggaaaataaaaatgtgcatgcattaactcaataggtattcagatgtttcccattagtaagttgtgaccatgcaataaaaaccatgctcaccaatattccccaataaacttcaagatttgtaagctcatgcatacccacatttatgttaaaatttgaaataatgaaatatttttgcattgtgaaaaatagatatatatgcattttgtgaccaaaaccatcaccacagttccattgctgttgttgttcttcttcttattattattattattatttttggtttgtttgtatctggcacatttggggttataaatcacaaataacataaataagataatgttaatctccttcttacaaaatccaatggcttcccacaagtctatatataatatgcaaatttcttactatagcttataagatctggaataatttttcctatctccagccttcacctcttctcacattcatcatattctagctaatcaggactcttttatgtcataaaatatgctagatttgcacacccttaaagccttcatatacgagtttgttctgccttggatacctctgttccacattcccgaacattctctctctcatcacacagctggaccctttcaccctcctgatctcaattgaaatgtgaccttcctgtataaactttccatgagctggcttgtctgactgaacccaaatggctaatggattttctttcccgttacatgctctctaatttatgatgctttgcttggggggaaaatgagaggtgggagtctgtttacggaacatggaagtccttttgcagaggtacaagagtggaaatggctgttccccagcctggctctctgagtcagacctgacatccacagagagagcactgcagtaactgcaaacgcttctgttttgattgtggtaattggaacaatcagggcacaaactgcaaggtcactggcaagggtagcagcaggcatgattcctcccttagtaattttaaagcagcagatttcaaaagggaaaaccaagcagatgaaagtgagcagatttgttcttcagcacatgtgagatacccttggagatgccaataaatcactggagagactgtgaaggaggcttaggccctgcagatgaagttagtgatggagggaaatcgtgtttatcctcgggctgtcaggtctgaaatacctgggttaagtaaatggcctctgggatggtcacagtcggcaattattagcagttacagatccatctctatgccaaaacagataacagcatccaggaattatccaaagtcacaaatcagtgtcagtgtcttgtcactcacccacgtagtgcttttcccttcctcctagttacttaatggataagggcacattgtcaaataaacaaacaagtgaggataaatgttgctccgaaatttaaggtgaatcattagtcagacttggtatcgtcatggaatttggtctgttttctaactagctttattttagcacagccataaatctggctgtaattgtctttaactccgatgactcatacatctaagcatttcatttaactttcaaccgtgaaaaattccaactgatttggcaatatgaatgtgctcttacatgcatatgatcatatgatgctgtcagtacaacatctgtttttgttcttgggatgttgatggactatcatgaaccatcttataactttcccagtcccctttaagtccaagaggatacaactgagaaggcaggtagagtttttggtcagtggctaggtttttcctgaatatcaaacaaattgcctggtatgagaatttaacagaatatgaccacaatttttttaacagatttatctacttgaaacatcgcctcagtcaatgaagaaacttatgttctataactaataataaaagatcatttgtaactgaaatatgacaaattgctgttttaatcatgaggattaccatttagaacagctaggtaaacatttactttttaatccggaaataagttaaagcaaataataaaaatttatatttaaatcacacaacatgttttatcatgaataataaatgtttttaaagtttaaaaatgtacttgttaccttgtgggtattcctgaacatgattaggatttttatttctccaagtatttttattcactcacagaatcaaaatgtcaaggctatataagttttcatcaagtgctaatttagcatctaagtttttattaattaatttgtaaaggaaataataatgagagtcaaaggaagaagcatctcctgtggtgagctccatttccagattccaacgaaaccattaaaatatttatggcactgaggctgaatcagacgggtcttgtgtactctcttgtgtggccatattgtgtagcaacagtgggtttcgaataataagattcagtcatccatttagactccaattggagctcaggcaacttcaatttgtgattataatgattaacttcaaaaagatgcactatttgtagacctatgttgaaacttatgcagtggaactaaaaagccacctatttttataataaaaaggcacaaatacgcaaatgcaaaagaaattcattggaaaatcttgaacgtttcaaatataattatcacaaatgcaaatataaaataacaatatgtttgttaatattatactttcatttaatcagttcttctaagtaaggcaaatatatgaattttttaatatacaaaaatacccccccaaaactccattaagtatatctatatgaccattgggtaagattttttatgattattagtatgggaaaattgtgactgtttagatatattaaatatattaagtaatatatttaatgatttaagattgttaaataatttatattaaaattgaaacctcattttgccagtattaaaaatttcaaaatttaaatacatatgacaccaatgcatacaatgttactttgtcctgaacataagttttaaaagaatttaagtttaaatattctcctaaatgctttgtgagacttaagataaaaaacagttcctcagaactcctgacaaaggggggcagtaaagaagcaaaaagatttttatggagttcagggaaagctgaaaggcctttgtgtacattccctattttctaaacagtaaatgatggattgcattttaggcagactacaaaattgctaaaattaaatgttgggatggaaatgtggaatgcagagtttgcaacccccttttaatttaatattttcaaagaattaagagaaattattatattttattttataaaatattatatttaaaattactcaattctaaatgaatgttattgcaaacctaggcttataagaagaatgcatttagaagccctagataacatacaatataaaaataatatttgcaaattatgcatttgttttcttttctttctttttttttttttttttgagatggagtttcgctcatgttgcctaggctagaatacagtggcacaatctcggctcactgcaaccaccgcctcctgggttcaaacgattcttctgcctcagcctccccagtagttgggattacaggtatgtgccaccatgcccggctaattttgtatttttagtagagatggagtttctccatgttggtcaagctggtcttgaactcccgacctcaggtgatccacccgccttggcctcccaaagtgctgggattacaggcctgagccaccgcgcctggcctgttttcattttaagtgtagttgtctagcattttcaatacattcccccccgtttgacaaattttatcttgccatttagctaatgggcaagcaaaaaattaagtggaataattggacagaacaattatctggtaacctaaacaatggtaacatgagataggtattttatgcattgtttggacttataaactatctagtgttctaataatagacataatggtttattcaactaatagctactgtcatccttagaggttattaacaactcaaagtagtgaattacatccaactaaagggtgcttttgtatagacatttgttcttattgctggtcacttattcttcaaatatcttttaggcaccatttacaaagatgaccagaggtacaaaatctgcatatataatagaaagagccaggtagtcattcaataaaagaaggtatatagtaccaggaaaagatttttatcttagcctaaggcagtctgaattctcaagcccaaagcacataaatttgttggaattatttcaatttctagtcactaaaaatgtgacgcacatttacaccagtggttcggttgattacttctcttcagccctagtctcttaagcacaggtatacacacttacagcaatatctctgcatacaatatttttgacagaatgaaaaagttaaaaatattgatgtttatttcagcgattctgaaatggtttataaaaattctatgactataagaaattcatgaggaatgcaatatatcaggaaagaacaatgtcatctttacataaaaaggatgcgtgtcagtaatttgagaggctggaatctagtgacaaatgtgtcactttttaaggtgtgcttgattcacagctgacagctttgatttgaaattgcctttaaaacaatgtctatgtatcagtgcaatgaattctaaccaaaagcttgttggagctaaccacagtacctatatattcaagatgttcatgggaggaatggaagatttgatatttaggcactgaagggttgctatgatagttattatacacaattgagtttaaaatgaatatatgtgtcagttctattattaaatgttataaaatatgagggaataataaatgctatgtaatttataaactacaagaaaatttatatcaggaaactgcttatttcctaatatatgcactgtcttcagtgtctccaaaactgtcaactctgccaatgtgactagcagatgatgagcaggcagtccgtgtgatattatcaattacatagtcagaaatctgagtctttctttcaccttatgagctgtttaggaagaaggtgtatatgtgtgtaacagggagcaagaggagattaacttgtaagccattatctgatgcaaaggcagacatttactaagtcatctgtgaagagatggttcgataatagctaagcattcatataaatcttcagggactcgaattctctcaagtgtgacagaatactcctctcaactgccagcgctcctgttgtaaaaaatcacatttggcaaagggctctggtgttttgagttctgctcagtgacaggtttgttttaagtaagattaatactgaggacaataaaatgaccttcaattaagactccttttaaattttgtctacctgatttccactatggttcgtgtctagctgtactctatctaagaatgatctttaaaacattcaggattatgagagagatatctaggaagtcataggaaataaccactattcaatgctgttctgtacaccattagtaaaccataagagaggacaaacatttatccaagaaagagactattacatagccaccaggacccaatatggattcagcacaattgagcaatacatgtaacagatttgtggtgaaaaacaggtgctgctcaattgcttagtctaaaattctccctcaattccttcccatcacctaatttgtttgacatctagtctttttacattataatatagtatattaaaaagttcttattatggtttttttttttgagatggggtctcgctctgtcgttcaggctggagagtaggctcagtgcaaactctgcctcctgggttcatgccattctcctgcctcagcctcccgagtagctgggactacaggatcccgccaccacgtctgggccaattttttgtatttttagtaaagactgggtttcatggtgttagctaggatggtctcgatctcctgacctcatgatttgcccaccttggcctcccaaaatgctgagattacaggtgtgagccaccgcgcctggcccttattatagaatttttgggcatacattgcacatttttctaattgtgcttcaataataccaaacaagtgggcaaatgcttcactgggctacatttgcatccctgagtacaatttcacattggttttggttttgtgaattttggaggaatttattttgagagatgcccctggaaataaataatgctgatgttttggtgtaattttatttattgcattaatggaatatgtaaatacaatctatcagcattaggcagaaaatatttaagagatatcaaattcttttgccgagaaaggtagtagtttgccaggaactacaagctttctaactgaacttttaaaaataaattttaatttttaattttgatagatcatcatagttgcacatatttaagggctatctgtgatattttcatacaatactgccatgtttactgccactattcacaatagccacgatatggaatcaacctttgttcatcaacagaagaggagacaaacctgactttggtctgtgctggctgcaggttctggagagctgtttgaagtgacaagatggcaaatgaaagggtcagttggttgcctggtggattattcgtcctcataacactttacctagaaattttgccttttctcacaaaaccataataatggacaaacagcatgaacctagatatgcacccccagtcactatcgtaaggtcaagttggtatgagtcacataagtagaggactagaagttttatctgaatagtattgtcatagtggctaggaatgagagtgaaaagtagactagatgtgtgctttgatatggcttggagcaaaaggtcaggtattggggcacttctgaaatgatatctattatttaggaactgggtcaggaaaatctataattacattcctactgtatttacataccattcattcctaagagagctcttccaaaaaaaaaaaaaaagagatgtcagtgcataaaaaataaactccatttctttctcaagcccaaagtacataaatcttgaaattttccagctaaaaaataggcatatgttctagcatcagctttaatttatcccacattcattctctgctacaataaagtgacaaagccattcatattttatgttacatctaattatctgtttttcagttagataaatatgctttatatcctaggtaccatcagaatttcaaagctcagaaaatcactaatgagaatggaaggaattaaccatcatgcaagcagaagcatgcggctaccatgctacattgctcagagttcatgtagcagtttaatcagggtagcagctgtgcaatgagctttgttggaactggagtctcgcatcctaaatgtgaaatatctactgtttgaaagggtgataactttatgccttgcaaagaaaacagtcctcaagtgttattttttaatgaattaaccctttatctttcctcacaccttttctcttctttttttttttttttttgccctcagaagtatttaaaggataatcccatatgataactcacactgcctagcttcagtacaatgtctcatacattgcaggcactcacaaacatttgtttaatgaatgaataagtgaaagtccaatggaaaattacactgttgaatttacaatggttttagaggtacatctctaaatttgttgatttatttaggattgtacattgtcacattttcactgctaaatttcatattattcattaaagaaaggcagtgttggagagttttatagttgacagatgaattatctataacttctaatatactcagacatcatgtttttctagcatgtaacttttaaaatataaactctccaacatttaaagttttaacactttttagtaattttttaagaaatgacagatcaatagtagctttccataaataaaagcctattaatttgtataacataacaaaattcagtgcaacataaattcatatagtactcctacaagaaatctataggagtaaaattatgattataaaaatcaacagacttaaacaaacaaataacagctttcaattaagtttatagataccaaagacattcaacctttaacatcccactgtgtaaaatcaaatgggaaaggataaaaggaccaaagctatggttagtaatataattgattgctgccctacctacaaactaatttgttttaatatctgtgctagaaccagtatgttaccccttttaactttagctaaataatgtttatacaaaccttactatgcagagctatctttaacaagagcatcccattgaggaaaaaagaaaatagaaagatatgaaaattttcacttttttctaataccaacagatatcactttattgatattgcatttctgtatataatgacatagaatatgagcattccctgtagttcagttttactgacagtaacattgcacaaatcattttagggctatgtgctatgcagagacattgtacagttaattggcatcattaagtaacattttgaaatgatgaggtgttcaaatgtagtagttaaaggcttgattggacattgctaaattgggtactagatctctaaagagatggaatttaccccctagtaggctttatcctttttcacttgtctcagatttggaactcatttcttttaggttgaaaattttatgttcatgttggaaacttaaattttaacaattaaaagattacttgaaatgcaatgctacccacggctgcctgtcattttgggagtttcttatagattctttttagggataagaattatgttaaaaccagatgctagaattgctttaatttttattccccagtttctcatttccattttgacaaagaggcccaaaacatgaatagccttttgatctgtttttttctcccatatcagttcccatgagaccagtgacttcattctttctgttattgcaggtttacattttgcagtcatcttttattcttgtatcactatcttcaatcattgtggccaattctttccaggtcattctcaaacctccatatcaaagctatagatcaataactatcagaacaagttaaacattaagataaagttaatcatcttttctttataataataaccaccactgaattgcaattgttatgaggtattatgctaaacactttatcaaatcttatgaaataggggtaatttttattctcatctcacatgagaacttgaggcacataaaaattaaggcattttgccccaggtctcatggctggcaagtggtctgtctgacagtagagagccagcttcaagcactgtactatagggccactgtgtcatgactataaacctttcatggcatggtctatacatttgggctcttcagcttcaaatttatctatcatgcaggcatgacactaggttttcacttgcactggaagtcaactgctggaaaattagtctgtagaaaaccgtaggccacagagttcctgaatgtgttagtaagaggcttagattttattttggatgggctgggaaataattgaagggttgtaacagggaatgtgcagaattgcattgtggagagatctaattggagattgggggaaagatgagcaggccctaaactgtgataatgttggcaagcttgaagggagggacagaatcagaaaatatttgtaagtgacatttctaggcccctgtgatttactggctggaggatgagcaggtgagaggtgtttgttttgaaaaaagtgattttgaagagaggtcagaaaaagattttcatttttttacttcatgtgttcatgagttggggagtcagggtacagaaggaaagacacatgaagccagggactgacacagagaccagacacacagtgggtgcttcatggatagctgttgaatgatttgtgaaaatcagatagcagtggtgagggtttttatgcaagtgaaatacaaatgaacttctcaaggtgccatatctgagttgtggctttgatctggttcctgactttgaattattttgttcctatgaagtacaggactttgtaataaaaatccaccatacacaaaatcccctggacttaagaatatctccacaagttataagaattgaaactgcttagaaggaacaattgcttgtactcagccagtcatcctcagctgcatgagtctcaaaacgggggtggagagtgtctacctcctccagaaaaggtttttagagcgaaatcaaagagactgcctcttctccaccaaaattatttgtcttaagatggggacaagaaacctggcacccaggagtaaggacacagacgtgctctctcattttaagctgaagctgaactgtcttgtcctaaaaacatatgcccagactctagaaaagctctcttagacagactgctaatttctccatttctgtcacttaagaggattttagggacatataactttgagaattccattctgcagctttcagaggtaatacaatccaatactcatagtgggcttatggtgtacccggcacttttccaaacattctacttgttatagcttctttaattgaggtacgtattcttatcattctccatttgggagatttgagagagaggcaaagtatgtgccttaagatgacacagttggtaagtaggaaagcagaactttaacatcagcagtaaaaccctgagactattgttttaatgtgtttaataaatgccccactaagaaaccagagcaaattaaaagtatgctgtgttctattaatttgatacaggcagaagaaatctaaaaacagcaaagaatgatatttaagaagaactctattttaagtagttataggacatatgcttaaactgagtgaactttttatgaacttttcatcagagatttttttttaattgttgtttttctcctgtgtctgtgactgaataaatggcctctgttcactggaatgcttcacatgcttcctctctcagttgtaggtgtgtttatttctattcagacaccaaaggcctatgggtatctgcaaattaacagtttcatttgctattatgttccatcattgtgaagcagcacaggaaattaacatatctgtaaccacgcccttactatataatatgaaagtgtaaattaaaacatgccgtgttcattaaactgagataaaaccacattttgaaaataaagtttagtaagtggatacttagtatcacattggcgatactaagcttatgacttgcttttaatatttggattgcaaataaatttggaagctaatgtatggagtacaataatagcgaaaagcatgggctttgatattagacatggctatgcatccgaatatcttattattggatattcgattcaagaacatatcagaatagtaattatgttgtatttgattcagtggctgagattgaagggcaactaaccaacagaggagaagatattattgattgttctaaagatttatcctccaaagctttcctttaccctatcttgttacatcttttttaaacaatgctaattgtgtcccttgtacatattcttattcaactcctcagcaaacatcttctatgtgaccaacattctgagaggtgctggagatgcagggaagagtaagatgctatgcttgacctgcagtatcttgaagctagttggggcagcaaaccattaagacattcagcagcatagctgttgtctgcagaaacagatggggatccaagggttggaaataatacagaggagagatggattcatttgaagagttctcttgttgcatgcttaatataattaaagtgcctagccactagtagatgacagttttctaattttacacatcatgtaatccccttagtcttgaagatattgatggtgttaatcacttgaatgcagtgacattaataatttcttagataaaaagtatactgtttccaatcataaattccctgcctcccagactctctgtgagcctcatgtgcataagtggagggaaggacctgctgatctaagaatacccctagtgtcaaagaagtaaatggtcaagtaaggttgtcctaagaagccatgttaccccttctgctggtgagcacagagcccaggtataaaattttttttttttttttttgagacagagtctcgctctgtcacccaggctggagtgcagtggtgcaatctcggctcaccgcaacctccacctcccgggttcaagcgattctcctgccttagcctcccgagcagctgggactacaagcacatgacaccacacctggctaattttttgtatttttagtagagatggggtttcaccatgttagccaggatagtctcgatctcctgacctcatgatctgcccgcctcagcctcccaaagtgctgggattacaggtgtgagccaccacgcctggctgcagaatctttacctaggttactgttgtccatgtgggtaacaatcttgacatctgaagtgttcattgaataaaaatttgtattgaatattcttctaacaaaatctgaaaaaagtacagagctatttttgaaatggatgagaatgtatggtaatttagctagttcattgtatgtgtcctgttttcagttatcattgctactgaattatttatctttaggtgtataaattatagtcaagatgcttacaattgatgaaggaagaatgattttaaaacacagagcaaaatgttattttaaatacagaagtctattcttctcctccatgaataactggcattctgtttctattgtatattaggttgaaatatgtgtttttgtcattaccagtgtttccacaggataagactgaaggcacaagcatttaatatttgctgaaagcacttaaacagaaaaaatattggctagtgagattaagaatgaaataaggtagacaaatagctggctgcaaaagagaccttaaaaagtttctcagagcctggccaaaatggcaaaaccccatctctactaagaatacaaaaattagtggggtgtggtaccatgcacctgtaatctcagctactcaagaggctgaggcaggagaattgcttgaacccaggaggcagaggtaggttgcagtgagccaagatcatggcactgtattccagcctgggcaatagagcaagactctgtctcaaaaaaagaaagtttatcagtctattaagaatatacttgatttttacaagaagaatcaattgctttacaaagttatttatctaaaatgtatgaataaaaatgtataactataaacatatctataaaactagtaaagatcaaaagctcaggtatctttaactttctctgcttctactattcacaaaaatatttgctcagagacacagaaactcatcttcaagatttatttttatctgggtggagttacagagttgccttggtaacagcaactatcaccaaattaagtgttaagcacacgtttttaaacatttttaacattttaaaaatgcagatgccaaaggagagcaatgtcaggagagaatgttgtaaactccctttttcccacatctacttgacattacaaggtttgtactactttcagaaattctccagtgtttaaaaaatgcgtctataaacacacatatacacagagcacttcttattgaagtaatcaccttaaaaattatgtaatgcaatgaaaaccacaatggttttcctaccattgactaagaaagcaaaggacctttcttctgaaagtgaggaggacctcttgcctcctgtcatttgtgaatagaactctgtagtcagaaccagagcatttctggcatttggtctagaatcattctgaagggcaagcctggtgctgtgttgctaagcacaaacaatttggtatttggctccaaaaatatgctcgagattagttcttccctcagcaacaggcgctcagccaaataatttttaaccaactctcagagcccagtattgcttgagctactgagatcctatttcaagttattgctatcaagatatggaggagagtgaaatactgacacttgtgagatcccaagacttacactaaatccatacaatttctgtcctgaattaaaaatttttttaaaaaagagatgaaaagtgtgacatttccaaaccacgtaattggtttctttcaccttaaactccaagttagagaagtattttgttgttgtttgttttgttttaaaactagacttggtggaatacagaacataaacattttaaacaaaatattaaacttctagaacagtggatcacttaaaatgaaaactttaagactttccttagactgagttttttattcttaaaaaaaattaaaaggaagttgaattttatttctaaacggtgcaggacaaatgaataaaatacattttgcctctgtcttaaacttagaacagatacgcaatctctttaacagtatgtaaaaattcagtcttttctttctttggtttccaaattacagtgaaatgaaacattttccttttatgtgtaattagtgcagtttaactaagagttatggagcatctttccacctcatggtgtatccatgtagctgaatttcttcagcatttgcttttttaatttgtataaggagtaactgttccatatcttagaaatctttgaaattagaagttgatctaatagcatctctaatgtagtctctccttgaattttaaatataatagatatgacctgttatttaaaagatatagtgtttactggcatataacagttgtgttgagaatttttcattgaataaaatatatttcccttgaaatttttgttttatggtcatatctcataatccacctctgaatcaatgaacacttgtattggtggagaaaacaaagatccttcagacagactttctgtgtggtatgttctttctgtttcttttctaataacattaacttacatttaaaattattataattcactctattttcacaaatcatcaaatcatactcagatatttaaaaataaattttattgtatatatttacagtaaacaacatgctgttataagatgaatgtatatggtgaaaaggttattatagtgacaaaaattaacacatccattgtctatctcacgtagttacccactttttcccctgtggcaagagcagctataatctactcaattagcaaaaatcctgaatacaatacactattactaactatagttgtcatcctgcatgtcagctttttagttcctcctacatatctgctactttgtatccttagatctacatctcccaatctcctccctgccacctcactcatggtaaccagtgtgtggactgtgttttttgtttttttattttgagacagagttttgctcttttgcccaggctggagtgaagtggcgccatctcggctcactgcaacctatgcctcctgagttcaagtgattctcctttctcaactgcctgagtagctgggattacaggcacctgccactatgcccggctaatttttgtacttttagtagaaacaggatttcaccatgttggtcaggctggtcttgaactcctgacctcaggtgattcacccacctcggcttcccaaagggctaggattacaggcgtgagctaccacatccggccggtaaccactgttttattctaactttatatttgaactttttctttttagattccacatataagtgagattatgcaattttgtgtgtggatgtgtgttggacttatttcccacagcttaatatcctccaggtccatgcatgttgtggcaaatgacagggtcttctccttttttaaggctgaataatattccattgtatatacatataccacagtttcttttatccattcatgcaccaacacatacctaggtggtttccatatcttggctactgtaaataatgctgcaatgaatatagcagtgcagatatctttatgaggtgatgattttatttcctttgggtacatccagaggagggattgctgggtcttaggtaattctaattttaatttctttaggaacctccgtactattgtccataatgactgcaccaatctatatttccaccaacaatgtacaagggttcccttttctctacacacttatcaacacttaaactgaacatgtagactttttcttttcattattctctaaacaatatagtataaaaactatttacatagaatttacattgtattgggcattatcagtaatctagagattatttaaagcagcagtccccaacctttctggcaccagggactggttttctggaagaaatgtttccacggacagggatggtgaggggaaggggaatggttttgggatgattcaagcacattacatttatcattagattctcataaggagcgcacaacctagatccctcacatgtgcagttcacaatagggttcgtgctcctatggcaatctaatgccaccactgagctgacaggaggaggagctcagctcttgctgtgcagcctggtatcgaacagcctaacaggctatggaccagtactggtcatggccctggggttggggacccctgattgaaagtatatgagaggatgtgcataggttatatacaaatactaagccattttataacaggggcttaggcatctgcagattttagtacccaagggaggtcctgaaaccaatcccctatggctactgaaggacaactgtgtatcattcttaacagaaaaaaacaaaatctgttttgtaaataaaattttttcattattatttccatttcactctggaatttagttagaaattaagattaacaaaatattaattgactactaaaatgtaccagcactagcagcacataccaaaaactaatacaaatattccaataatattaaataatgactgcatttgtatttcatctgagagtggtttatggttcttccccataagtggctgatttattgatggccactttttcttaactcctggtctttctcacaatcacagaaaacagtcccttatcacacaaataaaaaagtcatctcaccattcctctgtaccttttatcttaacagacttgtgttttgaaatattatttatactattttttaattttttgagaccgggtctttctctgtcacccagtctggagtgcagtgcgcgatcttggctcactgcagccccagcttccgggttcaagcaattctcctgcttcagtttcttgagtagctgggattaccagcgcccatcaccacacccagctaatttctgtatttttagtagagatgggtttcaccatgttggctaggcttgtctctatcccctgtcctcaagtgatccctgcaacttgacctccaaaagtgctgggattataggcatgagccaccatgcctggccttatttatattatattaactctaataatcactatgccactttctgttgtaattctttaggcacttcttctttgtatgtttttaattagcatgtagttatatagttatatatttacgtttagatatacctccaagtagccaatattctacatgaagtgataaaggatttatttatccctgaaattatgaaaagtctgccttgttttttctttcttgcattgtgctacagtacacacatacacggacacacgaatgcacacacatgcacactgggttctgctaattatcatttccttagttccatatcattccccaacccctaagccacctgtgtccataccagtcttcccactgcctaccagccccatgtcagatgacctccatcagtagtatctccatttatggtgtctcgcctttctgacacatagtaacaagtgaggtgttaagactaacaagagaaagaaggcattattcttatctggctagaaagaaaacaatcagcaacttgtcttttatttaagggaagaaggcttcactctactatattttcaagatattccaaaactgcaacagaccctttcaattattttactttcatctattaccaaaaaggccaacttttagattgaggcaatgaaaactcagaaacttttttggaatgaccttcagatttgagatgaccactgtttcaacaatatttcagttataattctttctctatattcatttagggaaatttgattctgaaaaatacaaatagcttcctttctcctgagctaggactgtatttagaagggaataaattgtagattttattaaaatttgatcacattttctttttttgtgctacgacacagtagcaatgtagattgaaggcttttacatgtatttttaaaattgccatagagaattatttgtattaatcatagatttccaaggctgcaaaagctaaatagtaaagcatataataatggtagcgttaatttgaaaaaaaattccagctagcaaaacatgagtctagatgtagatatcatgttcaaaaatcacaaagcagattgccagcaaaaaattgaaccaagtttttccccttcagaaaactagctttatttaaaaaaatttcctaatatttaaattgattcacacgtttataactatacaagggtttccttgtttcatcaaagaaataagtatgaatgagcagaatgttttagtataaaagtttacaaagtttattcacactcggaacaaaggaataagtaggaaaaaaagagcaactaaaaacaaatgaattcttttccccatccctctcgtttgtctccaatcagttaaatccttttaatgatatatcataagtagcttcatgctttagttcacattgacgatattcttatatctacatcattaataatcaaaatagtctttctgtctttagttttgctgtctctaagtcagaactcaatactgttgctctaaaatacaaatgttaagatgattcttcaggagcttctcatcacctgtactataatgctactagcatgagagcacccacctagccttcttatctcaagtcctgccctgccactctgtacatatatcccctctttaattcacccttagacagagacagagagggccacgcatcttgtcttttcctgaattaatatgtggtttttgccccatgctttagcacatgtgaatccatttgtccagcatgcctttgctcacctgtgtacaagaagagctacataacagatcaaaaggaacatcaaaggcgctggttcttagagtctcatgtccattcctccaattctcgccacttctggatgcactgtttcttatgagcttccttaaatatgctgtgcctttttgctttctgcgtatgggcatctccagtgccaaagtaagaggagatttctgcagaatttcaggaagttaatatcctagtggcagctctcagacaatgggagacaggagctaatggctgtttcttcgttttgtccttcaggctgataatccagaaaaccaatctgcacaatgcttgagaaggtgcagagaattagagccctcattgccctcaatgcagtacctttatattggctttttctccttattcatcacatgctcctgtttcccgagattgccacccacatatactacttgcaccctacactatatttcaggctcttccttcaggataatgaaaccaagctaaaggcaaaatccaacttttgtttaactcatcctgcttctgagctcccaagatccctgaacctacttctcttatataatttattatagaaagttatttaagcatgagatttctctagtttatctttgaatctccactgtcaatatagtctctggccaatgaaagctgttcagttaatgtgtggtgattcaatacatgcactcctaattctcatttatgaacattttgttaaatcgtggcctataggaaataggcatgtaaaatgcacctgtaagttttatagcacctagtacagagtgacagctcaaaactatttgcagaatgaaagaaaaaaggaagttgactctccaaaacaatacacatggccaaagcctggaaaaaagtaatagtgtcccagtgtaacttctaggaggtgtgaggaagaaagaaaaacaaaattggcaccttttcccaggctttagactgagagatattaacttggagaggggaaagcatagtctaaagagaaacagggctaaggaaggtatcactttcttttactatctctcagacagattgcaatgcaatctcaaggcagcactacactggacaaggtactaggactctgaccattcttgtttttattcttttttttttttttgagacagagtctcactatgtcacccaggctggagcacagtggcactatcttggctcactgcaacctctgcctcccgggttcaagtgattctcctgcctcagcctcccaagtagctgggaatacaggtgcctgtcaccacacctggctatttttttttttgtattttttttgtaatttttttttgtatttttagtagagacagggtttcactatgttggcctggctggtcttgaactcctaaccttgtgatccacccgccttggcctcccacaaagtgctgggattacaggcatgagccaccgggcccggcccatatttttattcttaaagaaccagaactatatgcatctagtgttccccaagttttcttctttgtcttttaacattccaggaaaacagatattgagtgttttgctggatcatgcatagttccatatccttttgaccctctgtttgctgtagccagctttgattctttggattcatggtcaccctataacatattcactaatccaccaatgaaaggttatgtaatgtataacaatcaactcagggttttctaatgacaatctttatcaatgttctataagcttgaaaattaatttaataatttataccattgtgcataaaatataataaaaactttaatttaataacgaaattcatgcatacttttacaaacttatcagtcattcagaagtaaatgtggacttcagttttgtgggcaggggtttacagaagtatgttttactaaagtttggagaaaagatcagtataaaaatatgaaattataccaatagcattattagaaatagttaaaagacaaagtttaagtattttcataatcatatcactttttaagtgactaaactactaaagaaacatttagttaactctaaaatattgttgtaaaatttctatgtgttttgaggaaaaatacttttattccatcataaaattttcaacttagagaaacaatttgtttacttgaaaaattataatattttcaagtaaaaatggttatactgacaatttattaaaacataaataaaagttcttcccacactttgacacatgattagaaaaaaaaaggcagtaagattttcatacagaattctggggttaagtagaattcacttgtgtttgctggtctaagatgcaatggaatttggaggcaatggggctggattctatcaaatcagacacacggaagaggttataacgtgagaatttatattttttcattttctcagcccacacttgaaataacaatttgcaagagttttgctttgctcaatattaggcctgattagctaaaatgctcaaatttccattcaatccttaaaaacagatccacacttagtcattcttcacacctctctccctcgccctttcacacccaaattgttaacttttttctctattctcacatttatagtctggttcagacttccgtgatctgtcacttgctcttgtggttaaatttctgaagtgaaattcctatctctaatctcttctcctatgtatgtcatcagacttgcaattttttctaaacccaaaatgtgttttcactagtcccctgttaaaaaactgtcaacacatccacattgcccactggctatagagttcaattcaaactagagtcattcactacttggacaaccagcttcccagctccacctctgggtattctttctcttgccttcagaatggtgttgaggatataaggtgaatgcaacagccattgctctcagtgagctcatagtctaagtgaggagacagatgagcagatcattataaaacaaattggcaagtgcaatgacagaagtgtgcataggtgctatgggaaccaagaggaaggatatataataagccagggaaggaagagaagattcagggagacttactggaggatgaattgccctcagaaagtattgaagtgtaggtaacagttggttaagagaagcagaaagaaggaaaaggagacagcagcacagggtgccaaaataagaaaagcctgggtaatactgccaagagaaatctacaattaaatgcaattcccatcaaaataccaccatcattcttcacagaactagaaaaaacaatcctaaaattcatatggaaccaaaaaagagcccacatagccaaagcaagattaagcaaaaagaaaaatctggaggcatcacattacctgctttcaaactatactataaggccatagtcaccaaaacagcatggcactggtataaaaataggcacacagaccaataaaacagaatagagaacctagaaataaacccaaatgctaacagccaagtgatctttgacaaagcaaataaaaacataaagtggggaaaggacatttgatgtattgtatgggttacataagatcgattaagtggagatggaaattttacaactttttgttgtatattgtaaactatttttaaatattagtggcaaaaagactaatatggataaatattcccaacaatttgatatttgatgtcccaaactattgtgagattggttataataaaaaatagcaaactaccctgctgatttcccatgaagcttaaccctctctcacatttcagaaccagcctgacttaagcctctacatacttaaacagcttcaaatgcctatctgagacagctttgtaatgggtctctgcccctgtttctctgtccacaagaggtactaattcacttctcttcagttgttagacctaggacacaatagacaccaagttacatttctgttaggtgcatcttggaagtgcctgagaactgaccactgggcacctacctttttacctaagtctctgttaatgttggtctgtttacctgttagtagtggagcctggtgcatagaattatctccttgccatctgtgtcccacaacacatatataaccccctgcatggcatatgaggcctttcctgagaggggtgcttttaagccaacattccagagacctagttcccctgccccaggtgcctcagtttttacacctaggatgctattttgaatcttctcctcaatgacaagtatctgtactcacttagtttgggtccatgccacattcctgaggcaactgaaacccacctactccttgatggccttccaggatgcttgtctgtactatagtggacatcccttcctgcctcacggatgtccgtgtgtgtgtgtgtatgtttggtttttactggattcctgaggaaggccttccactgaacttcattcatgtgctttgctacctgttagaaaatgtaacctaatgtaaatgtaaacctctggtgcctctagttttactgacttatgttatataaatcttggttcctggttctttctgttgccctgttatgagatgtatcactctaagccaagcccaaacactaagataacaagtgctaaagatgacgaatattctgaagagttttcaggacacacagaattgtttgtggccagcacctcagtaccaataacagatatttcatgttatatagtggggtcattaaggacttatttgagggaataatcaagaaaaacttcctagtcttgctagagatctagatatccaaatataagaagcacaaagaacacctgggaaattcaatgcaaaaagattaccacctgggcacacagccatcaggttgtctaaagtcaagatgaaggaaagaatcttaagagctgtgaggcaaaagcatcaggtatcctataaaagaaaacatagcagattaatagcagatttctcagcataaaccctgctagccagaagagattgggccctatatttagcctcttaaacaaaataattatcagccaagaattttgtatccagtgaaactaagcttcataaatgaaagagagataaagtctttttcagacaaacaaatgctgaatttgccactaccaagccagcactgagaaatgctaaaaggagctctaaatcttgaaacagtaacttgaatacatcaaaatagaacctccttaaagcataaatttaacaggacccataaaataataacacaattaacaacagcaacaacaagaaggtattgaggcaacaactatcatgatgaatagaacagtacctcatacctcaatactaatgttgaatgtaaatggcctaaatgctccacttaaaagatacagaatggcagaatggataaaaatccatcaaccaagtatctgctgtcttcaagagactcacctaacacgtaaggactcacataaacttaaggtaaaggggtggaaaaagatattccatgcaaatggaaactcaaagtgagaaagaatagcaattcttatatcagacaaaaaagattttaaagcaacaacaattaaaaaagacaaagagagacattatataatgataaaataattagttcaacaggaaaaatttacaatcttaagtgtatatgcatctaacacttgggctcccaaatttataaagcaatcactactagacctaagacatgagatagacagcaacacaataatagtgggggacttcagtactccactgacagcactagacaggtcatcaagacagaaagtcaacaaagaaacatggacttaaactataccctagaacaaatggacttaacagatatttacaaaaaatcctacccaacaactacatccttttcatcaacacatggaatattctccaagacagaccatatgaacaagtctcaataaatttaagaaaatcaaaattatatcaagtattctctcagaccacagtggaataaaattaaaaattaactccaaaagaaaccctcaaaactatacaaatacatggaaatcgaataatctgctcctgaatgatctttgggtcaacaatgaaatcaagaaagatgaaaattttaaaaatatttgaattcaacaataataatgacaaaacctatcacaacctctgggatacagcaaaagccatgttaagagcaaagttcatagcattaaatatctacatcaaaaagtctgaaagagcacaaatagacaatctgagcttacacctctaggaactggaaaaacaagacaaagcaaacccaaacccagcagaagaaaagaaataacaaagatcagaatagaaataaataaaattgagtcttagtgtggtggctcacacctgtaatcgcagcactttgggaggccaaggcaggcggatcaccataagtcaggagtttgagacctgcctggccaacatggtgaaaccccgtctctactaaaaatacaaaaattagccaggtgtggtggcaggcacctgtagtcccagctactcgggcagctgaggcaagagaatcacttgaacctggaaggcagatgttgcagtgagccaagatcatactgttgcattccagcctgggtaacaagagtgagactccatctcaaaaaataaaaataaaaataaataaataaataaataaaattgaaacacaaaatacaatacaaaagataaatgaaacaaaaacctgcttctttgaaaagataaacaaaatcaatagaccattggcaagattaaccaagaaaacaagaaaaaagatctaaacaagctcaattagaaatgaaatgggagatactacaactgataccacagaaataaaaaagattattcaagactactgtgaacacatttacgtacacaaactagaaaaccaagaagagatggacaaattcctgcatatatacaaacctcctagattaaaacaggaagaaatagaaattattaacagaccaataatgcatagtgagagtgaaacaataatagaaaaaatgtcaggaaacaaaaaaagtctaggaccagatggattcacaggtgaatgctatcagaaattcaaagaaaaattggtacaaattctattgaaactgttccaaaagatagagacagagggaatcctccctaaatcattctatgaagccagtattaccctaatatcaaaaccagaaaaggacataacaaaaaaagaaaactacagaccaatatccctgatgaacagagatgtaaaaatcctcaataaaatactagctaaatgaatccagcagcatatcaaaaagataatccaccatgatcaggtgggtttcataccggggatgcagggttgctttaacatatgcaagtcaataaatgtgatacaccatataagcaggagtaaaaacaaaaatcatatgataaactcaatagatgcagaaaaagcatttgacaaaattcagtattgctttatgattaaaaccctcagcaaaactggcatataagatacacaccttaaggtaataaaagccacttatgacaaacccacagccaacattatattgaacgggggaaaatttgaaagcatttcccccgagaactggaataagacaagaatgcctgctttcaccacttctattcaacatagtactggaaatcctagccagagcaatcagacaagagaaagaaataaagagcatccaaactgctaaagaggaagtcaaactgttgctctttgccgatgatatgtttgtatacctagaaaacctaaagactcatccaaaaagctcctagatctgataagttaattcagtaaagtttccagatacaaaatcaatgtacacaaatcagtaccagtgctatacaccaacagcaacaaaactgagaatcaaattaagaacttgagcctttttacaacagctgcaaaaaaaaaaaatgcttaggaatatacctaaccaaagaggtggaagatctctacaggaaaactacaaaatattgctgaaagaaatcacagacaacagaaactaatgaaaacacatcccttattcatggattggcagaatcaatattgtgaaaatgagcacactgccaaaaacaatctataaattcaatgcgactcccatcaaaatgccaccatcattcttcaaagaacaagaaaaaaaatcttaaaattcacatggaacaaaacaacagcccatacagccaaagcaagactaagcaaaaaataacaaatctggaggcactagattacccaacttcaaactatactacaagactatagttaggaaaacagcatggtactactataaaaatagacatgtagatcaatggagcagaatagaaaatccagaaataaagctaaatacttacagccaactgatcttcaacaaagcaaacaaaaacataaggtggggaaaggacatcctattcaacaaatggtgttgggataattggcaagccacatgtagaagaatgaagctggatcctcatctctcaacttatacaaaaatccactcaagatggatcaaagacttaaatctaagacccaaaaccttaaaaattatagaagataacattggtaaaactcttctagacactggcttaagcaaagagttcatgaccaagaaaccaaaagcaaatgcaacaacaacaaaaaagataaatagatgggacctaaaactataaagcttctgcacagcaaaagaaataatcatcagagtaaacagacaacccacagaatgggagaaatatctgcaaactatccatctgacaaaggactaatatccagaatctacaaggaactcaaacaaatcagtaagaaaaaacaaataatcctatcaaaaagtgggctaaggacatgaatagacaattctcaaaagaagatagacaaacagccaacaaacatatgaaaaaatgctcaacatctttaatgaccagggaaatgcaaatcaaaaccacaatgtgataccaccttactcctgcaagaattgccataattaaaaaataaaaaaataaacgttggcatggaagtggtaaaaagggaacatttttttacactgctggtaggaatgtaaactagtacaaccaccatggaaaagttatggagattccttaaagaactaaaagtagaacaatcatttgttccagcgatcccactcctaggtatctacccagaggaaaagaagtcattatatgaaaaagacacttgcacatgcatgtttatagctgcacaattcacaattgcaaaaatatggaaccagcctaaatacccatcaaccaatgagtggataaagaaaatgtgatatatttacatatatatataaagcataggggggtgtgtgtggatgctatggaatactactcagccataaaaaggaacaaaataatggcatttgtagctacgtagatagagttggagaccattattctaagtgaagtaactcaggagtggaaaaccaaacattacatgttctcatttataactgccacctaaactaaaggatgcaaaggcataagaatgatataatggactctggagacttgaggggaagggtgggaggaaggtgaggaatgaaagactacacattgggtgcagtgtatgctgctcaggttatgagtgtaccaaaatctcagaaatcatacctaaacaacttctccatataaccaaaaaccacctgctccccaaaagctattgaaataataataataaagttaatcagaaaattattgtctataacaccaatatattatttttattaatgcatttcttttaatgtattgttatttgtcattaattaaattagtagttacactattaagcgatctgttgttataattaattaattaacctccctttatcaattaaattataaagccctgaaggcaactgagtagaggcccaataagtgattgctgaattgaaatgctgaactgaattatacttcattatatagaaagcctcatatatagggcctcacatatacccttacacaaaatataagaatccactacaaatcacttcatcgattaatcaactggctgtactttgtaacaaggtttgcacaaataaaatatctttcaggaaaagtgtaaaatatatttcattaatctgtgaaaatgcaactggaagttttgtggcttcctagtttgaactccgcccaagaaggcaaaacctttatagacccatagtttcccgtctaggtactgctctttcacacatctctaagtctgactagacacattgtaacataagctgtggtcacatgacaggtaggtgtctcagtaacaggcaacaccagtcatggaaaaacaaaactaagtgtccaaatgagtgcagaatcctgattgcagctcacatttactcttaaacaagaggccctcttcttatattctcaggtaagtgactctgtaataagaggattgtgtagcatttacctaacagctttactttaggactgtatactgtccttagatatttttaaaactttttatatttcatttctaaataagaatattacaaaaaatttcctaacatttatataacataattctcaaagtagatagagccaaataactgacttctgctagttttttttccagatatttgtcttttatgtacatggccagaaaccacttagaacttgcataaaaacaagttaagaagcaaaatgtcagttagttcctttctctatcccagagcgcactgtttcattaggaatttttcaataaaaataataatgtagaaggtgtgatttttacagttttcatgtcttgatatatagtgaaattgagcaatgtgagaataaatgtgatctagaaaagaaaaatatctttcgatttgagaacagatggttaataataatcatgacagtgattcaaggttaatgacctacatgctaaacttgttttaatttttaaaagccattactaactgaaaactccctgctttagctgaaccaacacttaacaagtgttttttaaagatgtcttgataccttcagagaagttctcctgctgctagttttctctggagcaacagtgggaaaccccaggtggttactcctttgtgaatataagcatccacatgaaattggttgtttccgcatgcacgggcaaacatgttttgttatactaatgtctgaagtacaaattgttgtagaatcattttattccatagacttccaagtctaattctaatactaacttccatcaatagttaaattattatttatcttctatccaaaggctacctgaaggtcctatcactttggtgtgagaagaatcgggtaagacaaaaagttaggcttgcaccagttatcaatagaatattaagaaagatttttaagaaggagaatagcagttccaggttccacatatttgatacttttcaccagaaaataggaaagacggattgggtctgcaatgtattttcaaagtcaaacttctattcctctatttaatgtatttttacagagatgacttgagaaaacacacatttcttttgaatcttgatgtatatatttttgacggatcagacactcttacttgagctaggtgatctcacatcattatctgttgctatgtgctattgtttctgtagccaaatgaatgggccattggcaatcaagccaaacaaattttgcttttacacccgattttagcattaatctacagacacggcttttcaatagtagaaaagatatctcccattttagtccaaatttaagtatagttaaagctacattttgggaaaaatgttttatcatttttttgttcacttgtgggatgaaaagtaggattaaacagtccattatctctaccttctctaactgcctttactaaaattttaaaatatttcttttgaagaaacaaaacataatatttgccattaaatcttaaaagtatgacaactaaatggatgctaagacaattgtgtttcaactgtgggcttataaactctattgagaaactcatttatgatcatgagttttttccaggatggacatataaagatggatttttaaaacactggcctggagaatagggagagaagaggtaataaaaaagtatttatattacttatatgagacatatctttttataatatctatatttaaaacattttaaagtataaatatttctgtactataatacaatatacagtattatagtttatggtctgtgatttacggtaattactgtgggtcattttttctgaattaattttataagtgaacaagcaaagtgaccaagagaatgatctatgatccagaaataactttcaatgataaaaaacctgaagtacaacaaagaagtcagaggcagggctagacaaaatggaactaaatatactaagaaggtgcagaaaaagaagagaagagtatgttgtggcttaaccccatatttccccatggcagaaggacagaaactaaatctgagggcaactcaacagtagtcaataattatcagccaaatcaatggatgaataggtggatggatgaatgcatggatgaatgtttgtgcctgggaacccttctgtcatcatgcataagcagcctgagtcttagataatactatatgacatgctttcttcatgtgaataaacagacctaaagacaggcactaggagaccctgggaccacaaagctcagattgttataataaaaggagggaaacaaagctccctgttgaagaaaatttttgcacacttgatatacaatatttctactaatgaacagagaaagcttgacttgaaaggacacatttatattagatgtcatccctatctagaggccattactatcaagcatctgtcaggtaaaggagatgagatgcctgtaattttttctttaaatattgttttttctaagttgtgttggaaatggggagttgcaagtttgtatttccattgcttaaaaatagaaaacagatgaagaaaggagatatcatcagcagaacatagaagatttcataatacggaggctaaaactcttaagaaaaagcaatatttattctagtgcccaacctaccatgagaaagttgtgcgactttgggcaagttatttaattcctctgggtctgaagatgagtctgcacacaagagcctataatgatcccttccaacaccgggactggcgggtctgcagccacagttacatctggaaactccactggtgcttttggagcttcccaagagtatcaggaattcaatatgcagtcataaaaaattttgggtcatgttctctaagtacaacactgccatgtgtgtgaagagatatctttattaaaatttttcttaagttgttccttcctaaagtagtgaaagctgagcagatcttagaaattcatttagaattcatattactcaattacacttgactataacacttaagaatctagttattttccttttgtagtaaaaatatattttatttgaaatatgtgaatggttacttagtcattttaatctacatgaaaaatttaaccttaaagtaactctattttaaaaatatgaaatgagactatcaatcggtacttatgaagcaatgtttattcttctaatatagtgtgggaagagaaatgtaaaagtcttgcaacacaaaagggattgttctcacaaatcataggtttgtgagatggggtggcaaaatctcattgtttttaaagaaccaagctgttcttcatgagcaagaacactgaattccctggttttctttttctagtcactatacccctggcatcataacactactgtcaatcaactgcatccagaaggtagaataaaatgccaagtgatactttcggcagaattccagagattctcagatggttttttcttttccctcttaaaaactgtaccatatgagttaggtttattttgaaatgtccatgaaaaagaagtcagatatttcttaaaattggcccctcttagatatttctggggaagcttcatataattccatttgttcatgttattccttttcatcataaatcagtcctctataaagagcttcaaattttcactgcctgatgctactgtaaaaatatacctaatatgtttgatcgaaagacagtagtcaatatatttattaggagaaatactttattcactaatcttaagaaatactagaggaaatccagtacaatctgaagttaaaactaatgattattaaatgaatgttaccattttattaaaaattaataatagtaataaaaaactacaaagtactttcacatttccatttgactctcacaataactctgcttttacacataagcatatatacttacttacctgtatacatgtacacatattatgtataataaccctcttactatatgtaagattcagagagggtaaataacatgaataagaccacaggactcttaaattatgtgctagtgattataattcctacattatttctataggatcagctggcttcactgatatcaaaagattatatatagttatataattttataaagttctgctaacttagtgactttatatgcatttttcaggaaacttgcaaaaacaagaaggtgaataaacttcgaaatgagaagagttcactaagcataatgcatttattttgcatcaggatttttcaacgttttaatttttaattaaaaaattaaacatttttaatagccgacatacatctccaaaatttacttctccaatctttccaaaagaattgatgaaaatgtaaaccaagatttagatgtaaggatgatcattataacattataagaagcaaaaattacagaaaaacattgtattcaaaaacaggtgttgatgaaggtatttactttattcacaagtaaactgaaaccagagagatcacatgatttggtcacaggcacagcaacaggtaggagcagatctgggatccaaatccatgttagctatctccagacatagatctctctccaccaaaacacacttcagaccacactccaactatgggaccaatggtttgccccattgtttattgcctatggtaatgggtttatgtataatcgtgactaaaatcattatccttttaaattgaaagaaagatgggatgggtgggtaaatagattacagcagaaccaagcagtagattgctattttgccacacataccaaatattagataatgaacttcatattaaatatcttctctaggtctttatcttcatcatagctcacaatgttgtatgatgctctggcagaaactaaaaactatgcttgtagaatgtctcatttatatgacaacagaacgactgagtgaaatggagcttaatattaagtctgttaagaggttagggacaagccaaagacagagtgagactctgtctcaaaaaaaaaaaaaaaaaagtaactcagagataaataaaagtaagttctgagctgacatccataaatgctttgtggcattagatgctgctaagagtgaattatttccatgaagccaagatcaagctgttgcacaagctgtacattaattacttgaaaaaaattcccagtagggcaatgtctaaatatatttccatgagaatagtatatatatttgttataaaggtgatgatctagccaagagggtgtctgacctccaaaatatatccactaataaaaaaaatccaaggagcatttggataacagtggttaaaaaaaattgcaaaacagatggacttcacattttgggcatgactacacacgtggccagatcaatcccagtgattcttccatgcaaatatgttagtgtgattagttgattgtaggaaatgtggcatttgcattactaatatgttttgttcttgtcatggttgtaaaaacagtctttacttagcaagtataaatgttagcaagtataaatatgtttaaacataaaaaataagactaaacaagaataaaaactgtttttaactataattatcaagtctacaacccaaaagtctttttcccatccttgacacaataacattcaaacatgatttttaatgatctcgtagtacatttattgctaaattgtactcaaaataatgtttcattttacttaagtggcacaagccccctgtaggtatgattacattccgcatactaattcttcttgagctcactgacagaagtgactatgtcttcttataaaatttctatactcccatgatctagcttagtttcaaccaaataaacggcattcagtttatatttgctgaagggaagataatctccttctagttagcatctatccacacacagtgcttaataacagattgtatcagagtttgctagttgtccaccaaaatctgttctcccttctttgtcagggcatatggctatatactacaattttctgtctaccttgaataaattgtggctggtatccaaaggaatgagaaaggaaataatgtatgctacttcgaagtgggtatggatgcatcccctcagaagacggtggggctgcaacttgggaggagtctgggttcctcaatctccctaagggagaaactcacccacctgccaaaaacacctaccatggacttatgtgaatgagaatcaacctctactgtgtttgagcattttaattgacattcatttaacactatttaatatacagatgttcagtagatgttcactaaatgaattaagtttttgtagtttgattttctgaagaatttgaaacagatcaaatgtatagagaagtttcaagaacagtcaaagagtccctctatccacttcacccagaattcctaattgttaacattttacctcatttgctccctctgcctaacacatggatgtatttgtgcgtgtgtgtgagagtgtgtgtgtgtgtgtgtgtgcgtgtgtgtgcgtatctttttccagcacaatggtgcattaaccctaagtacttcagtaagtacctctctaaagcaaggattctcttctacactaacactgtaaaactgtcacaaccaggaagtcaacactgatagaacactgccatccaagccagaggatgattaaattattatgtgcttattgggtgctcaattgggtgttcagcatgacaagtatcataaccaccataatcatcctggctttctctttcatccaccatctctgtctctctctcttttccctcctacttcctaggctgctgggcacactgccattgacctctgcttgacatctccttcctccccctgtcagcagccttgctcagacatcaaccaccagtgtttgcatgtccccatggcaagaacaagggggaagggagtaggagggaaaattagtaaggacaagggaaggtggatgaatgaattcatttttaatataatgctacgtgaaaagaaatgccagaaagtaacattctgaaaatcactggtaaaagcatccccaaagtctacctgatatggacatttaaattcattaaaaattctgagtttaagaaaacagctaagaggttgagaaatcagagttggctgcccaacttacaattctccttgctgaccagcatcttttggctgcctctcaaaataacaggataaggcacacaaaactgaattcttcacttggattaaatctgaatcttccttctcttattcctttgcttataaaatatcttcctaggcttgagacagtctagagaccacctgagaacactgaatgttccttttgagtatccagtagcataactcacactgtcaacaaggccttacttacgtgtgctgaacatttttatatttttgtatcctttatcacaaaccaaacactgcttagttataaaatatatgtgtaagtcaacataattttttttgtcaaagcaaagatttttctccaaaatatagctacagaagaaaaggggcttataacaagtgtatagtacacattcagaaacattttgtttcatggatgtttcagtaaatgcttcatttctatgtaggaggtataagattcctgctaaaaatacattcccttccctgaatattcacaatagcttgccaaaaattctcacaaatgaataaagacagaactgattaactgtattaagtgtcctacttaatacaataataattcaggttttaaataatttcaacatcagttcattatattaattaatctcataaaaacctcccaattaatgtactatgtataaattttatcaagtactttgatgaattaagaggaaggtaaaggttttcatcaatatctgcaataatattattaaattgggctaaaaggaaccaagacaaatgaagatatataagaaaactaatcattattttagactaaaacaggaaaagaacatagttatctaggacactgtctccttagtttttaatgtttcttccccagatgggtttgcacatcttttgcctgaaaaaagaacttatttccaccacacaagttacattaaatacgtcttttagctcctagggagctgaaaggcaagtccaaaatgaacttttttattcgttatgtcatgaaactataacactgcattattaatacacctctaatcaataaagcctaaaaatccattcccaagagacccagatttctctaccagttctagttgtactagttattctcagcggtaagttttcctagttcttaatattaaaatgagaggtccagaggctctaggtggtggaggggttgctagctaaaaggagggtgtcctacagaaagggacagagtctccatgagcaatgctggatggtacctgtggtccagttcttggcacatggtgagtgctgcctaagtcttggtgccctagacctgcagcagcaatcggcggggaaaggaccatgactttggtgacaaaagtgatggcagaagagtggaaagaggtatgagtgatgactaaggacaaagaaacaagggtagaaggacaattccagcagcagcctatccgaataacaaaatccttatctcaggaaaaccatctctgctatgaatacatacacacacatatattcatcaggtatcaatttaattactgattggaacactgtaaacttgttcaaaatagaggttattattcagtatcttcagctgtccggattcaccattttatagcatgctctctgacattagtgagaatgaattgtactctacatatttaggtaatggtttggtatacagctgctattaacgatttgtgtgctatgcaatatttgtggtctcctgtcacccacctcaggagacacaactgatgtaagtgagacagctcagcatatcctatggaaaaatctcttattaaataaaggtcaatgattaagtagtatagtcattgaattaatttgttttccttaagaggagctctcctcaggtcaaaattaaagtcagggatagataagtctctcatatggttcccccagtgtgagaggagcaagctgttggtttcctttggtggcttttttcttgtctcagaagaataaattaataaattctgcatagctgtgattttgtgtgacaaaaatgaagaacctgtgcctctgtttacaaagcaatgcaatgggaatcacctcccctggtgtctcttccccatcaccaccactttgcccgctgaaatgttcttaaccccacccaccataaaaggtgatgataaattgttgcttcaaactcatgctgattgaaattttccagctatttttaaataacccccactactggatttcttgcttctatgttatatgacaatgcttctttcaggtgaaaatgtcctggaaacaagtaatttttacctggctacctttttttttttttttttttttataaagaaagaagtttaattgactcaccgttctgcatagctgaggaggcctcaggaaacttacaatcatagcagaaggggaaggggaagcaaggcacacctcacatggcaggagaaagagagagcaaaaggaagtgccatgattttaaaccattagatcttatgagaactcattcactatcatgagaacagcatggagaaactacccccatgatccaatcacctcccataaggtccctccctcaacacatgggggttacaattcaagatgagatttgggtggggacacaaagccaaaccgtatcactatggatggtagtatcagggtgcacatgcatctttttttttttctctctgattttctttttttatttaaattctttttttttaaattatactttaagttttagggtacatgtgcacattgtgcaggttagttacatatgtatacatgtgacctggctacctttaaagatggatattgactcctccaaaatgctttcacttgaaaaaaaaaagaagaaaaaaacctcaaaaatgagaagggctttccgacttgaggaaagcaaatctttttaacttgcactaggaacatcacgacattttcttgcctcttagatggtttgtattttggatgcttctgaagagaaacaaagacatatagaatttaaacattatctgtgtttatttgtagaatacttattttttgtattttgttttttaaatgagtatgtctgatatctcatacatttagaatatttgtaatagaatagcaaatttccaccatggaatcagtggagagctatgcaatttaacaactgcaaagaatcttagagatccttagagtaacacatcctcttatttacaaatggggaaacagggtatacgagtagaagtgacttgcctaatccataagctaggggtacaacagggtcattagggccatcctgttcaatttctccctgatatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgttgttgttgttgagacgggatctcactctgttgccaggctggagtgcagtggcacaatcttggctcactgcaacctccgactccttggttgttcaagtgattctcttgcctcagcctcccaaatagctgagattacaggcacgcgccaccaggcccagctaatttttgtatttttagtagagacagcgtttcaccatgttggccaggatggtctcgatctcctgacctcgtgatccacccacctcagccttccaaagtgctgggattataggcgtgagccaccgcgcccggcctcttgtagtttttaaaattaaatttaatccaataaaacatttagtttgcctttatttggaatttgttatctattgttatatactctattaatacctcctcttcagcaaggaaattttcttacatctgcttacacgtacatcatttgttagagcccctaaatattggtaatgatgatgatgatattatagcatgaattactttacgttgaacattggcctaagtgctttaaacacattatttgcctagcatttacaacatttttgtaggtattatttgtcacaattacattttcttgttctatgatataatttgttttgatatcgtattagttttctattgttcccctactgaattaccacaaatttattacattgtgggattgtaagtctgaagtccaataggggtctcactagcctaaagttaaggtgtcggcaggactgtgttctgttttggagactctaggagaaaatctgtctccttgccttttccagcttcttgatgccattcatagcttctttcatgatctggcatcctatacgttatacttattttctgattatattttgcctaacctctgtgagatattaattatttgagggcagagatttttatttgtttgttcataactatatccaggtgccttaaaatgatgcctgacacaaaataggtactcaatcaacataggttaataaatgaatgagcaaaaagttttattgtgcatattaattgttacctgggggaatatactcagacatcttaagtctcatatgtaaacttggggtattgatatcaacatgccattttgaggattaattgaggttatgtctataaatacctactagcatagtgtctagcacatagtatgaaaacattgtattattattatttattaaaatggcattttgttttctttatagcacctgacactatccaaattgccttttctgtttcttttctttttacttatttcttaattgtttcacaaaggcagagtcttgtatgctttgcctctatgtctttagtacctagaatagtgcctgtttaaaagtaggagctgaataaatgtttgctgaattaatattaatcatgtgtaggaaaagaagcttgggaatgttattctaccacccacagctgtgcccactattatgatggttgttttgtgtgttctttctcaaggattcactttcagaactcaaaatggggtgtagggtggtggtggtgccagcagtggggatgggagaagctcgatctctccctacagtagaagtgcttactgctctatgtgttcttcagccctataagaaccaatgaaagccatccacacttccctcgatactggacatccctacatactcacagcagtctgcaaaacatatccaagggcccactgagacactgaagatgacccattgatttaatacatatttgcaaggctctgattgagaacctctggacaggcgcttatctagaggttacagtgtgtgactaacacgacacagtttaggatttatgtaacaggaatatgctatagggagagaaagaacagaagacctcagttgacacggtggaattggagtgagagagatttccatgaagccaagtaaatagtattttggagagtgaaggaggagacatcatccttaacttcaatattattatcctgtgtagattcatactttgtgtattttttacttaagagaaaaaatagtaataatattcgctaggagaaacactttgaagaaagaaataagtccaggagccctgtaatgtacttttcctctatttatttcccacataaaattaaagctgttttagttctcatcgcatttatcatcttgaactcatttgccacattattttatttaaatattccttaacctacagagagtggacttaactgctaaaaagtacttaatacatgttcccaaggaactgcttcaattaccactgcacaaaggtttgtttgtttttaataatacagtattattactagaagtatcatcaagtcatggaatggtcaaaatattcttacttctattgctagggtgttagaaaggactctggactacttgatgtctagatgcagataaaaaaagcagctgttcacttcacataaagtagccgctactgcttaaaggtaagggtaaatcttgttcactgtggatgaaggttactaaagagaaggactaacatataaaataggttcaaatatatacggagatatagacttaaaaaattaagacttctccttcaattaatattccaagaaaagaaactccatattgccatctaaacacagaagcttttctgtaatggtattccagtgaaagtcatttaaattcgaatagaaaaatttaacttgagatctgcccttatgaaaagtggtgagaattcaaatagttctcgaaccctatttgtcatatcacttcctgaaaggatactcaatctcttaatttttttctattattttgtactttatggaaaaatatttaggaagattatagaaagaaaatttttaggaagtagcgtctctagttttcctaaaatttatgtcaaacccggcattatttattttacatataaaaagatcataacttttactctttgttaaaactatattaaaacaaaagagaagcaacccactaaataataattgattaatttcatttggaggtcttctatgtttagtatgtttatggactttttaaacactgaggattcactaattttttttttttttttttttgagacaggatcttacttttttgcccaggctggagtgcagtgatacaatcacagctcactgcaacctcaaccatccaggctcaagtgatcctctcacctcagctaccagactagctgagactacgggggtgtgccaccatgccaggctaattttcgtatatattttttttttggtctaactgtgttgcccaggctggtcatgaactcctaggctcaagtgatctgtccaccttagcctcccaaagtgtgggattacaggcatgagccaccatgccaggcgagaatttgcttttaaatgagaaagacacaatacctgccttcggaaagttccctgtcaaattttagaaataaataattaaacaaagtttataggcataataagtcataatattcttgaaaagatatgcagagggttccaaaggagcaccaaccaaccagaggggaaaatatgggggcaacagagaggcaagaggtgatatgagagagaaagcctgagctagaacacagagccaggtcatgaatctgaaggcaggaacaactctgtcagctgtgagacatgaatttggaaggctgctgggagagaaaagcagagattagtcgtgcaattatctacttaagatattttgggctggaagcagtggctcacacctgtaattccagcactttgggaggctgacgcgggtggatcacctgaggtcaggagttcgagatcagcctggccaacatggcgaaaccccatctctactgaaaatacaaaaattaaccaggcgtggtggcagatgcctgtaatcccagctactcaggaggctgaactaggagaatcgcttgaacctgggtggcagaggctgctgtgagctgagattgcaccacggcactccagcctgggcaacagagcgagactccatctcaaaaaaaaaaatatatatatatatattttgaagtctagagatgaattccagaaataaggtatacagaaagtgaaactgtaggactttgtgattgactagaactgagggacaagggagagggaaagggaagagttgaagatgatggaaacaatagattacaggaagaggatcaaatttagggggaagaagatcagatcataatcaatacaacttaattccacatgttctgaaagttaaatatctcctctagccaaaagacccttcctattttacttctctggacctcttaatgtttctttgatgtttattcccctgcacaaataatttaacccctttacagatccaaaattttatagtaggcaaatattgtaacccccttgaaaatgtatgttatgaatagcctttgtaggtgatatttttgcagtttggtaacttaggacaaggtccattttcctgtcccttgttaaatgtcacaagacttcatcttctctacctatatatcacaaagtaccttctgctctgctgatcacaaggtaattaagttttggagtggaggagtgtcttaggtttatgttcatgcattaaatataaagaaatctatgatttttaaaaaattaactatattgaggtataattcacttacaatcatatgcactcattttaaatgtacatttcttgagttttgatgcattaataaacccatgtaacgaccaccacaattgagaaatcatatatcttcattattttccccaattttcctttgtgcctttttctagttaattccttctccttctcctccacctccaccccagccccatgggggtagccatgaaggtacacctcttggatcttttctctccaattagctgccaggagtgctattggcctcctgctgcagcagcaatgggatccaccacagcacaggaacccagactggcctccagccaatgactgggagcagcaaggaaactacagcccagacatgtctgcctaatgcatgactcctcaacaagtaacctttgttggaagccaagactttcttgtaactgcactgtaatctgtggctattcctacccaattctccttccttctgcctccctttgaagtgatatcacaactacattgtggtttttccttgcctggtttttctcctgttctctttctacctttcatagctattgcctgcaataaatctcttgtggatggttgtaattctaacaccatcttggaatcagcttcctgaatgactgaactgatgcctctacctccagcaagcatggatcttgttgttaccatggatgacatttgtcttttctggaattatagtatgtactgatttgtgcctggcatcacacagcatgatagttttgagattcatccatgttgttgaggttatcagtagtccattccatttttgttgctaagtagtattctgctgtatgaatacagcacaattgttgattgattattgtgttgttaccagttagagctattaagagtaatgctatcgtgaataattctgtacaagtcattgtatgaacatatgcttccattaatcttaagtaaatacctaggggtagaacttacagatgaagaaacagaagtacagcatgtaagtgactttgcacaagtaggcagcacaggttttctgactttaaatctatgctcttaactcctatgccgtattgttcttcatgggaagaaaagctatttttcttgacccatttaaactttccataatgtttaatcaaaatattcaatatttaagttaaaaacagcaaaatctgggatacaaggtgtaccaacctcaagtaaacatgccaggtgtttggaaaagtagaagaataatgaaccttactacatgcaaactgtgcaatagttacatgtagaatgcatctcaaaaaaaaaaaggttcctggaaaccacagtgctatgaaaagataatcatagaaaacaaggataaatttgaataccacatactcattttaagaaaaattttcactgagagaaaaaatttaaagcaagttgatggcatataaacatccttgaaattcttcaagtgaatacaaattagttgagttaagcattcagataatttgggtccttctcaggtggcctagcaagttagtcaaaagataagacctgtaatcaagctgccctctctcattaccgtcgttaaactgcataggtagacataataatcgacttgaataatgtaccatcaaacaacattaaatagtctatcagatcacactgcttatagtacacattaactactcatatgctttactatctaaagcagggttgtccagtcttttggcttccctgggccatatttgaagaagaattaattgtcttgagccatgcataaaatacactaacactcatgatagctgatgagaaaaaaacaaaaacaaaacaaacaaaaaattcataatgttttaaggaagttcacacatttgtgttggatctcattcaaaaccatcctgggccgcttgtggcccatgggccacgggttagacaaacttgatctaaagcaataccatccattataattattctgtgagccaattatgtaattttaaattttctagccaccacatttaacaaattaaaaagaaccgggtgaattttatattttatttgatacaacttattcaaaatgttatagtttctacatgtaatctataaaaaaattactgagaaattttatgggtttttttcataatatgtcttgaaatctgttgtgtattttacccctatatctcaactcaggctagctacttttgaaatgcttgatagcaacatgtgtctagtcactatggtattgtacagagtaggtgtagagatcaacaggaaacatttattgagtacctatataagaaattatactagataccagggaaaccaaaaagaaaaaaagtcatctgtaagaagtttagcaggagcaacacagtgaacagattccagcagagattatggcagagattactgtgatcttgggcaaaagtgtgtatcttaggaatttaagatttaagaaagaattttaggcatgaactatatgacaaacatacataaaggcaggagaagcctgctatgctctggtgacaatggatcaaccagtattagagaattcacatgatagatactgaatttcctggatgctcagtggttagctaagtcttaagtttatgaatgaacaaatgacacaagatacaacattagaacgaggatggagaaaaaatataaaatctttaaaatatcagtcaaacgacaaattccagcttcttatgaatgaagagccagttaaatacgtttgaatgaaaaatgacgtgtgaagtgatatatgtggcagttaaagttaaccaggagagaaagctaaactaccgctgcacaggctcagcatctattgcactaatctaggcatgagttgtgtcctatccaaaccttcataatggaagagatgggggagagaatgaaagagagattggaaaaaacaaggatcctaaaatcatcttatggctaaatttgagagggagggaactatggaggcatcagtgatttatatggtttatattgtaggtcatgggaagtcataagaaaaattctggtgccaatggtgataactgatatgaagggactccttgcttgaaggaaaaattaagttaaactgagacctgttgaaatcaaagtagtagtgtgatatctaaataaaaatgtgtagcgtgcaaagagaaatatgagagtgtgtatcaggcaagagatctggctagaaatgtaggcaaagggataaatagtcataagactataaggcattgcggagggaagaggaaaagcttggagaatgagtcagaaatccacacaatagattaaagatttaagttgtgagaaagtttttatggagagtgttctggggaataaattagagattaataaaagaataaaaaatcaaccaggtagaaagggcatgcatcctggtgtgtgcaaacatgtatagctgcatgaatgtcaagtttactatcttacgtggctatatcactatgcaaactatagcctttcatagtacgtaagtgaaagcattagaggattatctgtgtagtcctaaaatcctttgtgaatacatcacattgtcctattacattcttgcccatgttttacataaccagactgactgtaatatgagtattgtgtgtgccctttgttaataaatccttgtataaaccccacaaggatttctctaaagacaaacctggcttgctaaatattactcactccaggctaaattttaataaattccataaaacactatcagatatattcctgagacttttgtattttaagtgctgtcttttcctatttggtatttgcattggttacttttgtggggtgtgctggtttcttccttcttccccttcagacactccaccccactcctgcactgtgcctggagaagatgaattgtactgactacaccacggtttttcaaccttggcagtaatgacattttttaactggatactttgttgtggaaggatgtcctgtgcattgtagatgtttaaaaaaatccctcagtgaatcatagtagcactccactcctctcccttcctcccctgagctgtgataaccactaatgttccctgggagcacaattggccctggattagaaccactgctacatcaatgcactccttttgtctacgctgtgagtttggccagtggaaacaccacaaagaggaaacagggagggaggaaagtaaggtcaggtgatccattttccagatattgactattctcgccctgctaggccagtgcaggcaggtggtatcagtccaaagatcacacagctcaagtcaggcagccgtcttcacataggacttgcttggtcatctctccttcctttctccctctttttctgataaatggtaatctccctgttcatttagttcattttggcctagtggttataacggtgctcgctgttgccatcctaaagtattgcactattccgtgtgtttttcctaacccggtctaaaccttcgtaattagtccctttataaagtctcctccaactaccaaatttgtgtgcactgtttgttttcagcaggagttataattgatatgatgtaagtacatatcaaagtatttacagaaaagcaaaattccaaatattgagatgttttctctgtattggccccaatcattggaatgttttgtgcatacaactttataataatcactgacacctatattattttcatactttgatttgctcaatgaatgctagttataaaaaacaagatcatttaaaatacttccttgcctttattattctcaggtgaaatggagatatgaatttataataaagagtgacaagttagtggaattgtaaaataacattatactcaaaaaagaagaatagagattgtaaagaaatgagattgagtccgtaagtaatgtataactgtctcagtatttcattgtcataccttataagtaagcagggaagtacaaatagatgtgtacttattaatttagtctttcagtcactcattgagtcaatcaattcttgaggccaattgtttttgaaggcactgattgtgctagatactgtggatgttacaaaggtgaataaaatgtcttaatctgaggaagaatttacaatctacacaggcatgaaaaaacaaggaagagtgtaggtgaaagggaaatttgaatgtgaaatcaccaaggtcacaaagcatgtctcctcagtgctagcgaaggactatataataggctcacaaaaatatttgtttaaaatgtaattaaatgaaatttgaagaaagcagaaaatgtctcacaatgctatgtggaagttattagaataacacccccttcccagttcctaattgcattcctggcatatcttatgtacattaatctataattaaatgaaacattaactgctttattaatggctactttagaaggagtgcattcattaaggattattttgaaatacaaataatttccccataaatcttacattcacatatttggattctgagttttacccaagtggcacacaaccataatttgtaggacaggtgaaataaagttcctactattctggtactgtatctagactgagctttacatatttttaatagctttttttttttttttttgagacagagccttgctctgtcacccaggctggagtgcagtggcgtaatctcaccctactgcaacctccaccttctgagttcaggcgattctcatgcctcagtctcccgagtagttgtgattacaagcatgagcaaccgcatctgtctttcttttctttctttctttctttctttctttttctttctttctttctctctttctgtttctttctttccttctttctttctctctttctctttctttcttttcttctttctttctttcctttctttcttttatttcttctgttctttctttcttttctttctttctttttttttttttgtatttttagtagagacaggatttcaccatgttggccaggctggtctcgaactcctggcctcaagtgatctgagggtcttgacttcccaaagtgctgagattactggtataagccatcacacctgaccaatagcttgtatttttgaaagaagttttaggtttgtggaataattgtactgagattacagtgcattcccatatactccattacccttcccccaattcccctattattataattttgcattagtgtggtacattattaaaacttatgaaataacattgataccttattacaactaaagtccatagtttatattagaattcactctgtattgtaaaattctgagttttaacaaaggtataaggtcatgtatccaccatgacagtatcatagagaatagtttcactgtcctaaacatgccatgtgcttcacccattcatccctctgcactttctcagagccccaggcaatcactgatctttttactgtctccagaattttgtctctttcagaatgtcatatattggaatcatatagaatgcaacctttcaaactggcttacgtacctaagttttctccatgtgtttttgtggcttgatagctcatttctttttatcactgaataatattccattgagtacatgtgccagtctttttgttcattcacctattgaggaacatcttggttgcttccaagttttggcaattatgaataaagctgctataaacgtgcatgtgcaggttttggtgtggacacagtttacatttcctttgggtgaatatcatgtagcatgattttggatcatatggtgatatggttaggctttgtgtccccacccaaatctcatcttgaattataatccccataatccccacatgtcaagggagagaccaggtggaggtaactagatcatgagagctgtttcccccatgctgttctcatgatagcgagtgagttctcacgagagctaatggttttatgtgtttggtagttcctcctgcattcattctccttcctgtcaccttgtgaagtaggtgccttgcttccccttctccttccaccatgattataagctttctgaggcctcctcagccatgctgagctgtgagtcaattaaataaacctctttcctttataaatttcccagtctcgggaacttctttttagcactgtgaaaatggacaaatatatatgttaagtatagtttagcttcgtaagaaattgtcaacctatcttccaaagttactgtaccattttgtattgccagcattagtgaatgaatgaaagttcttgttgctccacatctcaccagcatgctgtgctcttggtgttttggattttagtcattttaataagtgttttgtgagctttactgtttgatagctgagttacaaactggcaagtatccaagcaaagaacagagaactggaggtttgcttttctaccgaaggaaatatgttgagaatacaggaaagtttcacgctaaatgtaaataattttttacagttaaactaataatgagtgattgaaaaaagttgacttgtgacatacaaatgatacaaacctttcattgtcctctctttcatgggtattaatatttcatttgataaagatttaagtactaatgactatcagtatctgttgattgctagcaattttgagtagaacactttttctgatatgtatgaatatatagacaagaatcatatgatacacctggattgtgtaatagcctttatgatgcagtaaggcaaccactgaacttggaatcagtgaattacaatttgtttcttctgggtccctcactagccctgtgactttggtctatttgacttctgtgagcctcaaaagtgcatttgtaaaatggaaattaaatttttttctgcccatcttactgtgaagctgttgtaataataatattgacaatagcaataattatactaataaaaagcaatttactgtgtatttgaaattatgcaaacaatttgaaaatcatagcactatataaaatgtaacgtcacattagtgttggagtttacaatttggcagggaagctgtacaactaaccacggcacaatttgataagcaataaacttcctttagagtatacggagaaatggggaggattataaatattaagcccttttgtgccaggctctgggaccacaattatcccatgtgatctccatcacaccttgcagatgtaaattttcttattcttattttatacagatgatgcaactgaagaacgaagcaagttgtccatggtcacacagctaataatgatagtattttcctattcctcatagaaaactggagacggccacattatatatccttaactacagggaccatttctagaaatcaaatttctagaattcaagccacaccacatacaatatattaccccatagcttattgataatgctaaaatatgggatatctttgcatagagatccttaaattgtgctagaatatgagatctttttgcatagagatcctctcgcatagagaattcctgctactcaagaatcaatgttagacattcactctgtgctcacagtgttcttttctcttctgtcaaaaaaaaaaaaacaaacaaaaaacaaccaccttattttacttgtgaccttcagtaccaagtaagactggatagaatatcaagataaatttgcgacagatttagtgtcctttctgtcgcattatcatggttgcccagaagttaagaggtttggaatgattccagtctgataaggagaacaagacattgaagtaagtgtctggagtctaaaatagatctgggatagctattactttagcttttctgagatttaatatgggaatgaggtgtaaaagaagagttgaaataactattacacagagatgcttgttccttcttcctaaggcctaagaacatttctcactcattcttctatcctagaattcataatggtatatggcactgcacagaaattcattaaatgttagtgaaatattacatgtgaaagaaggtagtaatgtaaatagaacctaatataattttttatgggctcatttatgttctgcattttcttataaaattactttttagattgttttgctgctcgaatcattactggttgctatctagggatcaccttcaaacccctttcaaaatacaatgttcaaaaaaaataaaaacaagggcctggcacaatggctcacacctgtatcccagcactgttgggaggccgaggcaggagaattgcttgagcccaggagttcgaggccagcctgggcaacatagagagacgctatctctataataaataaataaataaatatttttggaaaaacaaatgctgttaaaatgcatttctagcttaggtcacataaaggatctgaaatgggcatgtaaacaatggcaagtttttatatatatcaattaacaggtcttgaaaaaagtattgactctactggcttgtgtgaaatttccctgaatgaaatcagacaatggtgttctcagaaacaatgcatcttagaagagttaatatcagccaaagacattatatcatactaacttctctcccaataaaatgcctagaaaacaatgtatctctaacaagaaaaagttcaatgctgtgttaactggcaattccatttaaaatattttcaaacacattccctaaggtaacaaatataattattaaaagcctaataaatcttttaataatccagaaagaaacatttagaagacattaagaaagacatattcagaattcagacagaagctcataaaagctaacataaaaagcaggttaaaaatcaatttctacaagaaaaatatagacatataatcaaacaaaagggggaaatacataacaaacactagacgaatgcaaattttcaaagctatattttaccaaattttaaaagttaactttaaaagaagaattaaccttggtggcagcaaaatccatgtctgtgtgtctggctgatttgggttcaattaaaatcttgggtagagaacacttaagtgaaaatatagggcaaaaataattccatacaaaatataatgaataaatagagcaaaatttcgcatataaccaaattccaacattttaaggaaggtattaatttcaagctaatatccaaatttgtctggtaagaaaaaggtgagcatgatccctatgatagtggttgccattacttctacttttgtgaggcagaataggtgggacagctctagggctcttctgattttattctatcaattataagaggtctgagaacaggaaatgaaaaaagctatgaccctcaagccatctagctcaaacgatttcactggcatctaggatctgatatattttggattggggaagagtaaacacaggcaaaatttgcattggatgtgaagctaatggcccttccacataattttgctgtaggatatcaattgattccctgtttcagaggaaggattgttaagctaaaatggtttcaaccagatcaaacattaaagtaagcagagtttttcagtagatttgactagattcttcatttactataaagatctgccacacccgaaataccacctgaaattagttttctagttaaatcagtatagactatggataaaagaagttacgaagacaaccctcttaatcttgatcaatattcagagatgactactccccatcacaaaagctaattcgtttttcacatttttctctgctcctaatgaaatcttttttgctgaagtttctgaagaaataaataaagaagcctggtgcctctcagagttccacacagctgatgagtctaggcagtgacaaatgacactatattcctcagcgtgcaacctttctctccctctcatcttcttgcaatggaacactgctacattccttgcagaggaaacgtactgtacatttcatagctgtcaccttggcataaaaggcagagggagggggaaattcttcttttggtctgcctaaacattttactttattttttatatatcaataaccatgagaaactattgagtaagtttagatataaaacagagaactttgttttggaaggcattacttttcaaaggaaatgcatcgtggagagtgaggagtgaagggtcaatgttttcaagagcgatcggaagctccctgccttgatattcctaatcttctttctggcatcttatgctcaccaactgcctaatagtggatgcatgtggttctgcccatctgtccaattgccattctaaattatgtggtttactaagaaaatacttaacattatatgaataatgtataattaattataagtagtttttaaatcttcaagatttatctcatgagtgaaatggttgctttgttcttaaggagaaaattaatttatttcccacgtatccatgtacaataagtagtgctgttataaacatataagaaaatgagctatcatgataagtatacagcatagagttaagtttattagaataccctcatattctataatatacaaaattactaacgtgcagtgaaatcatatagaattctgaagtagtgaattgtttccttactgtttaacacattcttgcagtttgtctttttaaaattaaaatcaggaattctgggcagttagttgtttttgaagacaatgtcatttatctttgctttaagaaggaaacagtctacatttaacaaacaattcattttctacatattaattgagcagtgaaaatatggttggcaggtctgaagaacagggaaaaagacagtgtagttagagtgtagttggagggtggcatacaaggagaaaagggataggaagtaagaagttactgaggtccagataatgtagggcctttaaaacacagtaaagatttgcatttcattctatgtatgataagaggtcactggatggttgggagcagagggggatgtgatctggtttctttcttaaaagaattattccgactgctcaagaatggactaggttgggtgtctaagtggaagcaggcagatcagttcagaggttagggaaggagtccaggtgagaaatgatgaaggcctagcctagggtggtaacagtagagaagggagacatggtaagactggggatacattttgaattacagtgtaggtaaaattattagcttaagggttagatataaaaggtatgaaaggaaaaggatcaaggatatgtatggtatatctgcaaatgctaggagaccaaagtgaaatttcacatagtgaaattactgtgtttcagcagttagggataactttttggagttctggaggcttgggctggacttttttgcatggataaaattcagacaggagacataaaagccttcttagtggtaagacagttattagataattgggaagtattttgaagatacttgtctacctagaatgaagaattttgttgagtatttgagagctatatggctgaaaagaaagaggccagataaaacaaggccctgagtaacaagagtaggccttgggccttgattctatagagagtgcaaaaccactggctaattttttgtaactaatctggctagaaatttccagatttccagcacactatattaaaggaagtactgccaaaaaacatttcatggattccaaaaatagagatcaatgtagatgaatttataagatgaatgaactctgggaagaccaagcagatttctgaaacaacactaccatatatttcattatatacacacacagctacacacacacacacacacacacacacacacacacaccataccctgaacataccctacaccctacataatacttatatatacacgttagtgctctgcagttaatttttataaaggcaccaattagtttctaataagaaaaagaaatgtgtaaagaagagaagaaatttcattctctccatgaagaataaaaaacacaaatatttgttagctgtaacaaatatacatttttttctcaaatcatttcatgatatttatcacatgaaaaatgggtactttggggagattttctcctaaagccttcattttttcatatatagtgagatctaaacaaccaatttctatttacagttgaattctacttccaaaaacatacaactatgactcaatccttgttacctttcaataaactgttaagcccaaagatataacttattttaaaatgtgaacctagacatttgggatgatcaggcatgctagttactattaagaatagcagtatgtactaataaaatggtattcagagattataagggaagcactaatgaataaaaatgacccaaactatatataaagtctttgttcatacacaaaataaacacatgcactatggatggggttctctaacgacagtagaagtaaacgggcagctaaagagtgtatcaaaaactgcacttttacagtttcctatatatcgtcagacaggttaacaaaagtatcgaaaagttggcatactgtggataaagtacattaaaatgagaaaggcaaagttttaaggatatatgaaaatgaaaggatggcaactagtatggtcgaaattcatgtgataaatcgtaataaccaacgtgatagtattaagtggtggggccttgcagaggtaataaagtcacgggggcagagccctgacaagtggaattggtaacattatgaaaggccttgagggagtgagttggccctttctatctctctaccatgtgagaacacagcatttggccctctggaggatacagtgacaagacaccatcttgggagtagagaaccggccctcgccagatactgaacctgaagacaaatgccttgatcttggagttcccagcctccagagctatgagaaataaatttctgttgtttgtaaattacccagtctcatgtattttgttataacagcacaaacagattaagacaacagctttctcagagcccaaaacatttataatagtaagaatttgcaaaatcaaacaatgagtaaggcctcaaatgatcagctgtacttgctaaaaatgaaagaacaactaaatcactcaattcacttgggcaagacaatccattattcgtctaaaatttttgttaataattttctgatttactatctaatagtactggataccatacaaccaattactcctacaaatttttttgttaatagttctctgttttgctttttaataatactggataccaatactggatatccaaaatggtttgatagttgggaacaaaggggataaaggaaagaaatgtactataaccagagatttttgaaaaataatgagactgtatgtactatgatacttcactcagaaaacctcacttcaaacttaatgggaagagaaaaagattggggaagaagtcttcaagcacagtccataatattgatagatagactcctacacatattaatggttgacagctagatgtcaatgcctagagcacaacaaataggtcttatatatcactatattttttatgatgcttggcattgtattttttttgtttgtttttgagacggagtcttgctctgtcacccaggctggagtgtattggcatgatctcagctcactgcaaactccatctcctgggttcgagcgattctcctggttcagcctcctaagtagctgggattagagtcgtctgccaccatgcctggctaatttttgtatttttagtagagacagggtttttccacgttggccaggctggtctcaaacacctgacttcaggtgatccacccgccttggcctcccaaagtcctggaattacaggcgtgagccaccgcaccaggctggtgtagtattttatacacagcatgcatcaacaaaatggatcagatggatgggtggacaaatggataattgaaagaataaatagcagaaatgataactctaacttttaagagtctatcaagctaaaatgacttttgaatcagtcgaatgaatgtacgtgggaactgggaacttaagaaagagaaggagcataaattgcaattgtggctaaagcagcagaatgcttatttacataagttttaaccagtgcggaatattgtaattaccatttatgttgtttttttatgaatccagtacatgcttattaaagggaattggagaaaataaaaataagaaaggaacgcaataatccagactgtaatctaggacccagtaatagttacttagttgcaaaatttcctcaagggcaatatgagagagaccattttgtgcttgttgccatgctgggggtgcctactggcgttaaagaggtaaggcccagggcttgtaaacatcctacaatgaatgagagttctccacagcgaagaattacccagcccaaaatgcaaaatgggcttcactgagaaaaactgagtaccttgtgcatttattccacgtctttatatgtacataagccacatacaggtttttaaaaaataaaaatattatgctgcacaaactgctttgtaatttgttcttttcacatactgcaacaatagcatccttccacaccattaataattattctacaacattttaatggctgttcagcaaaccactgcatggatcaaccataatgcatttaatgaggtccctatgatcaaacttctagcactatttttttcaattttgttttataatcaattctgtgataaacatcttcatatttaaacttatgatcatatttaaattcttagacatgcgactggtcagagcatgcataatttcaatgcttttgatagacttccaacatgtcctcaaaaatgacttttattagtttattctctaaccatattgttctgattgatggacatctctaacataaagttgctgaaaatatgaaacatcagctgaggcactgtgaccctgggaactggctggtcccttcctagcccacatcttagtagaagatgcaagggttattgtggaatacgtccgcgggttaaaaaccatgtatcaattctaaattccaagtgccagaccctttcattacctttcattagcgaagtataaaaagaaagagggagaagggattttcaaggaaagtaataagaagggaagtattagtggaacattagagtttgtctctggtccttcctctgagtggggactcatgaggcttggtgttgtctgaaagcaggaaggacttgggtcttactccctggtaggatgcagcctgaggagcaaggccggcagtcacagtgtgagcaaacattcatacagacgtgggggctgacatatcaagttggagaatgtatgctcacttcctgtcacccccatacaccctgattcccaagagttgaggcagttgtggtaggggttcttaggtttcccatgggctcagattaggcctcggacggaagtgaaggcagtggctggctgggtgaaatatggcggacagagtcggtgagtaacaggagagcatgttatcccttttagacccctgaagtattagagaggatcagccaggcacgtttagaccatatgatgtatcatattgtagattcaccccaaggcatttgtggctgtgcagtaaaagtgcaggatgaaaccagactctctgaagggtagggatattcccgtccctatccctcatcttttccccctttgcagataaaccatcccactttcaaatgaacttgggaggagggggctttgaactgtgcttggggttgtttctcctctggaaatgcttccattctaaaaagttctggcatagggaattggcctaaggaaaaactctgccctccttccccttaatggactgtcctgcctttgagtgtgagtaaaaggggctgagatcattcatcagccaattttacagctgcaatctacttagacctgcccccatctaggtcaccaaggatctttgtcagcatttggtacaaagcctatgtgaatgaagatggtcatttctttggtgttgtcccaagaaatgtaacagaaaatgactataaaagaatggattctgatatgggatgctgagtcctgataatctctctaaatgtctttcatctaggacctgcaatcagccattattaagaaaaagagaaaaggattgcaggggacagttccaattaacctgtggcatcccaaatctgtgttttactgaacacctagaactattctccatgggtttggcgtcaaagaggcattaggaaagatggtaactattcctcttacatacaatattaaggcctttgagatttgcttcagcttaacagagatacttttaaactttgttaatttaaatgtttcccaaaattatttgagcagagaatccattctaattataccatgtgcataatactcaatggaatcacatgactttggggaaatcagaggaaaactaatagtgattacattttatttagctaaataaaacggcatgttcagtgatgcttttccctctttgtgttatacaatttacttacttaatatcatcaaactacaaaggaatatggaaaagattttctgtgatcatgtatcgacacacttcttagagaaaatgtaagttcttggcaaaatattacaactgtataatgcactacaatttttaaaaatcttttgtctgcattatcttatttcattcacactccaaccctgggcagttggctggccagttacagatgagtagctatggtttagaaaggttacatgagttgccagggatctggcaacgcataattgaatacattgtcttaagattcaagctattaaacacagactgaaagcattttgaactcatttaattcaacatttttatttcacagataagaaaactcatgcttagagaggggagatgacatcatccagtagagtgagagagagaagaccaactctctgttccctgaattcaagcccatgccctccacaccatgccatgttttccctgtatatgaccaaacaaaatggtgcagttaaaccacgagccgtcatgcacaggagggccagctggccatcatgctggatcaaacagcagatatagaccatctctagcagaacacttgtgaattgcctttgtttcaaactcataaatgttagtatacctttgtaggaggactaccatgaaagatgaattgccactataagcagtcattagtatttagtggagattaacttttaaaggtgcctactttagatatgtcataatattagaaattaaggatgaagtatttctatctatctatgctttgtaggacaattatattaatcccaaagttacctgacataagtaggaagcacatgcctcttctgatatatagcaaataatatatactcaatccactgagcaaaaattggaacctcaaggcaaagctgtatgtacaacctcagaaaatctgtgtggcatgaaataccgtaacgtacactgaaagggcaattttcgatttttgtgaggattcccaatagccaaatagaaaaaaagtgtgtatacatgtgaattggagatgacttgatattaaggattgtcagacttatgtcaccccattgtaagcatagatagttaaaatctatttgatttcattaaattaaaagtgtacattattcatcacaatccataatgtaactgaattcattcctatgaactgaattccaattagatttatcatattgttgttgtgaacaccagagaaaagtaggacagtcccacatctaagcaggaagataaaatatatatccgttctttatttccattttttcacttacttgttcaataaataatctatttattcaacaagcataatttctggctcagtattctttgcattagtattcactatgacattaataagaattaaatgctactttggaattttcacaagtaactgcttagtgattccagaatcacctggtagaaggggatatttaaattgcaacttaaaaatccaaatgttgttaaaagttttaataaaatttcttataaaaattacttcatatacgagttgacaaattgttcattttctccttgtagaagaacaattaaattgatgagatgtatcatctaactctcatacacgtaattatatatttgcatgacaaatacaattggcatctcatttacctcatttctgtacccttgaatatcacgtaaacatattttgtcctgatttttaaatactttgaatagtttgagaaccaaaagacctcttttgacaatttcctcttgataaagcaaatagcatcatcaatgtctccctaaaacttaaaagctaacagcctatgcttgaaggggcagaaaagtcaagttatttcttactttttagggacaaacaggttgtttatcattgtagttggagacaagatatatggaataatatataaacacatcttatcctatttatgcccgtcacctaaacatataagtgctatttttccaagtttattatcaaattacaaagtggaaatatggctcagatggtagtagaggtaaaaacaaacctaagtcatgtaagatgagtaagtctaaagatctaatgtacaacatgaagattattgttaataatattgtagtgcatactggtaatttttcaagaaagtagattttaggcactgatagtaaaaaagcaaagataaccatatgatgatgggtatgttaatttgcttcaatgtaggaatcacttttatatacgtgtgtatattatatatatatataaataaagataagtatctcaaaacatcatgctgtacaacttaaatgtatacaattaaaaataattttacaatacaactaagtttgaagtcatcctacatttaacagtatctcattaatgaaaccagcaaaattatcatgccatctttgcaagtgaaggaatactaacaatagacgttagcacatgcacagtaaaaatgggttcacagaagtgtggtcattgctctcacgttgcagtccacagaattttaagctatgttaaacatttatgaaggaacaagggaagtgcacaaatatgatttaaacctatttgttggtgtaacgtgatgcagttctatcccactcatcctataatacatttctttgacaaacaaaactatcatcgcaatcagttctttgaatattaaaattggatgtatagtcatgcatatgttgtgggattgtaatgcttacagactattaaccactgatcctaagatttgggtggaagtatttgtctctatatctaagcagctaaaatatcatggctactatctgtgcgtgtatgtgaggtaatttcagtctactgacaaaaacacaatttaatgtatgatatttattgagagcatcagcctctctcatttctaagataaatctctttttttccatgatggatatatacttgtaacaaaccatattgttctcagagaccacagctgctccctttttcccagggtaaatatgtcagtctcccggcctgaactgcccatttcttgaaggcaggagccacccatatgttactcagttttgtatttctcatggtgcccagctgagtgtctggcacatattaagtactcagttaatgatttttaatgaaaacatagcagtaagcctattttccttataattttatacataattacagagtactttcccacctagaaccttacaggattaagggtcattagaattcactattcatccatcttgaacccagtgaaattttgtcagatacaaagaaaggccataataattgtgtttctaagtggggacagtttatgtaccattagtgggctctcatatgagtgagaaataccaacttttacataccacattgcaaaatgtcactgttacatacctttagaaacaaatcaatcttaaatttttctttaataatcacagtatgctttaatctaagattatagtgccagtaatagtatatgccactcgaaacacaaatacaaatcaggcaattcattgtgtctcaaagcttttaatttaggtctaaatatacctaatagtcatctggttatcttctgaagtcaagcacaaggacaagaaccaaacttttaattatttgaggcaatgtattatattaacaattattagacacttaaggggaaagcttactataaattaaaatatttctccagtcctgacatctcttattactaccttgttataaaattattttaagattatgcctgtgacctgtgtgtgcttcttcaaagaaatctgaaatgttgcctgtgacctgtgcttgtttgtgaaatcaacattaaatgattcagctgatggcaacatacatcatctgattaatcatttaatcagagggtccataacactcaagtgtttaaaaataaattttcatgaagcccaacatgacagccatagtaagtcaaaggaaatgagtaaaaggatacttagatattatattcacaatgtcaaacctgacattttaaaacctgctttttttttattcatctagcacacaactggctagctatccttttatgaattaagtcaggattattacagaatatacacgtgtcaatccatttgaaatcaagatttaaaaaaagttgttcataatatattgatgtaatttttccaaaatggcattgcttaggaacttcattctgattttgaacaacaataaataacatcgctgaacctggatgttttaagtatccaaggcaacagacatttcaagcttatttcttgcgtgaaaactattaatcatcatgtagataagtcgtgtctcaatgggatatgataacgaagctgactgctgtattatttgtcaggcagtggcttcacagtttattcaggacttttgctctctaaaactccagaaaattacaaaaatataaaaacttcaggatccaactcttttagagcattccatgtggcatgaaagagatgctcattagttcagcaaggatttatttgagcaccagccacaagcaagacactgttgaggagctgggatagaccaagtgttctagtggctactccacactgcacgcatagtagcattacagaataacgctgattcaagtcactttctttgtacaatattcttagaacaagcagatctttcttcttcaatagaagtaggaaatataaattttctctatataacatcactgttgctttgcacttaaaatttctgcctgtgcacttttaacctgtttctactctgccaatgaaaggtatgaacttcaagaaatgaattgtatgactgataacttcttatgtgcacatgagtaaaaatatggatcaaaagatctattattctaatgtactaaacacaagagttaatattgttctgtaaaacaaaatcttataattcaagataactcatttgtcctttaactagtcttatacttagaaattattactaagggcagctacattcatatgatcaaattaacaaaacaggtatctgctttgatttactctcgatttattggttgttcagaattatgtcatttaatttccacctatttgtgaagggagagggaactttccctccctcatcaactagagggtgatggaccagataccctcaaagggcatgaaaggtgaaaaccggtgccattactccctttcagtgttcctgatcttaaaagcagagccattaatccacttctacaagctagacatccagtacccctacttgtcacatccctcttcctccaagtttctggcacagtgtgagcaaacattctttcttgaatgatgaatgagtgtctcaatgcagtcattaataagcatttcaagcaaaaagagtttgcttatttctatttaccagggtcattttgatcaaagtttaaaaaatgaaataaattatttcaaagttcataatgaacaaattaaatactttcattgaaaccatccagattttttagcatcccatagatgtgaccacaattgcagacatttattagagtattctttgaattattatagaaactcagaactttattgctaaattagacttcaacaattttctagtagagcttcctcattttatgagaaagacttttaggagatctgcgaaaggttatccagtcaggtggtgtatgagcagagaggaagactagccattttcactctcagtccaatgtttatttccacaactatgctgcaatttctaggttctatggcttcattttcatattagaaatcagtaagaaactatactacctataagggaaatatctccaaatgattaattttgtcacatcacttagatttctgctttaaatattaaaataaatagaagtatttttagatgggtggaaagcaaacccagttttgtaaaagattaagcactttcatgctccatttgcaatttatattgtatgccttaaatgcaggtgaataaaagacggtacatgtttccctgttgcttaatattctgaagcaataaaatcctctagttaaatctagttgtccataactgaatgtataaagacccaaaggaaggtaagttttgaggaagtgcttggggaagtgatatagtggctggaaaagtactactggtgtccagtctattccaaatgactgtgcaatcttggactacccacttcctctgtagatttctgtttcctcatctctacaatcagaagattgatctgaacagagggtctgtcaatggacttcccattaagctctttgatgtgcgtatgtgagtgcgcatttttctgaagctaagagggtctatagcttctattagcccgtgaaaagggtcggagacacaaaactgattaattgcctgtgtactaatttaatctgaggtccctcttaacttgtgaaatcttacgaagctataaatagaattaaaattttagatggaaaccaggaattaatataattattatccctaataagattatttgaaaagcatattttgtacaaaggggtaccaccatgaccaaccatgcattcaaacattagctgaagaacttcactagaagcccagtaaggatttgccatcattagcatccattgcaccagacactagacatgtaagtacatgtagtaaatctaaatatatcacagatatttttgttctgcctttttattatcagagttttaatgggctatcaaggtaaggctgctacttaggattacatgaagtggaaacaacccagaatagtttgccagcaaataaaacttctttctcacaattttcaagatattcatccaaaatcattttgattgtaacttttggatagctgaatagcactgttcttatactaagcatatgattataaaagacccagaaatgaaagttgttgtgcttactcacttccttccctccttaatttaataaatgtttgttaattgtctactgtaagttggaaactctcccagacacttgtgaaatatcaatgaacaaaataaatatatttcactctcatggtgcctacattctagaagggagaaataaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaaggaagggagaaaggaaggaaggaagggaaaagaaagaaaggaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttccatatttaaaatgaaagttataatatctttggtataatcttattcgtgtcccatgtttgtcaaaaaaattcagtcaaaattcttctcagaattttaaaatctacctcaaaactatatctctggttggtatgtattttaagtctctcatttcccacaaatatgtatttggcaatgaactgttatgtaatatgcagatatgccatttaataagagatgatgtcactataaagaaataagtaaaagaactttattttggaaattaggaaattaggcacaaagggatttgttactccaaggaagagaaattccaagacttacaattaacatgaaagccctcattctttctgaaatgtcactgttcctttggcattttactacattttttgtttcattaactttcttccagaaattgaaacaatcataataattataaaatttgcatggcatttatctgggttaatgcctgaaacaagcaagaccaatataaaggtagcactttttcacaaggggagggtcaggtagccgttccccacagtaagtatcttgctcctgcctccaggcctcacatgaaaatgaaccgtaatctcaccagcttataaatgtaacacaaaacgtacacagccataccttgcccaactggtcctttttgacaaagccagtggctgctgcaatgctccctgctccctccactgtcttctgggctactgctgtcacacccgtcaccactgctcctccaacatttgtcacttgctctttggtcttctcagccactggtacaaataaagagcaacaacagattaaagggtggtagaataacagtgacttaaaatcattccacttccactagccatcggcttccatacacctgtatctacacatgccatagataactgagtggtcagaagaaacaaaagccaccaagatgtccaagtgagtgtggttcaaccaaacattgaatcttggctaagatattttggctaaagtcatgcagtattaaaaagtgcttcaagtttaacgatcaggaatgtaaagccatgagtgatttggatttggtttatactatggaaagtttacagaaagcaattcttacaggtgcagttatatttgaaccagactcagcatgaatatttctttatttcaattcagtgccaatcctttgatctcactcagcaagttaatttccaccacaccttctaagcaacacaatacatacttctatttatttatttatttgagatggagtttcattcttgttgttcaggctggaatgcaatggcacaatctcagctcacagcaacctccgcctcctgagttcaagctattctcctgcctcagtctcccgagtagctgggattacaggtgcccacaaccacacctggctaattattattattattattatttgtatttttagtagaaacagggtttcatcatgttggccaggccggtctcgaactcctaacctcaggtgatccacccgccttagcctcccaaagtgctaggattataggcatgatccaccgcacccagcccctacttattatctacgtgttcagacgtggtattatcacatatgtacgaataacagcataagaaacggttgtgaaggaacttggatctttttatagaacttcaggtagtgaaacaaagggttcttaaaaagctaaatttgcagtaattttaataggagcacaggagctagacagtatgaaaatgaagaggctattgagcacccttacaatttcttttcataaaacaaaatgagatacggtcattcagtagatttattaaaataagttaacatttttgagaagacagtgtaaatagtttgaattgagtttacaagcagaagtttaatttcatgtcaaaaactttcttgttcagttaaataagccagaaacagaaaggcaaacaaccacatgatctcactcatgtggaatctaaagaaaaagaaaagttgatatcatagaagcagagaggagaacagtggaggagagtggaggatggggacactcatctaaggaaatgaaggcacattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacacccggctaatttttttatatttttagtagagacagggtttcaccgtgttagccaggatggtctcgatctcctgacctcgtgatctgcccgcctcagcctcccaaagtgctgggataacaggcgtgagccaccgcgcctggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccagaaacggtccacagtagtgttgctccctatttgtcttttaggctagaattttgtacaactacctaacaactccgtgccacttctaaggatatggctgatgtctccttaagagcaagagctatttacaattcaaagttcgatttaaatgccagcgaaaagctgtactgaaaatcttatgttttaaaacatttctgaaatgttgatcctttaaaaatagtcaattatgtgtttcaagttgtcatttttttccttttcaaggacgtgaattgaaaattttgcttgaaacgaacattttcttgttataaaatctcaaagcgagattaaaaataggttttgaattttttacagatccagccataaattttataatatctagatagccttttatatatgtataaattttaatctagttttaatgcaatacactgcacagtaaaatgtactctacacattattataattttgttgttttattattataatcataaataaaatggctacattacaaaatgacagagtgtacatgtagcaataatcgacacatttaaaaacatttctgtagaactgatttctctagtagggtctctgctgacctttaacctctatttttccccttgagggcctttcacactatctctctactcactgacattccaaatgacgggtgacaaaacaaaaggaaaagagacacactcatattagtacattttgggtctaataaatggtaactgtttttcggcaattgagttctttgaaatcagggattctgctttatttttctttatattatttcatagtagataataaataatttagaatatactaaaatgaatttagtgtctacctctaatgtctgcattaatataaataataggtttatatttgactttagctactttaaaaataaaattccaaaaaggaaatgtgataccaacttttagaatagatatagccaaatctaacctttgacattaaacaaaattataaaattaatatatggttttgaattgttatacaagtaaatatgtatatttaaatatacatatgtaaatatggatttaaagaaaataaatttgaaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttatatcatagtttatttttaaagtacctgaaaaaacatatcattcagtaagtttaattaaacacattttcatatatttctataatatgatgcattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggggaaattgtttctttaatattagaagataatattaggtactatgtaataatttcttgtttccctgcattaagacttgtagcaagaacaattaacaattagttagcacttaatatgtacccataataaacattttacatcaggcataatatgcaaattattctccctctctttaaccattgaagtgtaattatcttatttcttctcataattagacttaagcactttatattaaataaccctattcaaaaagttaattcatttatctgatgtgggagaggaatgattatgatagcagccgatttatcccaatgtgtttctcatagccatactagttatgacagcatttttggttatttcactactgccagggtggtccatgggtgcaatcgctgtaaatattgcacatgctgaaatcaccatgtccttactgcctagcaacatttcccatagttttctgtggaacactagtttcattcaaccctagtaactaatgaagaaagttttcaataatcaaaaagtttgaataaccctgattttaactatgtaatgcaaatttctttactgtaggacatctcagattccttaatacgctaaagagaaaataaagtatacaaagtctcccaacattgtacaatgttagaaacttaagattgtgagccactgtccttcagaaaacattttataaaatgtctaattgtacaaacttcagtctctctctctctctcacacacacgcacacacacacacacacacacacacacacagatatgtgtttacattttggcattctggaaaagactaaaaaaatgcagcccatctccacagtctccattagatcatcaggtgacagtaatagttgggttctttaatttttaccactgactccagaacttgccacatgcttgtctgctttctaaacctcatgggttcttcctcaactactaaatggaacaccattcatctaggttgaccgtcttcagatagtggagtctccacctgtctgttatctagttcttattataatcatgcttcacaatatcatatttataggaggtccctagaaggcatcatagtccacttacttaactacttctctgttggattgcaacagagcccattaaaggtgcacaattaacttctaacagaactagtttcaaaggagtctgttttatttttacactctgatttttaaatcaaaagtattcatttaaagaaatatttttctccactagttgtaaaaatgttgcacaagaaagttcactataaaactataagtaacacttataaaatacatattgtttgcttttgttttccagatgttttgtgtacattaattcactgaattattttatagatgaggaagctaaatcacacagaggtgaagaatcttgcaaaaaacacacagctggtaaggagtaagcaggaagttgaaccaagaagatctgactcctgtgtttttagtcatatccacaacactgtattaagattcccatatcattgtcctcatttccattttagaagtcagtgataggaacattttatttgtataggcactattgtgtttaatgctttccgattatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattgtaaacctaattgacttgttcaaattctcggtaaatttaggccaaatgaataatataatcagaaatgtaataattgcacaataatatttgtacaaatagctataccataacaatacaaagataaatacaataaacattttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgtcaatacatttttggtcagaatatttaaatgcccacttactataaattaaacatagcttatcaattcaaagccctcattattcttggcaagtatattttttatttataatcaatatttacctatttaaaaatactttataaagaattcagtttcaataagactgatatgttcttagaatgctcagtgattgttttacaatttcataggaatcttgaatactgggccacactaatcactagatactttaaatatcatctttggatataagcacaatggagcttacctgttgccacaccatgcaccactccctccttggttttggagcctacaaaaacaaattcaagacataagtctcaagctagccttaaattgctgattagctagttttcaatacaactaatttaaaaatctcaatcttcagaagtatatatattattatatcttcagggaaagaaaaaaatatatatatatatcctaaaactagaagaaggaactccagtaaccaccacaataaatagaagaaagcccagctaacaggaggtcctctccaattacgattttagcacaaaataatgactttatcccctttgttcccacatcacatgtcaacttacagaggagaaaaaagaatgagataacaccggggcccagtgagaagataattttgaattcagaactgtagaagctttaaaagtacagcactagagacagatcagtcaacccatgaaacaaaagggaagaaggatggagagaaggctttaacatgtgctgaacacccattatgtaaaaaaaacattttaggctgggcgcagtggctcatgcctgtaatcccagcaatttgggaggccgaggtgggcagatcacgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaaaaaacaaacagacaaacaaacaaacaaacaaaaaacacattttacatatcatcttatttaatcttcataacagccatttaatatagttatattatgcccattttaaatagctgatgaaattaaaaatccgagttaagtaatttatgtaacattacacatgtaataataggctataagcacattcaaactagggtctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatgttttacagaattatcatactcctttttaagtttggatcagtttacaaaatgttatcatttgcactttaatgtcatgatatactgacagtgtatttaacataaggtgtatttttcagcaacacttcctctgggacaccttcactctttatcacaacctctttccccattatacggataccttcacctcactacgttcctctgactgcatatttagagtctcctgaattgcagcagtgacaacatcctcagggtagctacttcctgtatacatcaacttatgtttgattcaaattttacttccagaatgtttcacttcctttgtttgctactctttcatctttgctggccagtttcctcttttgattgcgcattttcgtgaaacatcacatgggctcaccactgggagacaatgtggccacacaagtccgggcattgctgtctgtatgaactgcataacagatgtgaagcaaccaatctccaaaaagctttgaaagaagtgctgtggttttgtcactgattataatgggtttctgttatttatgtaatgatttgaaggctgaagagttagcagcaaagtttgtactttatgcaatgactttcggtatactgtggtaacagaaatttgaattgtgttgttagtggctggtgttatttaactaaccatagtacctggaatttgtttgtgctggaactatgcagagtgagaacagctgatatttaagagaatatgtttcaatctctatctctcatcctcaccacctgcaccccatgttgtcttaaaaatgactagtagtaagaaatgtctaacagctggaatgcgatctttgttctttgccttagcagtacctaagaatttgacctttggttaaattatgaaacatattctaaatcaaagacaatgagatagaagtagagagtagaattatgattattagaggctgacaacggtaagagggaggggaggatatggagaggttggttaaagaatatgaaattggagccaaatatgaggaatgagttctagcattctgtagtactgtagggtgatatacttaacaatagtttattgcatatgttcaaaaatctagaagagagaatttttaatttttactgttcccaccacaaaggaatgataaatgtttcaggtaatggatatgttaattaccctaatttgattatcacacattgtatacatgtatggaaatataattctggatcccacaattatatacaattattacatattcactaaaaataaaagaaaaattaaaaatagagtagcatatgacccagcaatccctcttctgggtgtagatccacaagaaaagatttcagcatatctgtttccaagggccccaacacagtggctcttgcttggaatcccagtgctttgggaggctgaggcaggaagatcacttataactatataaggaattttaaaaacactaaaactaatatttatttatttagcaaaccagaatttaaaacattagaaattaaagtgttttatttctttgtaaaaaacttatcaagagtaatgtaaatagtgtttgtcttcttctcattgtataacttcctatacggagtggacatgttttttatattttacagaattgtcatactctattctaaatttgaattaggagtttgagaccagtctgggcaacagagtgagatgctatatctacaaaaaatattaaaaattagccaggcatggtaatgtatgcctgtagtctcagctacttgggaggccaaggcaggaggatctcttgagcccagaagtttgaggttacagtgagctatgataacaccactccattgcagcctgggtgacagcaagaccctgtctccaaaaaagaaaaaaagaaaaacataatagccacaactaaagtgtctactgatagataggtagataaaaagattgtggtacatagatacaatggaatatcagtcagccctaaaaaaacaagatcctaccatttacaacatggatgaacccagacaaaattatgctaagtgaaataagccaaacacagaaagaaaaatattacattatctcacatatatgtggaagcttgaaacaaaattcaaatatacagagactacgtaaaaaacagggttaataggggtggaaaagtaggtagaaaatagggacatataggccataggatccaagcaagtagcagatgtgtaagatgaaaaagtgtacagatctaatgtatgaggactgtaggtgataaaattgtactatatttgagattcatgataaataagtggattttagctgcccttgccacaaaaacaacaaaaaaggtaactatgagagattatgaatatattaatttgcttcaatatagtaattttttagtgtctaatgtatctgatagcatcatgttgcataccctaaatatacacaattaaatttatttttaaaaaagaatgccactaggccgggtgcaatggctcacgcctgtaatcccagcattttgggaggccgaggtcggggatgatgagatcaggagttcgagaccatcctggctaacatggtgaaaccccatctctactaaaaatacaaaaattagccgggcatggtggtgcatgcctgtaatttcagctactcaggaggctgagtcaggagaataacttgaacccaggaggcggaggttgcagtgagccgagatcacaccactgcacttcagcctggagtgaaatgacagattgagaccctatctcagaaaaaaagaaaaaaaaaagaatgccactaaaccacaccattagaacttataattaattattttttataaatatcttatgcaacatattttatatttttgtagtgcaaccccaaagagataggtatataacttaaaaaaacgagataaatgagagtcctcataaggttaccatgtatcaaaccaatcagttgttctttgaggtcataattatttactaataatctgtaattgatggttagcctttaatttatgagtaatctgtaattgataacgtacacctacaaaataggtgccaagtggttatgtgactagcaaggtataaatgctgtagggacaccagagctgatggcttccctgagcggaggtgtcccacacacaccctatcttgtcttcccaacctcaaaagagcacagagtggagaagaaggtcagaagtaatacctgagagttttgagaactcagttatccctgttgtgcatgttatgttgactttgtcagcttagtgaggtgaagcacattttgacttgagaatttgctatcaatttcactgatggccactgctgcttattgagcagagtggcattggaagacactcaaagatcatcattttcttgtatttattgcatttatattactgagcattatataaagataattaaatctttctgcttttggatttagatctaattaatttctgagtcatttgaagaaatttttgtctattaaattgaagtatgttgattgaaaattggtgtacgcagataacaaaaatggagggaacaaaacccataaaaataacactgatcattaaggtagttcttcaatgagttaaaaagtagttgttaaaagtatattcttataaaggaatgagattacttttcttatgaggcttctaccaaacatcttcagccataagtgaaattataaaatggtctttggtcgcctccaatctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcccacaaaaactgcaaggtagttgcagttttctaaatcatattttttactaatcagggaagtgatgctcagagatgttaagtacgcttccccaagaccctaaaggtgataagtgatgtagtctcaactaaaactttggtttgtgtgattagtgcatgttctttccactctatcagtagtcagcaagctacaacatacaagacaattccagcccaccacctgttttgataaatgaagttttattgggacacagccacactagttattgtttatgactaccttcacacttcaacagcagaattgagacatagatttttttttcttttttttagacagggtatcactctgccacccaggctggagtgcagtggctcgatctcagctcactgcaacctctgcagtgagctgtatggctcaagccatcctcctacctcagcctcctgggtagctggcaatacacatgcatgctaccatacccggctaatttttgcgttgtttgtagacacagggtttcaccatgtggcccaggctggtctcaaacccctgggctcaagtgatccaccagcctcgggctctcaaagtgctgggattaaagacctgagccacggcacctggccaagacatagatctcatggcttaaaatacgtgctatctgattccttacccaaaattttgccaatccctggactatactattgtgtcttcacatggtcattttttatcttaaattctgtgtgtaagttcaactctcaattagaactcagaatgtaaccaataaaaaatttatagaatgtgctatgtgttaaatgccatgagagacattgaaaatgatttcaatgaacagttaaaaggtaactaagtcaaagaaacttgtgcttgcagaacttggaaatctgaggacaaacggaaagatattgataaactgcatgtcactgattcagtattccaaattccatctaaaaaggtataattcacacttcataaaatatttaaaattaactcatcaattttttcctcttgtaacaccctatttcaatgactttctgaaaatatgttttaaggtagaaaaaaagtaatttaattgaagatttgtgggaagattaagtcaacataagaaaagtctaaataatgaggcagtggcacatgcctataatcctggctactcaggaggctgaggtgggggcatgacttgagcccaggaattcaaggatgcagtgagctatgatagcatcactgcagtccagcctgggcgacagagcaaggccctgactctaaaaactgaaaataaaaaactgaaaaaaaaatgtgttgtgaactttgatgagatgcattcatataaatcatcccaagtataaaatttcccccactgatctatgttgaagagatagtgtagctttctttcactttgcagacatagacggagcacatgtttcagctaggcaactcaatgtggtcatcctccacctgactgttcatcctgtgactcttactgctatagttgccaccagagaatgtgaaaaagctcagaggagaaagaagagaggaagaatgggcaatgtgtctgtgttgagtgtgtgtgtctatgcctgtggatgagagtgtgtgtctattcttttccaaggaattcaaagtggtttgtaaaataacactcaattgaatacagttcaagttacagaaaagagagtcagagtttgggtgtataccccaaggtggaactttaggaacaagtaggtaataagcatcaatttctttattcttttagtatgtgtgtcatttgatggatgaactatacaaatgtttctgagagattagtagcagccctcaagcacttttctctgtcctcagtgttcacagagaccaaatgatcacatgaagtaactctatcaaagactaatctgttctttccattttagggccacaaataggtctctttatacacatcacaggggcatatcaaagtcatattttaaaaatcagaatggattaaaattgacaaacatttttcatgatggtaaaagaaatcacagatccatcaatgattttgattcttaagaatattcttgattattttttaaaagactatgagtttttaaaactgttctctgaaatagaattatgtaggtacagaaacattcatttttaaaaagtcataaatattagggcaaaattaaaaatctggaaaagcaaacagtcgcattttttactattagctcaaatacacacgttcacattcacctacctacacatacctctgactcagtccacctttttgacaagcaatgatgcaaaaatgaatcaagagagagaactaccagcatttagagtattgattatcctaacccatcactcatgaacaagcaccaaactgacatttggggtttacctacctacatagagaacaccctcttttgtctttcctgctgcttctgccacaccctgtttggttttctcagcagcagccacaactccctccttggcctttgaaagtcctttcatgaatacatccatggctaatgaattcctttacaccacactggaaaacataaaatacactttgaatgagaactttcggggaaaaataaacaaaaaacactgaaaaatcatgagaaaccctccaaagtgtgagactcttttaagtgtacactcatttaaccattggacaaagcagacatttttagctctggcattaaaaatttagcatctcccatccatcttggctagtaaaagtctagccacctaaccacggattaggatgaatcctctgagttgttattactgcatttcagaagtggagttgcatgaaaagattaaccccttttttaaattcccggggtctaaagggtaacagtatgagttagaagcatggaagctggaggcttagggtcaggggtatccttaacatgaatcccagaagaaggctaacaggttgatggtggaaaggcgtaggcaacagaactaactgctcactcggggtgtggttcaaactcaggcaaacagcaggcccaagtgtgatggttctaatccatccaacatccacccccgccctcagctatctaccctgagcaggcgccgctcacactcgcgggccgtctccaaccccgcgccagccacccgagggggcgttctcagcctccaccctagcggaccccgcgccagcacttgttaacccgttaccacctgttgacttggcctccttgcacttccatttcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcagcgccgggaggtggctcacaccgcaccgccgagagcgctttgccctcgcatcgctgaaatttaatcacggtcacaggttacaacgttaggggtcgctttagttcaaatatcttcaaggttttcgtttgctcttaatctaggaagagccggaaagggtcctgagggtgaaagggagactactaaggaagagtcacaggttgaggaggcaggagaaggctcagcaaatcctctttccacgccactatcaccattttcctttccaccaatcagcgcctgccagacgctgattttcccatcagtggaacaaggaataaatattccccagccgtctaaaacaagcggtcctaaggcttttcgctctagaaatgggacttactttgcagacctccctttatctgggagacaaatccagcgtgatttagcctaccggaccatcatatccaatttcttcttcagccccttctgaaagggagatgctacacaccactcacctttctgacttctgattctcgttgccctcagaattgacacccccttttctctccccccacccaccacacgcacatgcacacagacatacacacgcgaacttcaagacaatttttgcatcgcttaacacattttcacctctttcagagctggaagacagctgttcctggatcacaccagaat

SEQ ID NO: 2026 - DNA, 112878 bp, Homo sapiens; identical to SEQ ID NO: 2024
  source 1..112878: mol_type = genomic DNA

SEQ ID NO: 2027 - DNA, 82435 bp, Homo sapiens
  source 1..82435: mol_type = genomic DNA
gctgagcgcgggcgcggggccgctacgtgcgcggggagcgcggggagcgcggggagcgcggggctgcgctcgtgtgcgctcctgggcgctcgccgccgccgctgccgccgcgcgcctttgagtcagcaaactccgcggcccgcaagcccggctcggcccggccctgctctgttctgcccggaggagccgcccgtaagtgacaagagacccgctgagggggcctcccctgcaccgcccaggtggggacggcggcccttctttccagaggcgcgggcccttcccgctgttcccaggtgcccgcacccttgcgggctggaaagaggtttgggtcccttgggcttggagcagaggagccgcctccttttcagccgaggtgtgccgggcagggagaaatgatcagcgcggtagagcggggagatggagcgcgtcgatccagggattcttggctaaaaagacaccccggggagagggtggggcagaggtggattctagattacggaagaagtgctgtggcaccttacaccaggccgggtagaagggggtggggaggtggtttttaaaatttatttatttatttttttattcattcattaacgggtagccttgagttgaggaattgggaggggtaggcaggtttattcgtgggattgtgggattgagggagaaggcccaggggaaaatccatataattgactgattatcagatttggtgaccaggaaagcaacagcctgtttttcagttccgatgcatcatacttttctcaaattacacggattattgagggggatcgtcacggaatggggagcaacatgtcctgctgaaaggaagggcttctatctctacaagacacgttaaaaatgatggtatcagaaaattagaacggggaggaggcttgcacatgatctccatcaaacctttcattttacagacagggaggctaaggccgagggacgctgagtgttgggaccaggatcattcagccagatgggagcagaaccaggcctacaacctggcaggcttctgacttccaccccggagttatgtccacctctggggcctgggaactgggtttggattgcataagctccccctcctctcccaggagggggctgggctggaggctgaggccttcgccaggaagaagcagggactgcttggatagttgaccagcttctgcaggggctcctcagtgagagaatggaggtgaggtcagggactcctgccttgcctctgccatcacttccagtgatgcctattcctaaggtaggtacatagctggaccttcattattcttaatattatttacttttttctttttcttttgagacaaggtattattctgtcacccaggctggattgcagtggtgcgatcttggctcactgcaaactccacctcccaggcttcagtgatcctcccacctcagcctccctagtagctgagaccacaggtgcgggccaccacacccctggctaacttcggtattttttttgtagagacagggttttgccatgttgccccaggcaggtctggaagtcctgagctcaagcaatccacctgcctcggcctcccaaagtgctaggattacaggggtgagccactgcgctcggccttttattactattttttaaaggaagggtagacttgagattgactgatagggcagtttttaataaaaatacaaaaataaaatacatttagaagaaactgtgtgaagatgtgaaatatcagtgattagcatggactcaactggtcgtcctgtttcttctaccagtccatttcattctcacttttgattaccatttaactggggaggacatcagtgttgacagtgggacttgctcaggctgacactgtgccccaccagggagtctcccctccaggctggtacacacttcctcttattttactaatgggaaggacccctgagttaggtaacctaaagtaatagaaataagcacgttcattaaaaaaaataaaagtatgttaatcaaagagtaacgttggtgttctacagcaattctgctgggctttggagcagtggatatcttttctcagccctaggatcactactttcattttaaggcttcattttgctcgttaagttactggggaaaataacttcttttttccgtttttagtgacagggctgtggtttcacaaccacttggtgaaaggcagacaactggttgagaacaggggccagtctatgcagattttcatttcctagcatggcggagaagggcttttggccaagctcatggttgactctgtggggaatcccccaaatttagcattgttatctccaaacatctttttcttagtaatctggtaggtatgaattagctcttctgttctctaagccctgttcaaagaggaaggtatatagtgtagtggttagaacttgtgattccagacccatctgagttgaaatcttggtataataattttctaagtatagttttgttggcggggcacttaacactctctgagttgcctgttattcagaaataaaaaagggtgatggtaatctttgcttcccagaactgttaatacaacagctgacatttatcgagtgcttactatattccaggcatcgtgacattatcgagcacttaattatgggccaggcattgtgaaagagtttttatgtggcagtctcattaagcatcacaacagacttatgaagcagattctgttactgtcttcagtttacctctggggaaactaagccatcagagtatttatgatttctctaaactcagcttacagttttaactacccaacaaatgtgtgtcagatttctgttataagctaatagttatctagggcttactgtgtggtaggccctgttacaagtgtcctaagtacgttaacaacccttgagataggtattgtttttctccccttcttctttctttttacagatgtggaaactgaggcacaaagcccaaggtcaaacaactagtaatgcgagagccaaaatttgaactaggagcctgggtctggaatcagtagtaactctcagccacccacctgcgaatgtaaagggcttagccaggcttcagtcaagggcaactcctattgatacttacatttatttttccctaagtaactactccttgctcccagtttctgcagaagagatgcttttagttctacaagtgattcaactttactcaaggctttgtgattcagtatgtatttctattgtagtctctgttatttttaaaatcttgtgctaggcctcagtgatcttgcctctggggacagggaaatagtctttatcagatctgtgaacccctttcaaatatatgatgtcatttttacttttttttttgatacttttgtagagatggggttttgccatgttgcccaggctggttttgaactcctgagctcaagtgatccacccacctcagcctcccaaagtgctgggattacaggtgtgagctactgtggccagcctgatttcatattcatctgcaaaagtgcattattctgggggagagaatctgtagctttcttcagattcttacgtggtcacccatggtggaaagaaagtcattattcaccattttattctaataatctcattttacaaatgaggctaccaaggcccaatggagaggcagaataacttaatctgaactacacagctaattagaggtaaaaacgggactcaaactcaggttcctgaacttccagtctcatattctttccattatagcctgatagttccctgtggattaagtggtgccagatcaatcaattacgaattgccagagacccccagctctctcaccaagctgtccaatgcatgaggccagcaaagctgcctggaagtgcctgtcaaaatacgacatcgtttggcatgtgatcctgttagctgagccactttactctgatttggtatgggaatctacaactcggagagatgtgagccaggaaaagaaaagctgtttggggagaagaagaggaatgttgcagacatgcattggttgaggcacaggcagccattcagacctcttggtagaattgtcgtattggaaagtttttgctaagagatttagaaattcaaacaaaattccctgggccgggtgtggtggcgcatgcctgtagtcccagttacttaagaggctgaggtgggaggatcgcttgagcccaggaggttgaggctgcagtgagctgtgattgcaccattgtactgcagcctgcacaacagaattagactctgtctcataaataaataaataaatacaaataacccccaaattccctgaagtctgagatttttgcatagtatgtggctcactgggaagtaagccatctcctggctgaagggtgatgctccaacgacaaaagaagactaaaagagttgggttctggtggctcacacctgtaattttagtgactgaggaggctgaggtgggaggattgcttgaggtcaagactttgagaccagcttgggcaaaagctgggtgtggcggcacacacctgtagtcctagcttcttgggaggtcgaggtaggaggatcacttgggcctaggagctggaggctgcagtgagccatgatctcaccactatactccagcctcggtgacacagtgagaccccaactctaaaaagaaatactaataataagaaaaataagaaaagcctaagaggtaatgagacctttaatagtttaggccagacttttaacacgacttaaattttacaaactgataataataaagcttacctggaaaatagatttgtacttgtaggcaatacatttttgaaaaagaatattgaggagaggcttgttcagccagctatcaaaatatatcaggtaggtaggacgtggtggctcacgcctgtaatcttagtgctttgggaggctgaagctgaggattgcttgaggccaggagttcaagacaagcctgggcaacatagaccccatgtctaaaaaaaattttagaaagtatatatcatttgggactatgaatagaaagtcgagaaatggttccattgtaaagacaggaattgagtgtatgataaaatggactgttactaagtcttgggaaaattgcctctcaatttggaaaagattagatccctgactcataccattcacaaaagtaaattccatttaaagattaaatgtcaaaaccaaaattataaatattaaaatatatgtaaatatagaagatggttttaaagagctttttgttgttttgagacggagtctcgctctgtcgcccaagctggagtgcagtggcacaatctcagctcactgcaacctctgcctcctgggttcaataagttctctgcatcagcctcccaagtaactggggttataggcacccatcatcatgcctggctaattttcttacttttagtagagacagggtttcaccgtcttggccaggctggtcttgaactcctgacctcgtgacccgcccgtctcggcctcccaaagtgctgggattacaggaataaggcaccgcagctggccagaagatggtttttagaaataactttggtgtaggaaagacctcaagtttaataaaattcagagaccataaaggaaaatattgatagacctaatttcatgaaagattatacttcatgtctagtagtttatttgaacatgaactttggctacatttcccatcttcacagctcaggcacccccaatctgtccttccccactgcagactggcaggtgggatttcccccaggtcatcctccttccttctttcctcacatctttcttcctctgcaggaaacagatttttcagggccttccatacctgcccctttgtttgtctctccttagttataagtaatatttttagaaatacatgtaaaatatcaagaaataatggctgcacctctgccgcctctctctcacctcttatttcataaagctggctctatatgttgctttatgtgccttagtatatgcttatggatattatatatattatagatatatatgtaacacattttttaaaaagtaaggaagaatatattaataccataaacaaagttaaaaggcagatgacagggctgggcgcggtggctcacgcctgtaatcccagcactttgggaggccgaggcaggtggatcacttgaggtcaggagttcgagaccagcctggccaacatggtgaaagcccatctttactgaaaatacaaaaattagctgggcatggtggcaggtgcctgtaatccaagttactgaggcaagagaatcacttgaactcgggaggtggaggttgcatgagccgagatcgtgccattgcactccagcttgggcaacagagcaagactcagtctcaaaaaaaagggcagatgacaaaggagtaaagcaaatagttgcaatatctataacaggcatgaactcttagaaatcaataggaaaaacaatccagcaggaatatgggcaaaggctattcataggtaattcacatatatatgtaaaaatgcttaatcttattaataatcagataagtgtggattaaaaaccatgaaacctttttgcttaggtttgtaatatccagtgttgacgaaggtgtgggaaaatagattgtcactatatatggcggagagtgtaaattggtaccatctcttggaaaggcacgttagcagtatttataacattttaaagtttgcatactttctgatcagtacttccacttctaggaccttatccctctgaaatacttgcctacttgaaaaaaggaagttgctccaaatgagccaaaatggaaaatgttcattatgcattatgttagtcagtttgggctgccataacaaaatgccatagactgggtggcttaaacaacagaagtttatttcttagggttttggaggctgggaaatgcaggctgatttgtttcctactgagagttctctccctggcttgcagacagccgccttcgtgctgcgtcctcacatggtggaaaaagagagaaagagaacaagctcttggtatctccgcttggtgtctcaccagtcccatcacgagggccccacccttttaacctcatctaaacctaatcaccccatcagaggccctgtttccaaataccaacacactgggggttagggctttactatatgcattttggcaggacacaattcaacctatactgtatattaagtaatgaaagcaaagtggaagaacagtgggagaaatacaatcttattttttgaaaaaatctggaaggatgatatgcccctaattgtagacagtcattacctgtggagagtgagattagaaagggaaagggaatggcattatggaggatttcagcaattttttttttttgagatggagtctcgctctgttgcccaggctggagtgcggtggtgcgatctcggctcactgcaacttctgcctcccgggttcaagcgattcttctgcctcagcctcctgagtagctgggattacaggcatgtgccaccacactcagctaatttttgtatttttagtagagacggggtttcaccatgttggtcaggctggtggaccttgtgatccacctgcctcagcctcccaaagtgctgggattacaggtgtgagccactgtgcctggcctctgattttttttttcagctcactgcgacctctgcctcccaagttcaagcagttcttctgccttagcctccccagtagctgggattacaggtgagcaccaccatacccagataatttttatatttttagtagagacagggtttcaccgtgttggctggtctcgaactcgtgacctcgtgatctgcccgccttggcctcccaaactgctgggattacaggtgtgagccaccgcatctggcctatatttctatttttttccccaaactttgaaataattttaaagtataaaaagtgcaggctgtgtgcagtggctcacacctgtaatcccagccctttgggaggctgaggtgggaggattgcttgagcctgggaatttgagatcagcctgggcaacatagtgagaccctgtctctgttttcaaaaaaacttttaaaaagaatagaaaagccgggcatggtggctcacgcctgtaatcccagcactttgggaggccgaggcgagtggatctcctgaggtcaggagttcaagaccaggctggccagcatggtgaaaccctatctctactaaaaatacaaaaattagctgggcatggtggtgcatgcctgtaatctcagccactcgggaggctgaggcaggagaattgcttaaacctgggaggcagaggttgcagtgagcagagattatgccactgcactctagcctgggcaacagagcgagactctgtctcaaaaataaataaaaataaaacaaagtgccaaaataataatttttttttttttggcttaggggagtagggactgtgtcttgctgtgttgcccaggctggtctcagactcctggcctcaagggatcctcctgccttggctcccaaagggtttaggattacaggcatgagccactacatctagccctaaatcttttatttttaaagataataagtctgttatcctgaaataaaataatacttaagacctgtggaaaaaaataacaaaatgatttgaagtattaacagggccctcctgcctagagcctcccagctgaactgcctagggaggggtggtctctgctagagtggaagacctggtcctctgaatttccaggtgagtgttcccagttgccttttctgctacttattttaaaaggtttatcccagcctccatctctgaaggcaggatgtatgcagcaagagtattgcttaattcagaagggtgatttaccctggatttcgtggtctttaagtgctttaaaagaattaggccgagcaccgtgtctctcactgtaatctcagcattttgggatgctaaggtgggtgaatcactggagctcaggagttcgagaccagcctggccaacatggcgaaaccccatctctactaaaaatacaaaaattagccaggtgtggtggcgagcacctgtagtcccagctactcgggaggctgcgatgggagaatcacttgagcctgggaggtggaggtggcagtgagccgagattgtaccactgcactccaacctgggtgacagagtgatactctgtctccaaaaaaaaaaaaaaaaaaaaaaaaagccatcatctctcagtttagttgtgttttctgagtatagcttaaaactagttatgttacttcatcattggtattcattggtgttttctcagcatcactatcccttcccaaatccccccaaaaaccacacacagagtgtatgtctaaccaggctttctggcattaacaaggccagatcttatgttactcattggtatagttaaatgtgtatattctcttgtgctcaagaaaggtggctggcaaggcagaatttataatgaactacagatgtcatgtccttgattttttcttttccctatgtggtccgaatcccttaggaagataggaaagggaagtcttgagctcctttttagattcaggctggaaatgcctactaaattcctaatagcttccaaggtgctgtgccttaagaagccttggattcctggggatgagagaacaaaaaagagggtgagggggaaccaaagggggcaccaaaggccaaagacagacttcacccaggacaagtcctgtgtccaaggagtgtgacaaggctttctgacatgcttccaggaacattttgtgtttatttggcatggcatgttttaggaaggagatggaaacatctatttagtactcaaccatgtaccacacactgtcctgggtacttcagtttacattatctcattattcctgtgatataggagatgctacagacattttcgacaattcagagatatttcatgacttgaacaaatggaggagacaggatttgagccacagctgttcccatacccatttttttttccagtactttattttaagagtcccaccattgagtttgcttttagagtcaaaatgcactctctctgatttaaaagttttttattaagggaaaaatttaaaagtcatactgggtacatcgttaggcataggactctgaggttaccacttctgatcctcaaacataatccatgtagattataaaaggctgtaacttggggactgggtcatacgttttttcccttataccatagacaaccagggctttgtaaaatacctcagagcattttaactttgacatcagtggtgtgaggttattttcatctcctttttttccaatctcccttcccattttccatctcaggtgtgcattttccttctttgtgcctttttatgcttccttgattctgcaaaggtccctttagcatgtggtcaaagttctctgggtatcagagaaacagaaagacccatctcaagctgtgtgggcccagaatcttacacagctctcatcagtgtagggcacttgccctgacgtgaccttgagagccaactcctttgcaggcaggagatggactctacgcaggctggcaccagcagtgacaatgggggccacctctgcagccccaagacaaccccacctcagcactgtgtttccattcacatggtctccctctgtgtgcagcaagcctcctctttcacgtttttgtacagcttctctcttaagcacagtacgccccagcctggcctacgtattgcccaggaccctcgggtaataccttactcgtcttgtgtgttgtgcactcttattctttgttttcaccagcgtggctgctttctgcggggtgcaccctcggtttctggtactccctgctccctggtgaccacttttgctgcatacccacaaaggctgggcttggagttctgaccccagttttgccatcactaggcaaaatctatttctggcctggcagggtggttcatgcctgtaatcccagcactttgggaggccgaggcgggtggatcacctgaggcccggagtttgagaccagcatggccaacatgatgggagggcgacggaggttgcagtgagccgaaatcacactgcattccagcctgggcgacagagtgagactccatctaaaaacaaaaacaaaaacaaaaacaaaaaacctgtttctgatggtctcagaaatgagagagagaatgagaggaccctaaaggaagggagatcagaggtaacacattgattaagaatcctcctcagctaaaatcagctactaagaattagaatgcgttagcttcaactctgttggtggcagatcccctaaagtctttgaaaggctttgtcatgattctttcaagattacagtattcttgcaaattcatccctttgtgcttcagctgttgctggttttaaagaagagaaactttcctaagttagcattggagttgggggcttaatgtaaggatactgcagacaactcaaaggcaactgcttggaactggaaagtcaaaaactgaagctgcactttcactcctctcccaaggcccaagtcctctaactccccgtcgctgtttctctggctggggcttctctacttgcacatggttcagtgtggcctgcctggccctgcctgcacacagcttcccatccaagggctcattgccctctgatgcagtctttcaggctcctccgaccctctttgtacatttttgtcttcatcatgccgaactcctcacctttcctctactcatctggccactctgctccattcccttgcttgtttctctggtttctctgattcctccaattgacagctccttggggcctgttctgagccctcttcttttctctatgttttctccctagatctgtggttttccaacatttctgtgcataggaattatctgcaaaacttgttaaggcagatttctgggtctcagtattccaattcagtagttctaggatgagacctagggacttgtatcttattcctgggtgatccagaggctatgacacactcaggacaagctggtttcattctatgactttaagtgttgttaataaactactaattccctggtgtggatatctagctctcttgagagctccaggtttagatatttaacattgaatttgactgtggcttcttgggtttgtcacagacatttcatattaacttgcccaatacttgatcctctccccagttttgtaagggcctaacacttacatagtttggggtcctctgtaagaaaaggaacatagaattgagaatacaaagcgagatgtgggaacgtggtggtgcactgtgcagattagggcttggaaacttggcttctgtagccttgggtcactcctcctcggcttgcctactcaccccagcaccgtctcctccagccttccccatctgaatgaaggcctatgccttccatttgtttgtttagaccagaaacctaggagccgtttctcatcttcagcccacttctgagctctctgaaggtcttgcttgattctccaattcagtacccccttgccccgaatctcaggttgccattgttactttcctattagcttctgatcgagtctctctggttccactttgttcccctccgatccaatttccagaagcagacagagcagtcttttaaagtacatcagaacgtgtcactccagtcctgccatgtgtccatagaaatggctgagtctggtggcagggccaggggtgtgggcagatgggagagggtcaggggggattacaccgcacaagcttgactgtcctggaaccttgaaagaagtgggggtgtgtctggggaggtatgcaagaattatcaactgcagttgtttgtttcagtcccactttaccacatttcattggaagaacttgagctgtataaggcctgtgaacacaaatggggatgggtactccctaattctttgcttttcagtgcattcctgtggcatttgatgctaaatagtgcaatcaaactgtttaattacttttggggaagaatcacacattcttttttaaccccggtgtcatcttttaactccgggttccttaatctccttagagagctgattaagcttggtgagaacccacaggtccatggcccaggtaaatccaaagcccggcccagggaaatccaaagccctgcccaggttttctgcgaattccctggaggagggggtggatgggggaggcctcatgtgctttcttttttaccttggtgtcagccccgacacaaactcagccccttccctcatggatggagaaatccaccaccactactaccatgtgttttgttagttgagtggacttcactggagtcccctgtggggctcctgatcttgcatagtctcctgggtccctctttcctcctctcatccctacccctcactccatccccctcacttgtccgtgagctccagtcttcttcctctgtaactatggatactccccagttcctctcttcaacttacaaacccaagtcaaagtacagggcagaacaacgggctttatatgtagggaaccaacactccttagaagttataaatacaaacacacacaaaagagttttctatcacactgtaattatcttcccctttctcactgatgtagcagctcttattgtagagtggcgtttggaagagctggggagaagatgtgctcttcctgctgcccccgaaggtcactgtctggattagggggcaggcagtgttactgtagctctgggctctggaatctcacagcaaacaacttggggtctcttcatcagcttgtctgcagatgatcagaccctgagaaactgagctctttctgtctaaacacacaggaaacttcctatgttgggaaatcagcttaaagatttacaaccagacgcagaccggatgctgcgatttgctagtcaccttgcttcactagtggttgggaaaccttgaaaaacggtggcgtctattttgaggactttgccaaactgagtctgtagacagacacatgtcaaatgcccttggattacagtcattattgccagcaagtaagagtttaagaataataactttggcatttcacccacttctgttattttaaaaattatttatttattttagacagaatctctctctctgtcgcccaagctggagtgcagtggcgcaatcgtgggtcactgcaacctctgcctcccagggttaaacgattctcgtgcctcagcctctggagtagttgggactacaggcatgagccaccacacctggctaaattttttgtatttttttttttttgtagagacgggttttcgccaggttggccaggctggtctcgaactcctgagctgaagcgatccacccgcattggcctcccaaagtgctgggattgcagacgtgacccactgcacctggccacatttcacccactttttaaaaggactttcttgtgttacttatcttaggcttcttagatcaaggccaggcattggacatccgtgagtaaatgatccaactcttgcagggagtggccacagtgtggctgagtttcagagcatttagatttaaaatattctgctccctaaacattattatcctatctgacaaaaaagatgcttgaagagaatttttttttttttttttgagacagggtcttgttttgtcactcaggctggagtgtagtgatatgatcatggctcactgcagcttcctgagctcaggtgatctcttacctcagcctcctgagtggctgagactacaggcacgcaccaccatgcctggctaatgtttttgtatttttgtagagatgggtttcgtcatgttgcccaggtctcgaactcctgggctcaagtgatccacccgcctcagcctcccaaagcactgggattacaggcatgagccaccgtgcccagacagaaaatttttgtaaaggaacaaatgctctgtgatcatgaggaaggcacctcagcatttttcatattgggggtcctgggaaagtctgagaatgaacagtgactgcagctggcacagtcggagccaggcacaggcctccatgcttgctcatttgatctttacagtagatcatgaagcaggcagttatctcctcttacagatgagaacactgaagcacagagatgaagtaatttgggaaagggcagaatgtgaattcacaaccaggtggtctggagtcaaatgcctcacactacttttaccactcactgtgctcatcctgctcactttaggggggcattcccctctaaactgctcctcagcagtggatcttcatgacagaggcaccgtgaaggaaagagggttatttccagtgagttgcgatgcttttcctttagaaaagagaatttctctctctgtttaaaagcagaacattaaatgttgaatttttttctctcatctgcatccctgtatcctttccttatctcagccccaagctgctctccagacgcctaaagactgtctctcccgtctggatgtccccaacaccctaacatgttccagtttctttcttacctctcaaaacagccccccttttccaacttccccattctgggaacaccagtcttcttccagtcacccggcctgtgagtcatccttgactcccttttctcaatcatgccctgtgtccaagtttttcttgttgtttattcatttatttgtattctttgagacaggatctcactctgtcacccagactggagtgtagtggcacgatctcagctcgctgcaacctctgcctcccaggctcaagccatcctccaacctcagcctcctgagtagctgggactatgggtgcgtgccatgaaacccagctaatttttgcatttttttttgtttttgttccagagatggggttttgccatgttgcccaggctagcattctttttttttttttaatagtctttattttttagagcagttttagattcacagcaaaaatgaaagtacagagcttccctgctccccataacccacctctcccattatcaacatcagcaccgtgggggtacattggtaacagttgatgaacctgcactgatacattatcatcacccaaagtggacagtctgtagtttaccttcatcagtcttttgatgaagctcatggcttgtaatttctctccctggcaatccttccaacacccatcccagatgaatcactgccatcatgtcaagcttccacttactccatccctgccttccaacaggatagaagtccaaattcctccttttgttcttcagggacttcccaatcctaaaatgcttaccacagcctgtgatattatgatatatatgttggttttgtccacagttcctggcccataaatcccatagcccttgttacagtgtttgggtgttttaggcctcagaagcaggcctcagaaaacagtacctcttgctgactttctcctgttctcccttcaacctgctcctttttctccccaaggctaatcttcccctgtgtttccataaagaaattctcagacttaccttgtctgattgtagatcataagaccctcatttcaggaggggttctgccctttaccctgggggaagcaatgttgcaccaagcggcccagaagaatctgaacagacaggcctttctgggttccccactcagtctgttagtattgggtcatgtcctttttgtccaatcatatttctgcatggttgcccctgcttcagtcatccctgttcaatgaagtctgtgtaaaaggcccaagaggacagggtttggagggcttctggaaggctgaacacgtggaggttcctggggggtggtgcacctggggaggtatgggagctccatacccataccttgtcctgtgcgtctccatctgtgtcctttgtactatcctttataataaaccagtaataagttttgtgagccgctctagcaaattaatcaaacccaaggaggaggtcatgggatccccagtttatagccagtgagtcagaagcacaggcgaaacagcctggggcttgagatgggcactttaagtgggggcagtcatttgggtctgagcctcaacctctgggatctgataatgtccccaggtaggtagggtcagaattgaactgggttggaggacacccagctggtatctactgcagaattgattgcttgcttgttggtgggaagaagtccccacacacttggtcacagcaatcttctatgttgatcgattgtctttgagtaagagaattaaaaaaaatgctttgagtttgagtttctcagacagctcttcagacaaacccccttgtgatattctgccagcacagccctccattcatgggggactgggcccctcacttctcccaaactcattactgcctcttaatcaccacaggctggtcctgttttctctgcctgtcctaatgcgagcatcaagacctagtcaagccttgccttctccatgaagcctccccctccattcttccggttagccctgctatcagtgcagttcttctggcacatcacagtgagcattgcgttagaagtggcctgtttcatatctgagtcttgacatctttaggtattagaactcaaggagtgttacttaatcatccaaaaaaaaaaaaaaaatccctcaccaggaccaaacctggaacgctcacccagtcggttctcagtgattatgtactggactgacttgccactgtcctctgcttagccttaggtggcccttcatagctagtgaccctaaccaggtctgccgagtgaatgcactgcacttttctcagtattacctcttttcggaagataagtattacgtcttttcaggtatccggctgttggcttctcccgggttcatgtatgtgggaagaactctacccccaaccttcatccctaaagcatttgagccgttagtaactcactttgggttggtatttttcactcactgctgtcttttaagcatttatttctaagggggatgcttgggtgccctgttggatgtaggggtaccttgtggtgagggtgagggctcctctgagtctggctgcctgggccgcgatcctggcttcttcacttgatcagctgcacagccttaggtgccttttccttatttgcaaaattgaagtaataatgatacctggcctctggggcccttaccaggattagatgagataatacatgttgcaagctttgcacggtgtctgggacatagtaaacaattttttttggccttattgctattttggatttttaatggcataattttaacattattccccagtctcatcctccacagtccagtggagttagtttaggaggaaagatagaaaacagaggccacttcactctgcgttgttgctggctaaatgctttctttcctcacaagacgaatgattaaccatgagtgggctcacaggtgggctggcccgagaggcgggcgactgtcaacccatcttcccttcccaggtggttgggcggcttagaaacttgatggagatgcagaaatggagaaaaccagctggaactcattcaatcaaatttaatatactgcatattttctgggcactgacaatatgccaggcactgtgctaagtgctaaagttgtaaagcataaataattgggcaaggtccctgccctcaagggacttttcagaggacatataatcctcaagaaaatagattaatagataaataataaattaatatagactgcgacaaagtccgaggagaaaatgaaaggatagagttcctaggggagtctgctttagtgggtggttagggaaccctctttggggaggtggcctttaaaccaagatctgaagctgggaaggagccaccttggtgagttgggggtggggaggtggaaaggggagaatgtcgagagtacagcagcacgaggggactgaggaaggatctggcgaggaacaattttttttttttttttgagacagagtctcgctctgtctcccaggctggagtgcagtggcgccatctcggctcactgcaagctccgcctcctggggttcacgccattctcctgtctcagcctcccgagtagctggaactacaggcgcctgccaccacggctggctaatttttttgtatttttagtagagatggcgtttcaccgtgttagccaggatggtctcaatctccggacctcgtgatccgcccacctcggcctcccaaagtgctgggattacaggcgtgagccaccgtgcctggccaagctgaggaactattaatagtctggtctctgtgaaaagacacctggagtgtacagaagagcttggctgagggggtggccagggaaccgaaggggcgaggcttatagggattgtgtaagtgcataccccgttatctgggacagtggtttaacatttttaaattaaattctttttctttttatttttgagacagggtctcgctctgtcgcccaggctggaatgcagtgtcaggatctcagctcagtacaacctccgcctctcgggttcaaggattctcatgccttagcctcccaagtagctgggactacaggcttgcgccactaggcctggctaatttttaatatttttagtagagagggggtttcactgtattgcccaggctggtctggagcccctgggctcaagcgattctcccgcctcggcctccaaaagtgccactgcacctggccagtggcttaaaatttttttctatcattgacatacttgagaaggcataagatactcttgtagtgtagggctgttgcactggggggagggaattgtcagggtgtgtggggttgaaaagagcccctggtgatttagacataccttgccttccatctcttcaaattgagaaacacagctcttcacagaatccatgggcatctgggaacatttacatctcttacttttcaattaaattttgaagggttatagaggcacactataggaacatggaattctgtcaattgatgagaacattggctcagccctctgaggctgagtcactgtttaattggattactgtgtggcccacttaaataaatactgttttggaatagaaaagttattttattttgaaattgtatgaacaagactttggagacatcctttaagattttcacgcacgtggatgttgcccttttgttgagagaggcagtgtcgaggagataagagaacagctggcattgcatttgtgtctgcaccaggctctgtggctttgggcagtgatttaacttctctggtaaagtaggacaaataagtcttgcactgcctgcctcgtcagctgtcatggaacagtgctttataaattacacaatatcagaaaacaaaagttacttcaaaaaaatttagtttctgtacattatggcccatagcacattatggcaaggatgtaattcatgaccatggaacagaacttttcactgttcacagatgactggtctctagaaaaatctaaaggagaatatttttataactttggagtaggagtggtctttgtaaggatggtgcaaagcctggaagccataaggaaaaccttcataaaattcattatctaataaaaagtattggcatagcaaccaccataagcaaaacaaacagattacaaaccagaaaaatatacttgaactttatgttatgtattaaggattaacttccctaatacaaaaagaactcctatgaaccaataaggaaaagaacaggaactctgtaagaaaatgattgaaagacataaacaatttgtataaaagaaaatagtggtgccgggcatggtggctcaagcctgtaatcccagcactttgggaggccgaggctgtcggatcacaaggtcaggcgttcgagaccagcctggccaatatggtgaaaccccgtctctactaaaaatacaaaaattagccaggcgtgttggcgcttgcctgtaatcccagctactcaagaggctgaggcaagagaatcgcttgaacccgggaggcggaggttgcagtgagccgagatcacgccactgcactccagcctgggtgacagagtgagactccgtctcaaaaaaaagaaaatagtggcacctaaacacatgaaaaatgcttgctcttatgcataattgaaaaaaaatactaattaaatcacattgaaataagccattttttgcctatctaggattgacaaagataaaacattttgcaaacggatcatgttagggaagatacaggaaaacaacccactcatttgtaaatacgttgctttgccaatatcttgatgattcagatgatatggcttgatccagcaattccacttacagaaatttactcatgcaggtatttactgcgtactgttcatagtagcacgagaatgtcttatcagtgggtgctggtgaaatgaagtgtgttgcattcacatcatggaatagtacacagccacaaaaagagaacgaggctaactaaaaaccatttagcagatacctgcccccactttttaaaaaaagaacattttattgtgattagaatactcaccaggagacctaccctcttaacaaactttccagtgtataatacagtattgttagccataggcgcaatgttgtacagcagatctttagagctgcttaattaatctagtggactcctgatcttgttagaacctgtaaactgatgtctttcttcccaatgctgttgcttcactacctgatgcaccttttttggctgagtttgcttaactgagctttttgtgattgttttgccagcatgggaggacctactatatctgggactctatgcaaagaatattcagaggaatgatatgcctttaaaggctgcctgttaacaaagggttaaataatttaggcattagacgaattgggggccctgccaaatgagtgtggctaaagtctgtccttttcctgaacattcatgtaagaaaaccccaccccctgtttgtccccacattctctctcctcctaaggatcattgttcccttgtggcataataattaaaaaaaaatgtgaaattgagccgtcatcagactggtaatgaaatcctgagtgctgaagaacctgaatttcttttttctttttcttttctttttctgagatggagactcactctatcgccaggctgaagtgcagtggaggcgcgatctcggctcactgcaacctccgcttcctgggttcaagtgattctcctgtctcagcctcccgagtagctggggaggctacaggcacatgccactaccccacctaatttttgtatttttagtagagacggggtttccccatgttggccaggctgatctcgaactcctgacctcaggtgatcctcccacctcagtctcctttcaaagtgctgggattacaggtgtgagccgccacgcctggcccaagaacctgaatttctgacaggtaacaaataccattttctttttaaaaaagttattcctttttaatcttgttagactgaaatggcttgtctgtcaatatattttcaaagggtagtccattcttgtaaaggacataatgtgcctactgttcaatttttttttttgagatggagtctcactctgttgcccaggctggagtgcagtggtggtatctcagctcactgcaacctctgcctccattcaaacgattctcctgcctcagcctcccgagtagctgggattacaggcgtgtgtcaccatgcctggctaattttttgaatttttagtagatggagttttaccatgttagccagactggcaatatttttatattatgactaagtataatatgggtcctgtgtggcttgtttaaaacacattgctctgaaacccttgggcttttagttgttatattgacttgtgaatttgctgagatttagcaactatttccgtagtatatgcagttccctttttttctagtggctttcagtttcatagttgagtatcaagaatatagcctgtgaactgcatgggattctgcataaagtattttaagaaaaaagaacaggccaggcgtggtggctcatgcctgtaatcccagcactttgggaggctgaggcgggcggatcacttgaggtcagagtttgagaccagcctggccaacaggtgaaaccctgtctttactgaaaatacaaagattagctgtgtgtagtggcacacacctgtagtcccagctactcgggaggctgaggcatgagaatcacttgaacccgaaaggcagaggttgcagtgaactgagattgtgccactgtactccagcctgggtgaccaagtgagactgtctcaaaacaaaacaaaaaaacaaccaaggaagggactagaaagcagattaaaatagcaggaaaaagaatcaaaatagaagccatatgtagtgaaaagagtccaccaaaatgaatcagaaaagcaatttaaacaaaatgtattaattggattggtcaggagtaaataatgaatttgtatgtttgggtgcacagaaaaccctatagatgtgatcatagaaatatttgtttacaagagttgaacctaggaagaaaggcatttttctagataactataatgccattatcatatcctggaaatttaactttatacagtacattatctaataaacagggtcacattaatctatccccattgtcccaaaagtgtcatagctttttaaaaatcacaaaatatggctgggtgtggtggctcatgcctgtaatcccagcactttggaaggctgaggtgggcggatcacaaggtcaggagatagagaccatcctggctaacatggtgaaaccccgtctctactaaaaatacaaaaaattagcagggcctggtggtgggagcctgtaatcccagctactcgggaggctgaggcaggagaatggcatgaacccaggaggcggaggttgcagtgagctgaggtttcgccactgcacttctagcctgggcgacagagtgagactccatctcaaaaaaaaaaaaattgcaaaatacttgatagggttttaaaactgcaagatagcgaatataatacaaaatgaagtgaatttatattttctattagaaaagcagttttaaagggggtgctttcttttatgtaaataaaattgaagctgacaaatttgagattttatatttttatcaaatttgtatttagaaggtatcttttgcaacttatttgcttaaaattatacctagagttggctgggcgcgatggctcactcctgtaatcccagcactttgggaggctgaggtgggtggatcacgaggtcaggagatcgagaccatcctggctaacatggtgaaaccccgtctctactaaacaaaatacaaaaactagccgggcgtggtggcaggcgcctgtagtcccagctacttgagaggccgaggcaggagaatggcgtgaaccccagaggcagagcttgcagtgagccgagatcgcaccactgcactccagcctgggagacagagcgagactgtctcaaaaaaaaaaaaaaaacaaaaaacctagagtaaaaaaaatgggatctcatttccttgcagcagatgacaactttggattcttggtctagcttaattagtaaattggcttagaatcacatgatttcagacctgacagcaacccaggattttccagaaacccaaggttatggatgggaacaatgaatcattggtgtgattacattatcctttaaccgtaatgggtttgccttgcattaagtaaccagagggaaagaaagcacctgttccttaactcttgtggcatttccacactcatcttcactgagcttgtgctagtggggaaaacaaatgacaaactgtagttctgttttttggttttaagcctaataataataattaatggcagcaattactatgtgcttgttatgagccaggctttaggccaggtgttttatacatattaacttctttgtactttgtaataattatatagaattaggttctgttgttgatcactgttttatagatgaggataccgaggcgcacagagggtaagcaggtggaccagggtcacttagcaggatttgagcccagggaggatgaacactgggcagcccatgcttcatcagtgcagtgccctaagctgctgagtatttttgggcgctttttttctccatttattcatgctgtctgtgcgaatgtgtatggaaaactccaagcaattggagtatgcccagaatatactagaattttaagatgcaaatgttagatcacatcgcctacatttctgatggtagtcaatcttgaatagccaggctaatgcatatttcctgtatgcgttacatacctgatactaccaagatcgaggccggagatgctaaataaacaagaatagtgaggagccatgccatttgtaatttacggtttggtggggcacagacattaattcagcatttacccaaataagggtaatgatatttttattctcagaataatcttttattcttatgataagagttacagaggaagatgatggtacaagggaagctacctagggagagctgaccttgttggagggagtgagagcaagcgccctgggtagtgagattgtaaccaagatttgaaaagtgagtagggttaactagtgacagatggatttgaattccagcattgcccttgagcacgttggtcactttgtggtgatgaccttgaacaagttactttacctctctaagccttagtatcttcatctgtaaaatgggtgattgtgagaattaacaacatacaacatactcagcacaaggccgatacatagtcatcagtagtggcagtttttattactgttggcattttctgttcattttactgggaacttagaagagacacttatttaagtctcttactctgtagcaagggccaccaaatacctgggaataattaacttggaaaaatggaagcctgaatgaatattgaatatttaatggtgatcttctttgatctttttttttttttttttttttgagacagagtctcactctgttgcccaggctggagtgcagtggcacgatctcggctcactggaacctctgcctcttgggttcaagcgattctcctgcctcagcctcctgcatagctgagattaaaggcacatactaccacgcccagctaatttttttatttttagtagagatggggtttcaccatattggccaggctggtcttgaactcctgacttcataatctgcctgcctcggcctctcaaagtgctgggattacagacgtgagccaccacgcccggctttcatggtgatcttctaataggccaaatgtcttcggcatctaggatatgggaaaggcctttatgggactgttggtttgaagacacattcagaatggagcttacttgaaagcaattggagtatgcccagaatatactagaattttaagacgcaaatgttagatcacatcgcctacatttctgatggtagtcaatcttgaatagccaggctaacgcatatttcctgtaccaatagccgtacactatttgcccagtgattttttttttccacagtgtttgcaggtatatgtggttatttcttatagctaagtgtgcagggatccttgtgcatcctttgagaaaggcgagtcttgcttttgtctctctggtctgtgaagatgtacatgtatatgcagatatccaatccagcttttttattggaataatatcgttttttacaccttccattgttcttatattttgaagaaaaaagtaccaataattcagccagtggtcatacttatttattattgttattattattatttgagacagggtttcactctgttgcccaggttggagtgcaatggcgagatcatggctcactgcaatctctgcctcctgggctcaaacagtcttcccatcttagcctcccgggtagctgggattataggtgcctgccgaaaaaaatgcttcgctaatttttgtgtttattgtacacatggggttttgccatgttgcccaggctgctttcgaacttgagactcaagtgatctgtttgccttggcctcccaaattgctgggattacaggcatgagccactacacccagcccatacttaatttttcttgtatacttaatttttcttgtatacttcctaagtgctttaagtacattatctgatttaatccttctagtagctgtatgaaagagtcactttttctccacatgagatccctttttctccaagagaatattgaggctttctcggagaggttaagtaacttgttcaaggtcacacagccatgagtggcatagttggggatttgaaccgagatatgaatgactccaaacctgaactctaaactttgatgctgcctttcaagctagttattggagatgatcaaacccctgtgtcagtggaggaagggaggtctgtgtcaagagatttattgtacttctgtggtcataagagtggcttgtgaacaatgtcatgtctgaaaagcattgggaagcttgttgaatttagatttattcactgaatcagtagacgtagatattgtagcagtatctttctaggctattatctcctccttgaggaactctggtatataacaactgaaaattaaatatacttatgaaatgttaggagtttatgtttaaaatagcatttttacttcttcctcattcttgccatttctgttcttcagtttctatgttaactgctttgccattttcaggtcaactactgtttgttgccttaaatctatctgggagctgcttcaaatccatttggaagcaaggggaggatacattataaataaatgatatgttcagagatgggcagagttggaaagacatttcagtgagacggaaggccagtaaagcttttgtctatcagcatctgatatcattacaaacatattggtctgggcttagcttgcttctagaccatctggatttatcttcagctgagctaaacccaggaaaaaagacaaaaaaaacccatttggatttgctctgcagttcttattttgtttttcttctaacgcaaaccctgcttcaaaaattaagtgttgattttgactgatgataacaaaacaaaaatacaacctgatgtgctagctaaggcgggggggaaatgacaaaagcctcagagagcaggagccaagtgttcacttctccaggacgtttccttccctagtactggtttttcctaattcagcaaaagaggaagaaagaagtgtggggctcttctttattttatatatctatatgtatatatatgttacttgtatttatatatttgtttatatttttaattaattaatttatttattttgagacagagtctcactctgttgcccaggccagagtgcagtggtgcaatctcggctcactgcaacctccacctcccgggttcaagcgattcttctgcctcagcctctcgagtagctgggattacaggtgcccaccagcacaaccggctagttttcatatttttagtagagacacggtttcaccttgttggccaggctggtccccaactcttgacctcaagtgatctgcctgcctcgccctcccaaagtattgagattacaggtgtgagcccctgctcccggcctatatttttaaatcacaaaaataatatataaaaaaaagttgttaatcctggaatgtacaaagtaaaaaaatgaaagccccctcacccatcccacttctgtttaccttggcatatattttctggaatcttcttctttttttaatttattttattttatttttattttttgagatggagtctcactctgttgcccgggctggagtgcagtggtgcgatctctgctcactgcaatctctgcttcccgggtccaagtgatttctcctgcctcagcctcccgagtagctgggactacaggcgcccgccaccacgccctgctaatttttgtatttttactagagacgggggtttcaccatattggccaggctggtcttgaactcctgaccttttgatccgcctgcctcggcctcccaaagtgctgggattacaggcatgagccaccgcacccagcctggaatcatcttctatgcatacaagcatgtatacacatatgtacacacttaatggaatcatgctgctattgttcagccatttgctgtttcctgtttgtgcagcatggacatctctctatcccaggatttacagattcacctctttcctttgaattacaaggtattccatgactacatcctgctttatttaatcgtttccttaccaaggggcatttgggttatcttaactcttccagttataaacatggctcagtgagcagctgacacatgtggctttacctctgggtgctgatctttctgaaggatacctgcctagaggtagggatgctgagccaaaggttatgtgaactctggacttgtcagtagccctgcgtttggatcagggtgaaagtgtgaacattggcctgtttcaaatggagccatttcttcttgtggccattttctgtttccataaggtaggccgagtagcatggagctcacagcccggtgtgtaggcagagttatttgatggggatgacaatttctgcctatttcatccttttgaaatttatgaaggtaaaagctttttcctcttgaatcttgcttcattccagatgtactcacagagaactctaatatgttaagtctgctcctggaataaagccagtcttggttttctttcccactccccaagtgcatttgttttccttctggatattttgttcatctttggactttgatttacttacaggatcacaagattagctttctttgaagaagactcctgttggctttctttaatttggtcagtgttgagcccttcccactgagctctttcctggcctgcctgccttggccacgtgttcctttccaggtcaggtgcactgcagactctggatgtaatggcttgagcactgacagcttcccaaggttttgttcaggcaggaaatgaatcacatgccaggagggagtgagtgaaccctgctgactgctggacaccctccttacttcattatcttctccatcaggggctgagcaaatcattaaattttttcactttaccagtttttttttttccttaagagatggggtcttgctgtgttgcccaggctggcctcaaactcctggcctcaagatatcctcttgagtctcagcatcctgagtagctggaactacaggcacatgccactgtgcctggctcccaaatcattttaatattgggctatgatacatattaggccacagcttacctttgtcagctgcattgctcatgccactctcccatgcctttattccccaagtccttactaccctccttcccatgatggcagacatcactaattgatcctgttcttttgaacatgatccagtgagccagacaagcccttgggatctttcttgataccccaggcagcccgtcctaccagactggagttggtacaactaagggcccaggaaaaccctttcaggattcatacttgagaagggttttggggaatgctgagtggtacccagatttgtggaattcttggattactaaaatgtaaaaaagaacattgggagtcttgcacaggattgctaactttttgctctttatatgaaaggcattaacacctccccaaacctatcagatctactctctgccattttataaaagaaagaatattttgtcaccctcccaaaataagaaagacataatctcagaataaaggggagtcctttaaattgagagattctagctacataaaaagtccagtgcattgtctttcttttccccaatttgttattaaaaacttggtcatagacctaagtactgtttaggaacccgtgtcgtaagtttcagactgccagagatttttttctttatatttttacaaagccaaaatttaattccttgaatccaggtgatactgcttattggcgttgatgttgtgtactcagatgaacattttattttattatttccacttaatagtataaaatggtcattttgcagaataaacaaaaaaggttttgtattcttggaggttggaataaagatctgttctcttagtggctctcttgtccagtgttggctcattcattctgcagttatttattgcccacctgcgattatgtgccgagcactggggcactgcagtgaaaagcaaatgtctctaccctcttggagctcacaatacaggaaaaataattaaaaacaaataaatagtatagattcaggttgtgttaagtgctgctaagaagataaaatagtggaccgggtacggtggctcatgactgtaatctcagcactttgggagttcgaggcagaaggatcacttgggcccaggagttcaagactagcctgggcaacatagtgagatattatctctataaaaaaataacaaaaattagccaagtgtggcggtgtgagcctgtagtgccagctacttgggaggctgaggtgggaggatcacttgagcctgggaggtggaggttgcagtgagccaggatcacgccactgcactccagcctgggtgacagagtgagatcctgtctcaaaaccaaacaaaacaaaacaaaaataaataaaatagtgtaaaacttaggggaaaaacttaggggaaaaacgagttatggtattgcagcaaagatgactttggaaacatgagctgaggacacagctaaaaaacagtctagggaaaaagcattccaagaagagggcatagtagatgcgaaggccctgggatgagatgcacttggtgcgtgggacagctttttgctctttatataaaaagggacagagagaagacgaggcagcggaacacagaggagaggaagagagtggaaggaggcacccaggaggcggcaggggtggttggggaagaggggccttgttagtcatggcaagggatttaccgtttatttcttttgcagtgggaagccattggagggctttacgtagaaaaggggtttgatctgaattttaccttgagaagatcactctgagcgcatggagaatggatcgtgtggggcaagactgcagagtcattaggagactatcttagcagtctggctgatgcatggtggtaaccaggagtagggtttcagcaataaagttggtgatgagatttaggatacatttggaagtagtgccaacaggacatgtatctccagatagcacctgccatggtgcctgaagcaaatcagtgctccgtaaataagggctgaatgagggaatccagttggtttagaatgcaacagaggactgccgtgttcatgaaaggaatttgtaaaatttcctcctaatagtaattgtatttttgtcacgccctcacttaggttgaaatttctcttgaagtttatatactggtcctataggtacctcacaaatacactttctttaaaatgatcctgaagcagcctgaatgctcaacaatacaggtaacatccactcagttgaataagataaccccttattcagaaacatagatatttttgttgtaatgagattgaagaagagaaaatgtaggcttgtgaaaacgcttatgattatatcaattaaaaaaatgtgtgtgagaaaaaaaccgtaaggaagtaaaattgtgataatgattgttcattgtggtggtttatggttaaggtgaccaggaataatttattatggaaataatgacactttgtttctgaggcagggtcttgcagtgtcacccaggctagaatgcagtggtgtgatcatggctcactgtagcctcaatcattctgtctcacgtgatcttcccacctcagcctcccaagtaactgggactacaggtgcacataccacacctggataatttttaaattgtttttgtagagatgaggcctcactatgttgcccaggctggtcttgaactcctggcctcaagtgatcctcctgtctcggcctcccaacatcctgggattacaggtgtgagccactgtgcctggcctcaatcatagcacttccaagcaccgttcaaatgactgagtggggaatgaaggtgctatgaataattatacatactgtgatgacaagagaaaaccaagactgtcctgaacaacccaggccatgtggtcaccctagttatgggcaatattttacttctctgtttttcaaatttcctgaattatattatttaaacattaatttaaatttaaaaatacgtaaaaagaatgatcttgctttagaatatttgctttcagaggtcacagaacatttctttggctctttcaccaagcacttaaatgtctcctgccttttaaagtgatagggataccgtggagacattggtctcagaggatgggtggtctcagaggttggggataatccagctgggaggctttgaagctgtgatcatccccctctgccctctaccattctcatgaaagaacgggctagcatagcacctacagactccaagatgacctttttctgtgactaataagattaggatcctagtacgttcaaaatgtcctaaggatttgcttagatcacttgacaggcctgttctcctttgcctttcccaaagcaatgttacagttaaaggttagtttgtgggatctggatttgaatttttttctactgaagtttgcaaaatatatatatatatatatatatttgagatggagtctcgctgtgttgcccaggccagaagtgcagtggcacgatcttggatcactgcaacctcagcctcccaggttcaagcaattctcctgcctcagcctactgagtagctgggactacaggtgcacaccaccacacccgctaattttttatatttttggttgtgacggggtttcaccatgttggccaggctggtctcgaactcctaactttcctaacttcaagtgatccgcctgcctcggcctcccaaagtgctgggattatatgtgtgagccactgcacccagccatcaaatataaatttgtttgacggatttgtgtgtagcttcatggtaatggggcatacaagtgacagttttattggctcacatttgaagtatacgaaacaaaattagagattttttttttttttgagatggagtctcactctgttgcccaggctggagtgcagtggtgtgatctcagctcactgcaacctctacctcctgggttccagcgattctcctgcctcagcctcccgagtagctgatactacaggtgttcaccaccacacctggctaatttttgtatttttagtagagacagggttttgccatgttggccaggctggtctcgaactcctgacctcaggtgatctaccagccctggtgccccaaagtgatgagattgcaggcatgagccaccgtgcctggccaaaattagagattttaaaaatacgttatgaatagtcttttacaactaaaactgtattaaaagtaaataccaaggggtcagggtgccgatatttatctccatggactgtgggggaggttatgccatttcgttaacgagaaaacgtcgaacaaattagttcttcccttgcttttttagtttttctacctacaaaaaggagagaactaaataccttggctaagaaaacagtgaacacttccttgtaactgttcactaccttgtgaaagataaaggcactttaaatctcaaataagacaatcatgtggtcctggactaggtgcacgaagcctcatgtctgagtctatcatttctctagagcctcattttcctctaccctccccatccgagtccagtgaatcacttcctgatcccacacatggcttgcatcttcttgcctccctacatggatcatactgtactctgcacctggaacccatgcctcccatattacctccttcattaatgcaatgaaaggttttagtgatggccaactgggacaccagagcaaggctgcctgggttcaagtcccaattctgtcgcttaaagctatatgacctttgacacattacctgttaacttttccatttctctgtttgcttcactgtgaaatgggaataatattagtacctatcatttttgtttttgttttttaaatataattttatttttccatattttttgaaagagatggggtcttgctatgttacccaggctggtcttgaactcttcagtttaagtgatcctcctgcctcagcctcccaaagttctgggattacaggtgtgagccactgcacccagatgaactgaccatttttgtgaggatatatgtaaagtgcttagaacagcgattatcctttagaagcactgtctctgtgttaattatctttttttttttttttttttgagacggagtctcgctctgtcacccaggctggagtgcaaaggtgtgatcgcagctcactgcaacctctgcctcctgggttcaagcggttcttgtgcctcagcctccagagtagctgggattacaggtgtgcgccaccatccctggctaatttttgtatttttagtagagatggggttttgccatgttggctaggcttgtctcaaactccttacctcagatcatccacctgccttagcttcccaaagtgctgggattacaggcgtgaaccactgcgcccgggtcttgttaattatcttttgaagtgcagcccttccagtaagcatatgtccactagccaccacacgatttgtggcctactgacctaggtttgagtctgaaccctgctactttgtgttggatgacaggggacagttattcaacttctttgaacgttagtgtcttcatctggagtgcaatatatcacctggttgctgggcatgtcatttgtgatactgtgtgaactgcactgtctatgaagtgcctggtttagcacttgacagctggtagatgctcagcaaatgttagtttctttggtttgcatttgcctccctttgtaacactgtgtttgttgcctgatgcttgtacctgcttggttgcatctcctccattaggctgaatatgttttaattttctttgtctctgcacataaaaatttttttggtttattcattgatttcatcactcatttgttcattgtattcattcatgcattcttttctttttttttttttttttttttgagatggtgtctcgctctatcccccaggctggtgtacagtggtatgatctcggctcactgcaagctccgcctcccgggttcacgccattctcctgcctcagcctcctgagtagctgggactacaggtgcctgccaccacacccagctattttttttttgtatttttagtagaggcagggtttcaccgtgttagccaggatggttcagatctcctgacttcatggtccacccacctcagcctcccaaagtgctgggattacaggcgtgaggtgcccggccacattctttttcttgtttattcaaaaatcatttactgaaccacttgctaagtatgttgggccctaccaatggaatgtacccttcttccagctagagtcaagagtagaactgatgagagctcgaactaggccagtgacactggaggctgagagacaggaatggacttaggaggtgtttagagagaggactgtaagggctggctgaccagttgggtttggaaaggaatcaatgacagtttccaggattcttgcttgagccaccgtgtggatgctgacatcattaattaaaatgggcaacatagaagatagtagaattgtctagggtgtggatgggcagggagaaggtatcatgtgtctaccagcctggtttggacacagtaagtttgaggtgtgtgcagaatgtccgcatgaagagaccgctaggaggtggccagttcaccctcaaaggcagttctgattctggacacctttgtacatgatatgggagtggaagtagccaaaccagagaatgagtgtagagtggaagggaagagggctgccagtggcccactggggaagtgccctgattaaagtggaaggcaacagggaatctgtggcttctgctaggaagccacatgtgatgcctcaccactgaaactgcccatgtgccccaccaagaatatgccactgtctgtgcacttcaaggccagcccttgggtaggcagtacagaagtggggagaatgccttctttcccatcatgggcctcgctgcaggccccaggctgcatggaatgtttgtctccttctcctgcaacatgtctcacagagaattcttcttgaatgcatgctatggttcctctctccttatagctgcccatcctcatttttctcccctccactggataagcataagtgaggaaacacgccaatacctccttccccttgtacacacctccactgctgcttctcagtctggaccaccatcacctctggcctgcaccattagtcatctccaaacaggtctccctgcttctgctttggccccctacagtctgttccacacccagcagccagagggatcctgttaaaacataagtcaggttaggtcatgcacctgctgaaagtgccccagtggcttccacattcctcactgtggtccacaggcccggtgtgacccggcccacatctctctttctgagatcctctccctcatcccccatactccagcacactggtttccttctgttctccagatataccaggctctttcggccttggctttggcacacactgcccactcttcccgcagtgttccttccccagactgttttgtccctggtttcctttcttctgtcgggtttcagctcaaatgtcacctcctctgagaagccttccctgaccacccacatatgaagtagtcctcaccgagtcctggtagtcactctcaaaaacatcacccagttttgtttttctcattaagcttgttcattatcttgttcatttatttgcttagatgtttactttgtgttctctcactattatgtaagtgatgagtctgctgggatcttctctcctgaaccctggattcccactcaacaagcgttagtttgcttagtttgcatcctcctccctttgtaacgtggtgtttgttgctgataccgtgtacctgcttgaggaacctgcttgaggaacaaggcatcaggcaatgatcacagcgttacaaagggaggaggatgcaaactagtaacctggtcatggagccagtcacagacgtggcgggatttttcttcagtggtgggcggcacaggagagaaaataggggagacaaatgttaggttgatccaggttcagggccctgagatacaagtggctcgtgtggcagtgggacagggagctgagggtgcagagggagggcatgtgacacagtggaaggacgggaggtccacagggagatgggaagggtgggtcagggctctagtggtttcattcaagtggaacagccgattgggtgagaatgaggaagtgcgatcaggaagggcaggccctggtggtcagagggaacttctagccttacatttcatggccagggctgtggccacatgggggttggtaagcagagggttaggtaacaggaatgaaggaggtaggctaaggcaagagcccggaatgttagggctttactcatgatcaaggccctccttgtaggaggtcagaaaaagtggggaagtcagtgtggaggggtcggcaaagccacaggcatgaggagcaggaagctggagagaagcaggtcttgctaggaaatgagggggaggaggttggtcacattcctaggttctaggtacttcttggtaggttattgtctggagataacagtgaccaggacaatttgggttctgctggtcctgggatagaggggagcacatgaggattgagcagccggtacttgggagagttaccagggaggggcgggtggagaagccggggtgcagctaagatgaagctgctgagatgggtgtgaattggggcatttgcagccctggcatgagttcccgaggcatagtggaaggaagggttagaagaggagagggcagaggaaggacggagtcagatccaggtagagatgagagaaccccagaggatggatgttgcttggaggcccttcagcctgggcagacattgtggctcataggaggagggtgttttggacatgagggttgtgaatgaaatgggtgaggccaggcatagtggcatgcacctgtagtcgcagctactcgggaggctgaggcaggagaatcgctcgagccctggagtttgagaccaggccgggcaacatagcaagacctttctcaaaaaaacagaactaagctgagtgcggtggctcacgcctataatcccgatactttggtaggtcaagacaggaggatcacttgagccctggaattcaagaccagcctggacaacatggcaaaacctcatctctacaaaaaaacttaagaattatctggtcatggtggcatgcacttatagtcccagctatttggaaggctgaggtgggaggattgcttgagcctgggaggttgaggctgcagtgagctgtgatcacaccactgcactccagcctgggtggcagagtgagacctgtctctaataaaaaaagagaactaaaaaaaaaaaaaaagtagatgtattaacataaagaaatgggttaggcttcgggtttcaggtagcatgtttttaaaacagctttattgatacatgatccacatatagtacattcacccatttaaaatgtgcatacaggccgggcgtggtggctcactcctgtaatcccagctcttcgcaaggccaaggcagatacatcacttaagcccaggagttccagaccagtgtgggcaacatggtgaaaccctgtctctacaaaaaatataaaaattagctgggcatggtggcccatgcctgtagcccctgcaacttgaggggctgtggtaggtggatcacttgggcctgggaggtcgaggctgctgtgagctgtgctcgtgtcactgcactccagcctgggtgacaaagctagaccctgtctcaaaaaataaataaataaaataaaatataaataaaatgcatacagctcactggtgtttggtatattcacagatatgtgcacttatcaccaaagtcacttttagagtattttcatgacctcaaaaagcagcaactctgtaccttttggctgtctctcccctacccaccaagttcttctcccagtcccagtcccagtagctacaagcaaccagtagtctatgttccatctctgtagaagtttctattctggactttcatgtgaatggagtcatatgatatgtagactgttgtgaccggtttctttcacttattgtaatgttttcagggtttatccaagttgtaacatgtatcagaacttcattcctttatattgttgaataatactccattgagtagatataccgcattttgtttgcctgttgataggcaattggattgtttctacttttcactgttattaattatgctgctgtgaatagtcatatacaagtttttatttctcttggatatatataccccggagttgaattgccaagtcaaatggtgactgtatatttaattcttcaagaaactgccagacttttcgcaaggggctgcacaattttttatttccaccagtagtgtatgaaggttctgattgctttacctccttggcagcatttgttattatttgactttttaattctaaccagactagtaggagtagagtggtatcttaccatggtttagatttgcatttctctggtaactaatgatatcaagcatcttttcatttgcttattcaccatttgtatatcttccttggagaaattgctcaggatactttgcttgttattgagtggggtaatttgtgtttttcttattaagttgtaagagttcttgatatagtttagacacagtcccttagatatatgatatgcaaatattttctcattctgtgggttgtctctgatggtggcatttgaagcacaaaagttttacatttttatgaagcctaatttacctatttttttgttgttgttgctcatgcttttggtgccatatcaaagaatcctttgccaaatccaaggccatagagactaactgctgtgttttcgtctatgagttttatagttttttgctcttacaaaatggtatttgatccattttcagtcaatatttgtatgtggtataaggtaggagctcaacttcattcttttgcgtgtggctatctacttgtcccagcaccatttgttgaaaggatgattctttccccattgagtggtttcggtgcccttgttggggaaatcaattgactagacagaaataaacctatgggtttatttctcaattctgttcctttgatctgtttgtttgtacttgtgccaataccacaatgccttgagtgctgttgctttgtagtaagttgaaattgggaagtgggaatcctcctgctttattcttctttttcaggattgttttggctatttggagtctcttgcaattcctatgaattttaaaatcagcttgtcagtttgtacaaagaagacatctgggattctgatagtgatcgtgcttgaatccatagatcactttgggcagtgttgccattttaagatgttaaattgtcttccagttcatgaacatggtatgtttttctgtttattttgatctcttaattttttccaacaatgttttgtggttttcagagtatacattttgtacttcttttgttaaatgtaatcctaggtattttattcttttttttttttttttttttgagacagagtctggctctgtcgcccaggctggagtgcagtggcgtgatctccgctcactgcaagctccacctcccgggttcacaccattctcctgcctcagcctctgagtagctgggactacaggtgcccgccaccgcacccggctaatttttttgtatttttagtagagatggggtttcaccatgttagctaggatggtcttgatctcctgacctcatgatccgcccgtctcggcctcccaaagtgctgggattacaggcgtgagccaccgcacccgactattttattcttttgatgctatatttaggtagtactttgatgggaagttgtgatagtacttcttactcttaccaggtgaaggggtagagtgagtagaattgaaaaaatgttttgttggcaggagagagggcagggcattttctgctgttcttcaggaggttgtgttctcaggtttttcacaatccttgggtaaggcatcgaggaatacatcagccttcaaagaatttcatgcacccagctaccaatgatttcccccttttcccatcataatcaaaaccctgtgtggtggaaagggatgactgatgagtgagtagctgaagatagctcctggttaatacaaaggcaatccgattggactaattaacactaatatttaaatcactaataccactcccccagcttctgagatttatctgctgttccaaaagatgaaaattattagcacaaacaaatcactaattaaaagaaccttggtagcataagcaaagtgggaggtgggaaaaatgcttttggatttggcctgggatgtcaaggtagttttttgttttttgtctttttaaacttgctgtatcatagttatatgtatttttgaggtacatgtgacattttgatacatatgtacaatgtgtaatgatcagatcagggtaactgggatatccatcacctcaagcatttaaggacagtttttgaagagagagaatgtcacagtacgagttaggaagcacctgtgccagtggtcatttcctctctctcatatgtaatttttcacagcttctttccttttattctgtttagtaactgggttgcttcttagtgtgagtgagtacaaagggaggtggaggtcagggccaacatgcacatgcaggtatgttctcagtgtctgcatctcaggtagcactttttcaaaatgacattcaaataattgtgaggttaaaattctgtaattttttttgtttcttggattttaaaccctaaatttggcctactatcaagttcatgaccataaatggaacttgtatgtcatagagattagcaagttagtggtttctttgatttatgtcctatgaaccagtatttttttagattgctataaactttaaaaaaagatgtgctgtcatatcctctttttttcttttgtgatgaatggtggaaaaacttaaatgcaattttatttgtgtttctaactttaactgaatatcagagttctgctgtttttccatcttggtttgccttttctagttctaatctgggactgagggagacaatttgggcctggtttgcagatggttctgcttgctctgcaggccctccccaaaagcgtacggctgcctgccttcagcccagctttcatgttttggtgcagctctaatttctttttctttttgtttgagttcctttgattgcccaaactggggtcaccttcaagccaccttgagtaaagggatgcttatgttaaggacactgtgcacagggaacctcagagatgctggacacggaagccactgggaaagtggccccaggcaggcctgcacacttcagcaaccgaagctggctcctgtgattcagcttgtctggtggccaatttctgtggcctttagtgtcttttatctacatcatggctcatatatacttgtgttatacgggtataacacaagaacctctggtccctcagaaccccagctgtgatgtcattatctctccagtttctctttcatcactttccagcctccattcttaaagaaccaccaaatgtagtaatatttcctaggttcaagtacgaggagggagccattgcccagccctttcttctttttgtgccaggctgtgccctaggtaccctctagcctgtggactgacttctttcgagtcagacatccatccctgatcctccctactgtgtctggggagggtcatgacagccagccgcctgtagatctgccctaggagcaggaccttggtaggctcttccccagcagatctgggagggccctggcaccaccacagatgtgtccagtgcagagccaagggcataggtagtattgagagcagatacgggaaaacttggcacagaactaaacattgaatttaaaataacctcgcagatggaatattcttttttttttttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgcccggcctggaatattcttaagagatgaaagtaaggagtcagtgattttttttatttaaatagaaaaatagctgaacattgtgggaggaagtgaaacacagagtgaaattaacttgactgctgtttgttttttgtggggagggaataataaaagtaactgagcacattaggttttactttcttttaaaaaacatgttttgttcttaaactttaacaaatgcactgtaatcttttggcgaaatacagaaaaaaaggaagtaaaaatcagtcataatcctaccacttagaaatgactactgttaattcttaattttattgtgcataagctccagttcttaagtaaatatgtaaaaaaaaaaaaaagtgcttttaaaaaatcacttaataatactgtttgaggccgggcatagtggctcacgcctgtaatccctacactttgagaggctgaagtgagtggatgacttgaggtcaggagttcaagaccagcctggccaacatggtgaaaccccgtctctactaaaaatacaaaaaaattagccgggcttggtgtgcacacctgtagtcccacctaccggggaggctgaggcacgaaaatcccttgaacccaggaggcggaggttgcagtgagctgagattgtgccaccgcactccagcctgggtgacagagcgagactgtctcaaaaaataacaacaaaaaatcaacaatactgtttgaacagccccgatcatttaatattcttttataacaatttataatggctatgaggtagtctgtcatgcagatggaacataattcattttttttctactccgcttatggacgtttaggtttccattttctttgattgtttcttaaaaacactgcattttgaacattctttcctgtacaaatattttgcacatgtagcactgatatttttttagattgagttcccagaggtcaaattatcgagttaaagaatataaacaatttatattgttgcttttgaaatatatggccaaattatctttcagaaatattgaaatagctcacattcctaccaacagtatttagttcccatttctcatgatccttgccagcagtggatattattacagaaatttctaattttaaagaaaaaaatatggtacttgtttttatttgcacttctgttaatagcaagatgaaacatttaagtagattattgaccttctttcaaaaactttatttttaattgtggtaagaaacacatgaaatttgcaatcttacccatttttattatttttttcacatggtctacaccatactagtgtatagaccttaccactttttaaatgtacacttcagtagcgttaagtgtattcacattgttgtacaatagatctctagatctttttcattcacagaagtgaaactctgtatcagtaaacaagaatgttccatttcccccttaaatgctcctttcaccctttcctctagcccttggcaaccaccattctactttgtctttatcaatttaatttccttgaaaacctcatgtaagtggaataataaaggatttgtctttttatgattggattatttcatttagcataatgtccttaaggttcgtcctcttttgtagcatgtggcagaatttccttcccttttaaggttgaatggtacccattgtatggagagaccacattttgctcatccattacatttcattgatggacacttaggttacttccacctcttggctattgtgaataatactgctgtggatgtggacccacaaatagctctttgagagcctgctttcagctcttttggatggatatctggaagtggaattcctggatcatgtggtagttttctgtaattttttgaggaactgctatactgttttctatagcagctgcaccattttacattgctgccaacagaagggttccgatttctccatatcctcctcaatgcttttttggttttttgtttcttggatctatcctaacgggtgtgagttaatttctcattgtggattagtgatgttgagcatgttttcatatgtttattggccctttgcacgtcatctttggagaaacgtctatcaattcctttgtccttttttttttttttttttttctgtgagacagagtcttactctgtcacccaggctggagtgcagtggcatggtcttggctcactgcagcctctgcctccctggctcaagcagccctacaacaccagcctcccgagtggcctggatttcaggcacatgccaccatgtctggctaatttttgtgtattttgtagaggtgggatagtaacttcccaatgagttcaccttgcccactgcctagacagagccaatttataaagacgggaattgaaacggcgagagagtaatttacgcagaccccgctgtgtgggagaccagcgttgttgctgttgttttgagactgcatctcgctctgttgcccaggcctggagtgcagtggcgtgatcttggttcacgccattctcctacgtcagcctcccgagtagctgggactacaggcgcccgccaccacacctggctaattttttgtatttttagtagagacggggtttcaccgtgttgttagccaggatggtctcgatctcctgacctcgtgatccgcccacctcggcctcccaaagtgctgggattacaggtgtgagccactgggcccggccggattagagtttttaaagacaatttggcgggtaggagcttaggaagtagggagtgctgattggtcaggttggagatggaatcgtaggggggtcaaaatgaggttttcttcctgtcttctgtgcctgggtgggatggcagaactgcttgagccagattaccactctgggtgatatcagctgatccttccagtgcagttgcagggtctgcaaagtatctaaagcatggatcttaggttttgcaataacgatgttatccccaggagcaatttaggaaggttcagacccttggagccagagactacatggcccctaaattgtaatttctaatcttgtagctaatttgttagttctgcaaaggcagactggaccccaggcaagaaaggggtcttttcgggaaagggctgttaccagttttgtttcagagtcaaaccatgaactgaattccttcccgaagttagttcagcttatgcccaggaatgaataaggacatcttaagcgttagaagcaagatggagtcggttaggtctgatttctttcactgccataatttcctcagttataattttgcaaaggcggtttcaggatttcgccatgccgcccagactggtctcaaactttgaggtcaagtgatcctcccacctcagcatcccaaagtgctgggattacaggcatgtgcccggtcttgcatattttttaaatcggattttttatttgtataaatttatggggttcaagtgcaattttcttacatgccaggttgcacagtggtgaagtcaggcatttagggtttttttctttgtttttgtttgttgttgttgagcttgatcttttttttttttcttttttttttgacagagtctcactcacccaggttggagtgcagtggcatgatctcggctcactgtaacctctgcctcccaagtttaagcgattctcctgcctcagcctcccgagtagctggaattacagggtagctgggattacaggcgcctgccaccatgcctggctaatttttctatttttagtagagacggggtttcaccatattggccagggtggagtctcgaactcctgaccttgtgatccacctgccttggcctcccaaagtactgggattacaggcgtgagtcaccccacctggccgatcttttttttttttttttaaatagttggttctgagactttgatcttgccaaaagaaaaagttacaaaaaattttgtttaaaaattaaattggcttttattagtgattcatgaatcagggagcacctgatctaaagatttagaaaaagtctttgccgttttttttttaaataatgatataaaccatacttgttattccttatttcatcatttgaaaaaatatgtgatcctttctcactccttacatgtatagtccacaaacttttggtcagtagtttacttgtcagtgagatctcccataggcatatagaccaagcctagcattgcaaatgttttggcctgttgacctcagaaaggtattattaaggtatagtatatataagtactgaaggcacagtaatggcttgctctgtagtaggggtctgcaaactactgccaccagtttttgtagataaagtttaactggaacccagccatgttcattcagttaggcatctgtgagtgccttttcactatgcactgcagacttgagtaggagatgcagagaccctgtggcctacaaaacctcaaatatttactatctgaccctctacagaaaaagattgccaagtggtactttatagaattttatctttgcttcatagatattttgcattttatagaaaaagtattccaaggtagaaaatagaggaagctttctcctcgagttttcggtttgggcagatctgtgtaccatgctctcagggcagtggggttgtgaagagatacacgagtctctcagatgagtcttcaggactgccatgtttcccaggaaggggataacccatgtgtctgctgcctgtgtgtatccagctgtaatgtcaccagcaggtttgagaaatcattcctgttgtttgatgtggttgtgcgattttatcttttttcatttgtttattttagagacagagtctcgctctgttgtctaggctggagtgtagtggtgcaaatagctcactgcagcctaacctcctgggctgaagggatcctcccacctcagcctcctgagtagttaggaatacaggtgtgcaccaccatccctggctgattttttgttttaaaatgaaaaattcaaacaatgtggaaaccaagccacgcccagcttgattgtgagatttaatgattcttggaatgggctgggtgcgatgactcacacctgttattgagcactttgggaggctgaggcaggaggatggcttgaggccaggagttcgagaccagcctgggcaacatagggatataccatctctacaaaaatttaaaaaaattagtcaggcatggtggcttgttcctgtagtctcggctgctagggaggctgaggtgggaggatcacttgagcctaggaatctgaggcaacagtgagctataattgtgccactgcattctagcctgggtgacagtgagaccctgtctctaaaatgaaataaaataaaaataataattcttacaatgaaggtaagagagaaggagaatgggtggccatccaggtgtgatgggggttcttcattggtggaagagagagaatactctagagacagcctagcagaggacactgggaggcagatatccatacttggcataacagtctttcagtgagacaagaattctctatgtgcatttttttttttttgagatggagtctcgctctgttgtccaggctggagtgcagtggtgtgatcttgactcactgcaaccttggcttcctgggttcaagcagttctcctgtctcagcctcccaagtagctgtttatgccagcatgcccggctaatttttgtattttcagtagagacagggtttcaccatattggtcaggctggtcttgaactcctgacctcaaattatctatctgcttcagcctcccaaagtgctgggattacaggcatgagccaccacacccagccctctatgtgcattattatgacagacacataaggtagcctggggagtttggaaatctatacaaacctaaaattttccaactcacctaaagggcttagttttgtcagggagcaatttctttttctctctctttctctttctgtccttctcccttcccttcccttccctcccctcccctctttctctgtttctcttctttctctctctctctctctttctttctttccttctttcctttcttctttcttttttttttttttttagatgcagtcttgctcttgttgcccaggctggagtgcagtggcacgatcttggctcactgcaacctgcacctcccaagttcaagtgattctcctgcctcagcctcccaagtagctgggattataggcatgtgccaccatacccggctgatttttgtatttttagtagagacggggtttcaccatgtttgccaggctggtctcaaactcctgacctcaggtgatatggctgcctaggcctcccaaagtgttgggattacaggcgtgagccactgcgcctggcctcagggagcaatttctgattggcagctttggtttgctaaattatagacagttgaccttttatctcaaaccatacaattgcgctgtcattgaatttccttctccccaccagtaaatgccatggcaagttctagtaccaaatgatactttctcttgtgtcataaaggtagcatctcttaatacatttgaatttgctatttattttacatgaaataaaaataatttatgttaaaattactattctgagagcattatgctatttactgtatttaaaataattattactttaaaaagtttaaaattaatgttactaggaaaattcagacaatatggaagtgtatagagcttagaaaatgacatgatcaccattttcactgtacagatttacagtattagaggttgaccatgatagttcactgtgatgttttggaacaactggttgaaactgctttcaactttcccaagtttcctattttcttttttattttcttttttatattttgagacagggtctcactgtaacccaggctggagtgcagtggcatgatcatggctcaccgcagcgttgacctcccaggctcaagcagtcctcccacctcagcctcccaagtagtagctgggaccacaggcgcatgctatcatgcccagctaatttttgtattttttgtagagatggggtttcgccatgttatccaggctggtcttgaactcctaagtgatctgcccgcctcaacctcccaaagtgctgagattacaggtgtgagcccccggggccagtttcctacttcatagttggacttggtctgtagcatcttaaggtggccaattatcagactcctattagatagaactgcagagttctgcctggctgggaaaagctcaagccctttggggaaatttaagaccccaactttgaaccatttgttcacattacagagtcatggaggcagcctgtggcattggaaggccaccctagggaagcagactggctttggttgcagtggaacttgagcacttgcactctttcatagtgtgaccttgggcaacttaaccccttaacccctctgaccttccgctttcttgtgaagtggggatattcaaatcctcacaggacagttgtgaagtttaattacacaaggaaacacagctatgccctggtggagaaattcagtcaaatgggagagacagagggtatctaaacatcatgatgcaagcgaagttaatggcaccaggggactgcacagcacgcggttgtgtaatggggcagagagcccgggaagtgatttctgtgcagaatcctggcagagtttgctggtgcctggaaagggtgaaagtatgagggtagaggttcagccgtgtggagcacgtgatgtgtgtggggagcatgggcagatcctgagatggtggaacccaccggctaacttggctctggtgcaggaatcccatgataaccggacttgagccgctcctcctcctggcctcctccccttggcatgacccaggccttctgtgtagagggcctttttccttttgctttcctggctatctcacaccatcctttaggcctcagcggaagtgccattttctcagtaaaccctctccacccccacttagtccctccattctttaaagttttgttttaaatggtaaaaaacacacaacctaaaatgtaccatctgatccatttctaggtgtacagttcagtggtgtgaaggatgttcacattgttgtgccgttgatctcctgaactcttttcatcttgcacaactgaaactctgtacccactcagctgccccccaccccctctccctcccatacttggcagccaccattctactttctgtctctgaattttttttttttttttttttgagatgaggtctctcactcaagctggagtgcagtagcacagtctcagctcactgcaacttttgcttcccaggctcaagtgatcctcctacctcagcctcctgagtagctgagaccacgggcgtgccatgactcccggataagtttttgtttttggtagagttggggttttgccctgttggccaggctggtctctaactcctgacctcaggtaatctgcttgccttggcctcccaaagtgctaggattacaggtgtgagccaccacctggcctctgcctctgaatgtgactgctcttggtacttcatacaagtggaatcatacggtgtctgtctttttgtgactggcttatttcatttggcctgtgtcctccaggtttatccctgttgtgtgtttttccattcctatcacacggtgtcctttcctatcagttccacattataattaggaagtcgcctccaaagctctgagcctgctgtgtactccaccgtgtgtcctgcttgcacctcagcccatggcacatagcaggagctccacaaagagtgactgaacggaatctccagttccaaccccagtctgtctttccaacctaatctcgactggtcccctcttgactagcttcttatagctgcggcaataagttaccacaagcttgatatttagaacagcagaaatttattctgttacaatttgggatgctggaagtccaaaatccaggtggcagcagagccctgctcccctgcagaggccctagggcagaatccccgccttgcttcttccagccccaggggctccatggctgggggctgcatccctccccctcctccgtcttcgtcttcacatgttcttctctgtgttctcctctctttctcttatatgggcacttgccatcagatttagggttcactccagtcatccaggatgattttatcttgagattcttaattatgtctccaaagactcttttttcaaataaagtcacattcacaggttctgtggatcaggacatggacctatctttatggcagccacaattccaccccactacaccctctgagaaccctgtcccccagctgatctggcctggtcacgatctctggaccatagggcacgcttttcaccaggctctgtgggtgttgttgttgctcctccgctcccctggaggtcctgctttttttccttgaacactgcgatcccctgctctcccattccctctccatgggtcctctgactgctccaggggagagggactcccttcctcttggaaagcttcctgctgctgctcgggtgcagctcgcttgccccttccagaggccctgtggggtctctcgtctgcacctccacacggccctggaagcggagcctgtgttcctgcttccctgtgttccctatggtgccagtgacatgagtatagagactctgggaatacgtgtgggggataatagggacccggaaagtgggctcagacacatactgatattatcaaagtgaaggcaaatagtagacctgcagtcatagtcaccctcagttgtaagaatacatatgtgtggatataggcagggaatttaaatttgctttttgtttttggcagggagcaggtgttaaatctaatgagcttacataccaagtgggtttaaagaacaattgacaaccccagagacatgcagggcctggaatcaaacaacaggctggctgcactgctcagaaggtcagagtcaaggtcctggctttatcccgctgagggccacaccatctcttatgtgacctctggagtaatataagtgtcacaggaagggcctgatcccagaaggtttgagtttccggtaaaagcgtcagggctgcctctggtggtggatctctctgcgcgtcttttccagccagcatccccccgcacatggcttctgctccccggcatctccagcttcctcgccaattcactaaggctccagccccagcctgactggctggccttgcggtttgaaggtctgtcatcatccagctgccttggactctttggggtccagactcctaacccctggtgtggactgatgttcaccttggtcctgccagcaggagagggcagcgtgggaggagcagaggctcacatgtcagggactgtggggcggggggggctctgtcaggggatttgggtgggaggccatgagtggtgtatccactccagtttggaggttccaaatgacccagtgtggatatcttatttttcagattgatcgtgtcctgtgctgaagatgtttccggaacaacagaaagaggtatgtcatcacaaatccaaaaataaataacccacttattttgattcacacaggttagttcttcatttgcgaaccataaacccatgggttgcttgaggaggtttcatgaaagaccaaaggcccaccctcctgtacctgctcctctactcccaccattggtgcctgcatagccttcattttgggttccagtgactcagctgtggagcacattcccacccacagctcgtgactcagaattctcccaggctctgcctcccaccccttggcttggagcagtatccatccagtctgccttcctgcttttttactccattgactcatccctgaattctccttccttcaggtagcagcccaggggaatttctgccattagtttcaggtttgccccacttgttgcctgggcttggtttcatacaacactggcaaaactggcccttctgcctgcagcctggcttcccaggcctccatgcccgccccctgagcctctccctgactgggaggagcgtaggacagccctcatgccagccccggctgagtgtccctcctttggcagtacgcattgccctgcctgctgtggtgcagtgcacatcatcacttggtgaggctgatgaagtggagaagcagcacaggggcctgtctagggagtgtgcacacacacgtgcacacacatgcacacgagtcacacattcacacagtcacatggtcccagctcaccctgcacaagtggaaagcatgaaaccatttatttcagagaatctttccagaaagtcctttgctagctctcacatctttaatttcagccctatctttggcttcaggttcttctcagcagtccagccttgcttgcatcccttaactctaggctgggcttccccattttcaaaggcagtgttttggtttgttttttaacttttaaaaattgggctagacgggcatggtggcctgtgcctgtggtcctatgtactcaggaggctgaggtgggaggattgcttgagcctgggagccagaggttgcagtgagccaagattacgccaccacacttcagccccggcgacagagcaagaccctgtctcaaacgaaaaaccaaaaaccaaaataattggctgggcaccatgactcatgcctgtaatcccagcactttgggagaccgaggtggttggattacttgaggtcaggagttcgagaccagcctgtccaacatggggaaaccccatctctactaaaaataccaaaattagctgggcgtagtggcatgcgtctgtagttccagctacttgggaggctgaggcacaagaatctcttgaacctgggaggtggaggttgcagtgggctgagatcatgccactgcactccagcctgggtgacaaagcgagactctgtctcagaaaaaacccacaaaaaacaaaaaaattgggctataatatgtatagtaaaatgcataaagtgttccaatcttatgtatgtagctcaatggatttttgtctttttgttttagtagagacagggtctctctttgttgcctagattggtctcgaacttctggcttcaagcagtcctcctgcctcagcctcccaaagagctgggattgcagacatgagccactgatcatggcctaaatggatttttatatacctgtgtaactaccactcagatcaaagtatagatgtttctggctccccagaaggtaccgtgtgcccttttccagtcagtccccctcacttccacccctagaggtgaccttccacaatacctataccaggcatgcttttttccatctcattttaagtaatcctgagaccaagctgcttgttccgggaaatacccgcccatgaagttaatgaaactgcaaggttaagggcatagttcccacaggactgcccttgtcttcaacaccaattgcaagcttggggctttcctgaaccaccttcaagtttaataattcacaagaaaaactcacagaactcagagctattatcctcacagacgctgctttttatagagaaagaacacaaacgagaaccagccaaagcaagagctggacgcatgggcagtcaggtggggtccaaggacagagcttctggtcgtcctcccaaaggagccatgggcggagttatcctcccagcacccatgtgtggcagtgtgcagagtcacttggtgtagctggaatgatcgcctggcgtcaaatccattgcccttagaacaaagtcaaaacacctgcacgtggtctctagcactctgcaggatccaaacctccttctttctccagacttctttcctgtgccccacctaccactccagtgcacttcttgttccttatttcagagcttattttagagccttgaatgctccatgcactctgacccccatggacttttacagatgtttttttccactgcctggaataatctcttcccctagcctttgtactgtgttgactggctaacttctacttatccttcaggcattggcttagaagtcaagaagaagctttctaaacctttaactataaaagatatttttatctaatcagctcctcaacagcaccctgtagtcaatgccagttagaaatagagaaggtttaggtcaagcctttcatatcctagtgtctggttgtttagtggaaagtaattcaggttccacctaatcgaatatgtaaggaccaaatgcagtatgactgattgttttggaatctagaccaagggtacagtgagtatggaagcacttttctctcagtacccacagcaaacattactaattaatcatgaggttggcacgtgaattgagatttatttaccatcctcgtaacaagattcatacagcctgggagtgacatcttggttctgtctaaatggtagtactgaccttaaaatttagtaattttttttttttttttacattttgggggtgaggaatcaaatgtagtctctcttgttaaaacagctttatgactgtaataaatctagaaagaggagaaaagggagtgagaatctcccttgttagttaagcatgttccatttgcacattggtttgaattcccaggagagcagtatccgagctgatggatcttctccataaaaaggccttggcattgggccattgtgaaattaaaatgaattcagagtcattcatgcatgcaactttaatttacaattaaaatattatggttacatattttaataagaataattagatggacccaactgaatcaactcttctgtttaatgagacagaacccagactccaaatggaaaggcaggtggctgtgacaggaagcgcatttcagacagtgtcttttgtggagctaggcatttttattctttttatattcgaatgtccagagtgagctgtttgatttttctacactactcaggatgcttgcctcagccttgctgaactcatcttgtggggtgtatgagtgagcatttgctccagctgcacacagtccctttcatggagtcggacattcttgcccaagcgcctgctccctcctccataagggcactgggctctttccttggcacagggctcacttggtgtaactagactgttcctccctgtgtgatgtgacctgaagtgtgggctgaaaccccttttgaatgtatgtgtgcatgcgtgcatatctcccctgctctcctggatcatgatggctgcattctacttttagagattcatccctttaggataactgattttccccttcccaaatgcacatgcttcatactaggtataacagcagcttctaggcaactccagttattgacaccttagcgatgatatatccatcacttctttggcagggaatatcctgagtaggacaggccgaagtgggccccagagagttgcacaaaccatgaggaccccaccactgagggaggagatggggcactatggggagagccggcagggagggatgtgttgccattttggatgagcagcccctaaggttaatattaatatgtctaagatatgcttatgctgacccatggtaatattttggacttcctctaggaaagcatgcttttgatattcggaaactgactggaaactgactggtctggaactgatgaatacctttaacaaataaataatattagctaggatcctgtgatgctgggtactttgatgggaagcaacaagacagaacattttctcactccccaaaacctaaatttgttgttcctctctccctcctttcttcctccctttttcccctcccaccctccctccctccatttttctcagtctctgttatactcagttattaagtgttcctgtttgaaaaaatagttaagtttccataagaggcaatttacagtcttctgtaagcaaagaaaggcagctgggaatattgtcttcacacatacacaccaggtttcagagaaggctgttaccattctgagcgctacattagtgttacaggtactgtgaggactctgatatttttttctgagcttgtcccagagaaagatcttcattccttttttttttcttaactcttcttccagattttaaaataattgttcactgcagaacatttttggaaaagtatacaggaaaaaataaaactttgagctatttctttctagtctttttctatatatatgtatatgtcatttttagaaaattgagatcatacagaatttatagtttaatatctcactcttccagctcagtgttctaacacatttcaagaaatacttcaccagctctgattaaattagaagtggcttaggaaaagaaagaattagtaaacataaattcatctttgaattgttaagaaatgaacaaagaataactttacagtggagaaatctgacaaacacttcctcagccaggtgatcactgttaacacccacagtgatgttatgttgctagcatgtggaagtgatatcacctggaagtgataaaaatggcactttaccctctgaaataggtagccttccttccaaaaacctataacaccaatctaatcatgagacaaacatcagacaaatctgcagaatacctgcgagggctcctcaaattgtcaaggtcatgaaaaacaaggaatgcctgagaagctgtcatagccaagaggagcccaaggaaacacaatgaccaaatataatgtatctcgagtgggatcctggaacaacagattaatgacattaggtgaaaactaaagcaatcaagcagtctggttttttttttttgtttttttttttttttgagaccgagtctctctctgtcgcccaggctggagtgcagtggtgcgatctcgactcactgcaagctccacctcccgggttcacaccattctcctgcctcagcctcctgagtagctgggactacaggtgcctgccaccacgcccagccaattttttgtatttttagtagaggcggggtttcaccatgttagccaggatggtctagatctcctgacctcgtgatccgcccgcctcggcctcccaaagtgctgggattacaggtgtgagccactgtgcccgaccagcaatcttaatgaagtatggacttcagttaataataacatgtcaatattgattaatgaattgttacaaaggcagcatgctaatataaaatgttaataataggggaagctgggtgtgggatatgtaggaccactctgtactatcttcataatttctctatatctaaaactgtttaaaataaaaagtttattttaaaacaaatatcattgacatatatatgctcacataaaaagattctgaaagattgtatagtgaataaaccaataaacaaaatagtatttataaatgtaggttatgctcctgtttgtgttaaaaaattgcataaagctgggtgtgttggtgcatgcatgtaattccagctacttggccaaggcgagatcacttgagcccaggagttcaaggctgcattgagcgatcatcaatagccacaacattccaccctatgcaatggagtaagaccttgcctcttcaacccccaaaacaaaaaaatacgcaaggtagagatgataataaaatgaacccccatatgtgtacctaccaaccagcttcaacaatttactaactcattattaactcatagccgagctatatccccaccccacctatttcctcctgctaccacagtcaattatttggaaacaaattctagatattatataatttcatctgtaaatatttcagtatgcatttctaacaaatgacctttttaaaaaatgaaccacataatcacatgttaaataattaaacaattccttcatatcatcaaatattcaatgtgcaaattaccttgattattttgaaaaaaattatatacttggttgttctaattctctatttaattaggattcagataaggaccacacattgcatttggttgatacattgtttaaagtctttaattctctcttttcccccttttgcaatttatttgtggaagaaattgcatcttttgccttatggaggttttcacattctagattttgctgattgcatccttgtggatgccaattatttcttactgcagaagaggaggttttttttttctgcacttttcctgatgtgttacaagatatgaaaaggtaactcgctgatttgggatactacttgtgtaaagaaacttgcaacattgtgagctattataagtcatgtaaaaggcaggtctagctaaatctcattcacagttgtttatcctgaagtaataaaagcttctcaaaaaatcatcattcagtaccaccagaggatggtatttaaacatactccatgctgtagagtggcaagtaatatcccttgtcatatgtctcttaagttatttgttacagctgttattaggaaataaagaaaggttgcttgatatattccttttgcccttctattttgttatttgtaaagaatatagtatatgaaatgtgctagattttagttgtgaaattgttatatgggggtcctgaatagcactctggtgattaacacactggtaaatgctttttttttttttttttttttttggtggggagacagagtcttggtctgtcggccaggctggagtgcagtggcacgatctcagttgctcactgcaacctccgcctcccagactcacgcaattctcctgcctcagcctcccgagtagctgggattacaagtgtgtgccaccacacctggctaatttttgtatttttagcagagacggggtttcaccatgttggccaggctgttctcaaactcctcacctcaggtaatctgcctgccttggcctcccaaagtgctgggattataggcttgagccaccacgcccagcccacactggtaaattctataatcattagttgtatggaaaagtacctagcgcattgttgttgcacaatatattttaagtgaatgaatgagtctccagtgtaaatacatgaacatgtaaaacactactttgaaataggaaaaaaaatgtcccaagaaaaagaacaaactgagacaagtttacatttttatgttagaaaattctcatcaaagctatgaaaaattagtattcacttaacacctagacattctgctttattagctttcgtcttttgtgatctttctgtaatctaagtaaatatttttacagttaacacctactcatctttactgtgctacaaagattcaaactaagctatgatggaaaattttaaaaaacacacctatcacaatggctaaaataaaaaatagtgataatccccctggaaactgtaataggtatgtatgatatatcattgtagggttaattgtatttccctagtggttaacgatgtcgaacatctttctacgtgcttgtttgccatctgtatgccctatttgggtgaaatgtctcttcatatcttttgcttgttttctaattgaattctattttttaaataagagtaagtgaatgagtgttttgagacagggtctctcttgttgaggctggagtgcagtggtgtgatctcagctcactgcaacctcccacccacccaccaggctcaagcaatcctcccacctcagcttcctgagtagctgggactacaagtgtgagccagtacactcagctaatttttaattagtttttaaatgtttgtttaaatgtttgtttaattagtttttaaatgtttcaccatgtttcccaggctggtcttgaactcctgagctcaagtgatcctcccaccttggcctcccaaagtgctgggattacaggagagagccacctcacccgtctgatagttttgtttttttttaaaatatattctagatgcaagtcctttatgggatgtgtagtttgcaaatatttcttcaatctttaatttgcccttttaaccttattcacggcatcttttgcaaagcaaagatttttagtttggtgaagcctaattgatcactttttccttatgtggattgcccttttgagataagttgaagaactcttctcctagtcctaggccgaaagattttctttgattttttttttttctaaaagtttttctaaaagttttctctgatgttttgtgtttgacatttacatctgtggtttggttggtgttgatttttgtataaggtgcacgctttaggttgaggttcatctcttggcctgtggatgtccagttgttccataatcatttgttgagaggcttttccttctcctttgaattgtttttgcacctttgtcaaaaatcaggtgggcgtatttgtgtaggtctccctctgggttttctgttctctttcactgatcttctgtgtctatccctctctaggactccattgtcttgctgctgtagccttaacattgggaagaaggcttcctcccactttattctttttcaaaaattttttggctattctaagacatttccctttccatataaattttagaataagcccatctatgtcttcaaaaaaagtcttgctgagattttttataggaattgtgttaaacctacagatcaatttggggagaatttctctctttactatgttgcgtcttccaatttatgaacatagtgtgtctctgctttgattcctttcaatagcatcttagattttcagcatagaggacctctgctttttaaaaaatcttgtcaatcagttggttaattctgaaacatttaatatgcacttactatgtgctagtaccatgcttggtgctagaaatacaaaaatgaaatacaaagctttaagaagccagaaggacagagtttgagaagagcatgttgtctgaactggcattttagctaataaaagcagaaaaaacttccccctccaaaacaatacaattacagtgaaattggaaattgcctaatatttattattagtaaaagaatcacgagatagaacatgtttgagagtacagtctttggaacaaggcagatctgagtttgaaacttagctcaggctggtcatttgactttgggccagttgcttaagctttagaagcctcatttaaaaaatctgtaaagtaggatgagaatatactgagctctgagggttgttgtaaagattgaagaaaacatttgtgaaacggtataatgcctgccacatgtcaagtgccctggtataatacaatacagttatttttattattagtttcatctcacttaagggctaaggaaaaaaatgatagggtagaagtggataatggtcaaacctggggtgtggggatgggggaaaaacagggaacattgaaatcaaaggctgattattataggataacacaggaattagatcttcaaagagtctaggagtctttctttagaagtctgttttcacatggagaacagcagggacagttagtctaaatttttaattccactctgcctggctttctcatactacatatagtcattaggcccaagaagtcattaaagtgtttaataaggttattaaattgactaactgcagctgctgaagcaattttcctaggaaatccatatgattctaggtaaggggctgtggaactgtcctctgtggctgacagcctgtcaacattcctttgaaggatggcgggcagtgtcgtgagggatgcgtctaattaagagattagaggtgaaccttggcttcctgggtgtgctatttgtagctgagagtatggggaaacttcactaattcctactaattgcagagtgggggaggaggagacccatgtgaattatagaatattttaaaataaatgtacttttattactttcaagtacatattttaactcccactaggccaacaaattgttgcctggtacaagtcttaggggactaagttactgaagctatcagaaggattttcaattatttctatgtaaataggtgcttctggagttctttagggtgctagaaaacagtttgttctcccagatcttaaacattgctcttggatccttatgctgttaattggcacatccttagaggaaggggtttgttaaattaagataaacttagaccagctgctaaataacttatcattaattcatggagcccaagaacccaagtagatgaggttttaatttcaagtgaagtttgattttcctttcctgaaggcagtttgtttattcctacaggcatttatttattcattaaatgatactaatggaaggcattggatgtatgaggcattcaagtcttacaagacagcctaagctgccctacaggagcttagcgtctgctagaggaggcctacaggtaattacaatacagcacagtaggatgtggtgagtagggactatgcccaaggcaatcccagagacattaggggcccagaggagggtcaaataagtcatactgggtgaatctgagaagggttcccagaaaaagtggtgaccgagttgcatttgaaaaatgaattggagttggcaaaaaatagtagaagaaaagagaagattaaaaaaaaaaaaaaaaaaaggcagtagggtggcctagcaatccaggcagagaacagcttagttaaaggcatggaagtgtgaagtggcatgttgcttatggggacctatgcttagcctttgaagataagcagagtgaaaatcatgaaaggctgtattgtgctagctgaggagtttgaacttgaaggttatggggcaacctttgaaggattttcagaaggaaagcaacatcatcagatacgtgttttggagccattcttgtcttcatgtggggaatgcactggatatgggccccgaaataaattagcagttcttgcattaatgttgggcaagaggtccttgaaccaaggcagtagcagagggaatagttgtcagtggttccaaggagaatgactatgaaggacttggtctgtgtggatttggggaatgagtcaaacagaggggtctaggagaactgggtttctagctggggttggtgggagatgctcttcactgagaaggggagcaggatgctgtgggaagggtatggacatggcgtgctcaagggacttctaggtggatcaggctagaggctggatccatgggagaggtgcctgcactgggatggagctttgggtggggtccatcagctcatgggagggggttgaatgtgtttggatgaggtcaccctagaattgcaatagtgtgcaaagaacaacagcctgggttggctctcaggcacagaaacgtttcaggatgcagagagggaagaagtttgccatccacaagagaatagtgatatttagcactccaaccaaattaaagattttcaggattgaaacaatatgtggagtcttagtgctgcaatgaattttgagtgtgcatttaaaagtttaagagacacacacacatacacggtgacaagagatggaggtgaaaagcataggccaagagcagagtacctggatttttgcttctgtttccatccctgggcagaatctgctttatcacactgtgattaggggatattatggatatttggtttaaaaatggtttttaaatccctcttataatttagaatgtgcttttaagaaatgatggttgtctcttaatgcgcatgaaaaaaataaagaaatagagaagaagaaatactggctggggcacagtggctcatgcctataatcccagcactttgggaggctgaggcaggggtgttgcttgagcctaggagttcagaatcagcctgggcaacatagcaagaccccatctctaaaaaaattaaaaaattagctgggcatggtggcacccgcctgtagtccagctactgggggcggggttggctaaggtaggaggatcattttagccctggagtttgaggctgcagtgagctgagatcgtaccactgcactccagtctgggtgacagagtgagaccctatctcaaaaaacagaaaaaagaaaagaaataatggccaaagagcatcactatagtgttatcttgtgtttttttttttttttttttgaccaagtcttgctgttgttggcccgggctggagtgcatttagtggcgtgatcttgctgcaacctccgcctcctgggttccagcaattttcctgcctcagcctcctgagtagctgagattacaggcgcccaacaccatgcccagctaatttttgtatttttagtagagatggggtttcactatgttggccaggctggtctcgaacacccgacctctggtgatccacccgcctcagcctcccaaagtgctgggattacaggtgtgagccctgcctatcttgttcttattctatcccctaaatgattttaaaaatacacaatgaaaatattttaaaagaagactttttggaacagtaattcataatccctgtctactaaagacaagtagtgggacagaagtctccagtgcaaggacaaagtgttgccctagaaggtgaaacttgataggggcaaaagttattttcagagtgtggtgtatttttttgattaaaaaaaatcctctatgatgaagagtctcatttaattatctgcatgattcaatggaggtgctttgtccagaaagcccccgatctctctttttcttctgctctcaagcgttcatagcctgcctctcagatgtgccccaacaagcaataagaaatgcctgaattccagcattgaactcccaatcttatcaaaaagctctaatatttaaaatcaaactcagttagcaagtttatgatcactgagtaaataagttatacttaaaaacttatgtgaaacatgatagttttttgctgtacattttcaaatttttaaactaaacctatttagtaaagagcacctgttaaaaagtattgttttaattttttttttttttgagacggagacttgctctgtcgccaggctggagtgcagtgatgcgatctcggctcactgcaaccaccgcttcctgagttaaagcgattctcctgcctcacaagtagctgggactacaggcacacgccaccacgcccagctgatttttgtagttttagtagagacagtgtttcaccatgttggccaggatgggctcaatctcttgaccttgtgatctgcccgcctcggcctcccaaagtgctgggattacaggcgtaagccactgcgcccggcctattgttttaaattttgccccatgttttctattcttattatctttataaaagaacaaaattatctactgtatatgatttttaatatccctaacttctatgtataacacaaaggtattatgaagatgaaatgatttaatgtaggggaaatgtattttaaaaatagaaaagtattatgtaaaagaaggtgttcctctttctattaataagttattatcgcttattctcatgtggctgggatgcatgcacaaagtcaacttcaaccctctttgcttacttttcccatgagctttggtgtcctttctttttcttcttttgatacagggtctcgctcttttgcccaggctggagtgcagtggcacaatcaaggctcactgtagccttgacctcctgggctcaagtgatccaccctcctcagcctcctgagtagctgggactacaggcatgcaccacactgcgcctggctaattttgtattttttgtagagatggggtttcaccatgttgcctaggctggtctcaaactcctgggctcaagagatccttccaaagtgctgggattacaggtgtgagccaccctgcttggcctggtgcctttcttatttgtgtcctaggaagcaccttacccagaagggcccattgtttcagtttagagagatgaagaaagtaagaaatgatcactttttaaatttgaaaaaaacctgaaccaattatttaagattaaaaattaaaaatcagttttacagtatactttgtcttcagataaccagtaaaactatccagaagtgctcccacctcagtgttgcattattttaaaaattccattatgtggcaaaagtgtgttctagatttgctcgtggtgcctgattcattaactttacttcttgttttttaaaggattacaagtaccacattggttaaagctcatttcagttttgttttagtgcagtcgttttgttcagttctttccagtcctacttgcagttctgaagaatatttctttgtttatgatgccattacaggaatttgtaagtgtctgggttcgagatcctaggattcagaaggaggacttctggcattcttacattgactatgagatatgtattcatgtaagtatgtagtcagtagaaatagtaattttgagggacttttatgggatacattttatgggataaagttgacacttgtaaaagtttttctcattcaaataactgaatttgaatgattacaactaatgcttttatcttacatgaactagtaagatggttcctaaagttgaaaaattacttatttgaatcccttattgttcctttgttaatattaacattttaatgtttattgccttcacatgtgaagatgtgcacgcatctaaaatgcatgggtaaagagtacttatagctcattaatggcatttcttatgatctgctatagcatatttctggataatataatgcctgataaccttcaagtttgagaggatatagagttctttggaaaagagatgtgtggtgttttatatatagaatcagaaggtgggaaatggatatgtgcaattattgtgattaatttatctagaatctgagtaattaatgtaacgagtaagcaactagaaatgatgtgccttgcgtggatgctactgtatcacaatctcttgaaaatgttgtgtggtgtgtggccttctgtgaccatcttaaacaagggtaagcaaacttctctgtaaaggtagtaaatatcttcagtttgtgggccatacagtttctgtcgagactactcatttctgctgttgcaggtgaaaagcagccacagacagtgcataaatgaatgagcataattgtattccaataaaactttatgtgcaaagacaggtgtcagaccagatttggccctcaggctgtagtttattggccccgattttgaggataatactctttgcatctaaaccagatgcatatcagatgcaaactaaattagttcaactggggagcatagcaattgacccagattgtatccgtgacttcatagcacaagtgaagtaaaatttagccattatttaatcttcccattgtaaatagctaacttggtatattggacacccaaacaccagctgtagaacttttctttttttaaattctcctttcttctcttttttctttgaagtttccccaactttgaaaataaaagaaaaactcagaactgcttttttgattgtgttgtaaagccattccaggatatgccatgtattttgattctgttttggttttacttataagctcacactagagttgcattctgtgtggaaaattatgactatataagaataagcatttgaagtaaaatgaaatagttttagttgccttctaactttctgtaaaaaaattgtgcgtccttatcacacacttcatgataggcatgaaatttaattattcccaggaattaatgaaagtatagattctgctctgctctataaatagcctgatgtaaattcagaaatctccatctggagccagaaatgatgggttccacaaatactatttgatggtgtcctggcacttttctgaaatgctaataaattgacaatggataagccttggcttggtggacagcaaaaacaagcaaatagatttattagaggaacttaatcagttagtgatctcagtatcctctaatcttgaagagacttccacctgtcatacaattaaaagtggatggcagagctagggagttctggttggcttctcttagttgttaacccatagagctttggaggtagagaagctggtctttaacttgtttaaattaacctcaagggagatgatgtcacacaactctgggatcttaacatttacttggaattttaaattagtagaccctagagctgggtagccatcataaatactcccctgaacctgccctgcaaatgaaggacttatggatcgaccttagtctggtgtaggtaccaggtggatttttagttattgacaaccatggtggttgtgagcagagaaattaaagggaatttaaatggacccagcctgtgtgtgagatgtcaggaatccctgtggtggtctgggattctttagggagagggtaccgggaagataacctgctcaagccttgttaggggactagttctggtataacatggtctgcaaacctagtccccaaggagcacagtagagtgaggccctggtgtgttataagtccacccacaggatgttatttgccacaaactccttccagcgggttttgctgccatatcgttaaagataatgggatttagaccagtggctaccttggggataagccttttaacctgtctacattctgaagttttctgaactttacaaagcataagcataccaggaaccatgtcatatatttcatgagaacagtttgagagctaatgcacataattacttagatttcccaaggaaaacaatcgctgggcatattaagtgatagaataataatttttgaaatagtactgatcttgggggtaaagaattgtttctcatttagattagaaaatcggattttgaaatacagagactagagatactcatattttcaaaaatcaggagaaacaaatattttggtagtcgcttgttttactcaaaggagaatatttactctcgtcttatgtttactcaaaggagaatatttactctcgtcttatgtttacgcaaaggagaatatttactctcgtcttatgtttacccaaaggagaagcattgtggctgagcttagcatggggacaccatcggtggctttttccaagtctgccttaggatagctggaaggaaaccaacacttagtaactaacagtattattaatagataacattggtcaagtgcttattatcaatcctcacaaccaccctgtgaattagatatatactagttcatcccattttagtactgaggaaactgaagtttgagtgacttgccctgtagcagaaccaggactggaattccggtcggcctgtcctctatgccagatgtttatccccacgtaccacggtcattctctggctcggacggacacgctccctctcacatacagtagagaagggaatgctgttctctaggatttctggtgatttgtatgatctgcagggtggccatgtcaaggagatgaagatttctgcaatgtctcataaagggtcatgaggaggtgtctctaagccccaaagtttcctccagcttacgtggatggtggtaaaatgcaacggatgaacctgagctcctacctgtcatttatatgttaggatttattttttatgatttattcttgaaagcagtgctcataggtgagtaggaggctccttcaggatgcagggagtggccaggtcatacctcaccctggggcaacactgcttatttccatcatcctggctgtcttcagggctgttatgttcctgggttatgtgcaagatttcagagtactggcataaatataaatatatgtttggtggtttaaatcctatttagagtgaatgttgagatcatattgtgaattatagatacaagaaatgcatttttttcctcaggtaagactcatttttctactttctctgtacagactaatagcatgtgttttacaatgaaaacatcctgtgtacgaagaagatatagagaattcgtgtggctgaggcagagactccaaagtaatgcgttgctggtgtaagtgatttagagtatactgtggagactttgtcattatattcagtatttaaaattgacgttcattaagatatataagatatgaaggatttttataggcttttgccttgattacaatatgtagctttagtttcttagctactgcatctgaatttaaaatttatcacttaaatttcaccaactttgatgggtataggccatgaaaggcctcagaaatgtttaaagatgggtttttctttaagctgacttcctgatacccttattatataactatataatgtataatcataattatagaataactgtgtgataataatcatcatacataatttgccttcactttgagggatttctgtaacagaagcaccttgagttaatcatttaaaaacattgttttttctttctcctaagacaactgccagaacttccatctaaaaacctgtttttcaacatgaacaatcgccagcacgtggatcagcgtcgccagggtctggaagatttcctcagaaagtgagtgtccagaaacttttgtggccagacaaggggtgtgagcaagtgctttacaagagctgcatggtggtgtggggaagagtgttcctgtttctgaaatgcaaataatctgcactagagcaaaacccagtggcccatttcctatattagagcaccatcttgtggctcacatcatctcgtacatatttgggaccaagtcttctagaaagaaaacaatgaacaaattgaattaaatatctggtcctttaagctgtcaagcagatctaaattacctgggcgtttagctgacaaaagtaaaaatttgccaggaaacaaatatgcctaatcatcaaaaggcacttcttaaaaactgtctttctttacaatgcttagaatttacagaccaaaatcagctcagtaacgggctgctaatatccttctgggttcctctaatagtttaacgctgatctttgaagggaatgtttataaaggagtatttggtggcgtgtgaacagtctcagtgagttattaactctggattactctgtgatggtgggtattgccgttaaagctgcctgagttcacactaccagtgatttccctcccccaatccactctctggaatgctggaatacccagaatgctagaggccatatagcacgctgatttacacctagactccgaggccaggctacctgagttcagatcctcgctctgccacttactagctgggggcttgggcagatcatttacctcctctgcctgtgtcttcccatctataaaatggggtaatcatagtacctacctcatagggttgttgagaagattagacaagttagtgactgtaaagcactcatgacagtgtctggcatgcagtgtgtgctatcttcatgttggctgttattatcttaatgcacttagacatgagacagcttttgctttcctaatttccaattttgtagataaggaaataggctgagtcatatgactactagttactgacaggacccagtctcctgaactgtttctttttctagtagtttcaggatctgaagtcatctcctttggggttcactaaataggaccttagagctagcctgaaataaatatactgcctcctccccatttggctctctcataaagggtttggatattaagtatgcacattaatattaatatttatttctattagattgacttagtgccttttctttgaaggtgtcctagaggcatacagaaagatccaagattataaattgagggagagtgggccaatgaagagaagccagaggaataaacatggcaagagaccagaagaactgattagcagagccaagtcctccgaaaacatttcattgtatttttggggggtatcacaggcatggcaggacagagacctggccaagtttttcctgccctttcccctagaggaggcctctgattttaattgttgtctctatgaggcccaggtggctgatggcctctcccttgagatgtggtccctgccacacaattctacagaattgcctgtcactctagtgtaggacatgttgtcctcggggagctgtggcatcttgtcttctgtagggaagtcttatttcaggtcagaaggcagcacgtacctctgaattatattgctggttaagtgcagggtatgtgtttttgaccaggaattacttcgttgttttgaacacaacctttctatccacagttgatctacccaaatgaatgaccctgtgagtgtcattcagccatagtggggttatgcttgtgccaggttatttttgcatagtgcatggtttgactgtttgctggttgtgtttgatgcagatgtcatagtagaaagtgtcctggttcaggaactcaaggagccgggttctaggtctcccataatcatggttcctggttttttttctagctgcatgtgagccttggaacagtcacttcattccttttaagcctttgtttgctatagagtgggataatagtacccacacatagccaacctcactgggtggttgtgtcctacagatgaaaaggacttgaaaaaaactctaaaaaccatgcagcgatccttcattcaatagatgtttattaagtgaatgctttgggccaggctgcgtgccacggacataggactgcacagaatgaacaagtccttgtcctgacacttccttctagggggagcactgtgtacacatccagggctacggctagattcattaacactgaatctggattgtcatccgattggattgtcaaatcatggaattggcagggggttctcttgtgatatcatttgttcccctgtggtatgtgaacatttgtctacaagttaatatttcactttaaaaatgaaagctggtgcttccacacagcctaaacctgaaggaagtgaggagtcaaataccacagggctggcttcaggcctgaactgagctctgcggcccctgctgaccctccccagcctcccttctgtgtccctcagatctgtgcttgcccgggttgtgtaaggtagtaccctccatgtctttgcccctggtgccccctcccctcacccaaccagggtccactctagggaactggatgtgatgtgtaccttggcactgtgtcttggccccagtttgacatcctctgagcccccactggttacctgttaagtagggccagccatcaatagcctgtaccttgtttgtagaggaattttaggaaccacagcattaaaacatggaaacatgcttgtattgtaggtttttcgcatgcatttttaaagcctggttttcatgtgagttttgaagttatgaaccagaagcactaaatatgttcaaaccttttgaaaccacaatgtctttgtatatgtgtatatatacctatttttctttaaggtcatttgtgaaatgatacatatgtaataagaaagtactgatctttgtagaggaattggaaaattgtttctttgactaggtgccaaataagaataatttctaccatttatcgaacactttctacgtgtttggcattttacatgttttagtctcagtactaaaaatcttaggagttgggtattatctcagttttatagataaagaaattataggaaagatggacatactatatgaatcccagaacctggcaaatttaaaattagcagtactcttaaatgctggctaaatttggtatgattgtgagatttttcaaatatattcatttttcttcagtcttaactataatctcccttttgtattcttgcccctgagtaattataaacttaaagtcccttctaatagttatgaaaagaaagttataggctaaaaaatataaactcagtaagtctctaactatgaaaaatggaattcctactaatttttaggtttgaatgggattttcaatttaggtttgaatagatttgttcatgactgggagccgcttcccttctttactgaattcatcccattaatacaactacatttaccctacagtttagactttagtatcatggttttgtatttcttcaaatattaaggaatattaaagattttttacaaaaggctagtgttgaaccatgacagctagttttacacacacacgatttttatgtctttgtgttcaatagagggcaccacagcatagatcatgaatgtcttcaatgaagatttgtaggttttattttttcttatagtaagagctaaacaggctgagttaattttttttttctacatcaaactgctaaccttccatgtactatgcagttatgtatatatatcattgtattgggttcagcagacccaggacatccttagttaggatgaaatgattttgcatagctatatattctcagctaaaccagcatataatacatctaataaaatcatgttgaggaaaactgtgcttttcaactgtgtccagtttagggaaaaaaaacagattttgctttgtttagtctaaaactgttatggggaaaggaataacttctgatttgcactataaatatctttctagaaattcttttaaaatcctagaggctattttttattccttttataaaggtttgaaaatcatatactttttaaatggaggtttctacaaatgacattttattgactgttttacaaagtactctttatattaggtttgaaattgattttgggctattagatttgtttgtggaaaatatggcacaaacatgactaaggaaaaaatagtatttaatattatgatggtggcagtcacagccctctctgatagtaagccaaatagtactcaaaataaattaattatgctcacctaaccagatgggaaaacactctcaaaaattttcattttaaatttcagaatgaactatctgactaaaataagcatataaatacatttaaaaattatttttgcttatttaaaactcatggagtatggtggcatgaatttagccagagaaacagaggagattccaaaaaccaaaactgtacctagccgactcactggtttgaactctaggcctgggggagtgttcagatgtcccctccccagccacatctttctggctctttggaattgtgagctgggtgagcctggctccttctcttttcatctgtgtgtcctccagatggcagtattgagcagaaaaagaaaacgctgggaaataatgagtctaatgtacagtaaaattggaaattgaattatagctcaagaaaaaggacagtagccttgaggtcccgatcaacctggactctgatcacttttgtttgctgtacccatgtgttaagttactagcaagttaataacaacacgtgagcagttcaaggctcagtagaattgcttcagacatgaaataaagctaaaatgaatttgtgtccaatatcattggcattagtgctcattactgttgtggtgtaatgcctcaaaccatctaaaatcaattttaaagattacccattattttataaagaaaataaaacacatttccaacagaaacaaagccacgagtacaatcccatgaacagttccttgtacttatggcaggcaggaaaccgctgacagaggccacaggaaacactctgctcagacttcacagacttcacgatccaagttcgtattaatggattgttgctctataactcttctcttaatctgaagtatttaaaaacaagaatggtgaatatttgtaaatgtagaaaataaatctcaaagagtagtaagagggatttactacttagctacttgtacttggtaaattaatcattatcatgtgacatggtcatcttttgggaggacccagggcggaggacacagagggaaaaagaaggatttagctgctttgcttgaggttttgccttttaaaaagcacaaaggttttacttttccttctaatagaccagtaaagaatattttctcaaactgtaaacctgctgaagcaaaggggacagctagattttggttttaatactgtgcatttttaggcatttttgcctttgttaagaaataattgttttattttgtagaaaaggatttggtattataatgaccttggattttcactaaattgatattaatggccaaaagagatttactttccttattacttgtttaaacaagcagaatataaggtaaggttcatttggtctgaaatacatgatctatttttcacagatcgttatatcggaaaaatcttatgttggacaaaattctacttgggttttagtgtgttagttttgtcccctgtatctggtcttagtgtctcctcttacataattattgaactatcagtagagactaaatgatcatatgtcaacatctttgctaaaagataaaccagtttttatttaaatataaaggtatactttgatttgatttcatattctaagatgtgcatttcagagaaaacacattcactaatatgaatttgagcatctgtagattttgctacaggatagtttttaatcttccatgtagttctgatgccctggttgaaatctgttctgtctttgtaaactttgatcttaaatgtgggaagagcagtatgtattcatcacaaaattatcatattttaattatatatatggtaaagttggctgggatcaattttatttggttgctcattttgacaacacagagattcagtgctcctaaagattttggagaaatttacagttaaccttaagtattaaaaaaagccatctctctcatgagctgtcgtaaacatgcccttaagtatataactgtaaagttttaaaatgtaaaatatgctgagaattgtattttcttcatataatttttaatagtagttgaaagttttgatgtttcatgacagcctatcccataaagatcactgaattgacatgctgttggcagtaaattttttaaagtagaataactttctatgactatataagcaaaatatttccataattaatccacatggtaataagagatgggtaaattgaagaaatgtccttgaagttattcttttaacagatgttcttaactattagcttcatgtttttacccacctaaatttccaaataattgaataaaagttaacatatgctttcctccccttaatgggcagagcccataattgatacaaagtttaccacagtagagaaattaccttcagtggtacttttctaatgtttttctttcttctaccctatcactgaccatcctgttcaccaattatttttccttttttttttaatatagagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaaggtatttccttgcattttgatttaatgtatatgtatttatataatacatagtatgcacatatgcacgtgtatagatatatatacacacttcacttttttgttgatataatactaagataatgaaaaaattaattgactgagattttattgagctgtgacagctcatcatagtagtcttcacacacacctccacactgaattaatgaatgcagtagaaattcaattatttgcattctgattatgtgactttcatttagtcagacttgaattattcgcgtttaaattatctagctaaaaaaatacccaactgcactccaaatggctaattaaaagtccaaatttcctgtctctctttgtgactggagataattaaagttctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaa

SEQ ID NO: 2028 - DNA, 82435 bp, Homo sapiens; identical to SEQ ID NO: 2027
  source 1..82435: mol_type = genomic DNA

SEQ ID NO: 2029 - DNA, 13446 bp, Homo sapiens
  source 1..13446: mol_type = genomic DNA
agttttgttttagtgcagtcgttttgttcagttctttccagtcctacttgcagttctgaagaatatttctttgtttatgatgccattacaggaatttgtaagtgtctgggttcgagatcctaggattcagaaggaggacttctggcattcttacattgactatgagatatgtattcatgtaagtatgtagtcagtagaaatagtaattttgagggacttttatgggatacattttatgggataaagttgacacttgtaaaagtttttctcattcaaataactgaatttgaatgattacaactaatgcttttatcttacatgaactagtaagatggttcctaaagttgaaaaattacttatttgaatcccttattgttcctttgttaatattaacattttaatgtttattgccttcacatgtgaagatgtgcacgcatctaaaatgcatgggtaaagagtacttatagctcattaatggcatttcttatgatctgctatagcatatttctggataatataatgcctgataaccttcaagtttgagaggatatagagttctttggaaaagagatgtgtggtgttttatatatagaatcagaaggtgggaaatggatatgtgcaattattgtgattaatttatctagaatctgagtaattaatgtaacgagtaagcaactagaaatgatgtgccttgcgtggatgctactgtatcacaatctcttgaaaatgttgtgtggtgtgtggccttctgtgaccatcttaaacaagggtaagcaaacttctctgtaaaggtagtaaatatcttcagtttgtgggccatacagtttctgtcgagactactcatttctgctgttgcaggtgaaaagcagccacagacagtgcataaatgaatgagcataattgtattccaataaaactttatgtgcaaagacaggtgtcagaccagatttggccctcaggctgtagtttattggccccgattttgaggataatactctttgcatctaaaccagatgcatatcagatgcaaactaaattagttcaactggggagcatagcaattgacccagattgtatccgtgacttcatagcacaagtgaagtaaaatttagccattatttaatcttcccattgtaaatagctaacttggtatattggacacccaaacaccagctgtagaacttttctttttttaaattctcctttcttctcttttttctttgaagtttccccaactttgaaaataaaagaaaaactcagaactgcttttttgattgtgttgtaaagccattccaggatatgccatgtattttgattctgttttggttttacttataagctcacactagagttgcattctgtgtggaaaattatgactatataagaataagcatttgaagtaaaatgaaatagttttagttgccttctaactttctgtaaaaaaattgtgcgtccttatcacacacttcatgataggcatgaaatttaattattcccaggaattaatgaaagtatagattctgctctgctctataaatagcctgatgtaaattcagaaatctccatctggagccagaaatgatgggttccacaaatactatttgatggtgtcctggcacttttctgaaatgctaataaattgacaatggataagccttggcttggtggacagcaaaaacaagcaaatagatttattagaggaacttaatcagttagtgatctcagtatcctctaatcttgaagagacttccacctgtcatacaattaaaagtggatggcagagctagggagttctggttggcttctcttagttgttaacccatagagctttggaggtagagaagctggtctttaacttgtttaaattaacctcaagggagatgatgtcacacaactctgggatcttaacatttacttggaattttaaattagtagaccctagagctgggtagccatcataaatactcccctgaacctgccctgcaaatgaaggacttatggatcgaccttagtctggtgtaggtaccaggtggatttttagttattgacaaccatggtggttgtgagcagagaaattaaagggaatttaaatggacccagcctgtgtgtgagatgtcaggaatccctgtggtggtctgggattctttagggagagggtaccgggaagataacctgctcaagccttgttaggggactagttctggtataacatggtctgcaaacctagtccccaaggagcacagtagagtgaggccctggtgtgttataagtccacccacaggatgttatttgccacaaactccttccagcgggttttgctgccatatcgttaaagataatgggatttagaccagtggctaccttggggataagccttttaacctgtctacattctgaagttttctgaactttacaaagcataagcataccaggaaccatgtcatatatttcatgagaacagtttgagagctaatgcacataattacttagatttcccaaggaaaacaatcgctgggcatattaagtgatagaataataatttttgaaatagtactgatcttgggggtaaagaattgtttctcatttagattagaaaatcggattttgaaatacagagactagagatactcatattttcaaaaatcaggagaaacaaatattttggtagtcgcttgttttactcaaaggagaatatttactctcgtcttatgtttactcaaaggagaatatttactctcgtcttatgtttacgcaaaggagaatatttactctcgtcttatgtttacccaaaggagaagcattgtggctgagcttagcatggggacaccatcggtggctttttccaagtctgccttaggatagctggaaggaaaccaacacttagtaactaacagtattattaatagataacattggtcaagtgcttattatcaatcctcacaaccaccctgtgaattagatatatactagttcatcccattttagtactgaggaaactgaagtttgagtgacttgccctgtagcagaaccaggactggaattccggtcggcctgtcctctatgccagatgtttatccccacgtaccacggtcattctctggctcggacggacacgctccctctcacatacagtagagaagggaatgctgttctctaggatttctggtgatttgtatgatctgcagggtggccatgtcaaggagatgaagatttctgcaatgtctcataaagggtcatgaggaggtgtctctaagccccaaagtttcctccagcttacgtggatggtggtaaaatgcaacggatgaacctgagctcctacctgtcatttatatgttaggatttattttttatgatttattcttgaaagcagtgctcataggtgagtaggaggctccttcaggatgcagggagtggccaggtcatacctcaccctggggcaacactgcttatttccatcatcctggctgtcttcagggctgttatgttcctgggttatgtgcaagatttcagagtactggcataaatataaatatatgtttggtggtttaaatcctatttagagtgaatgttgagatcatattgtgaattatagatacaagaaatgcatttttttcctcaggtaagactcatttttctactttctctgtacagactaatagcatgtgttttacaatgaaaacatcctgtgtacgaagaagatatagagaattcgtgtggctgaggcagagactccaaagtaatgcgttgctggtgtaagtgatttagagtatactgtggagactttgtcattatattcagtatttaaaattgacgttcattaagatatataagatatgaaggatttttataggcttttgccttgattacaatatgtagctttagtttcttagctactgcatctgaatttaaaatttatcacttaaatttcaccaactttgatgggtataggccatgaaaggcctcagaaatgtttaaagatgggtttttctttaagctgacttcctgatacccttattatataactatataatgtataatcataattatagaataactgtgtgataataatcatcatacataatttgccttcactttgagggatttctgtaacagaagcaccttgagttaatcatttaaaaacattgttttttctttctcctaagacaactgccagaacttccatctaaaaacctgtttttcaacatgaacaatcgccagcacgtggatcagcgtcgccagggtctggaagatttcctcagaaagtgagtgtccagaaacttttgtggccagacaaggggtgtgagcaagtgctttacaagagctgcatggtggtgtggggaagagtgttcctgtttctgaaatgcaaataatctgcactagagcaaaacccagtggcccatttcctatattagagcaccatcttgtggctcacatcatctcgtacatatttgggaccaagtcttctagaaagaaaacaatgaacaaattgaattaaatatctggtcctttaagctgtcaagcagatctaaattacctgggcgtttagctgacaaaagtaaaaatttgccaggaaacaaatatgcctaatcatcaaaaggcacttcttaaaaactgtctttctttacaatgcttagaatttacagaccaaaatcagctcagtaacgggctgctaatatccttctgggttcctctaatagtttaacgctgatctttgaagggaatgtttataaaggagtatttggtggcgtgtgaacagtctcagtgagttattaactctggattactctgtgatggtgggtattgccgttaaagctgcctgagttcacactaccagtgatttccctcccccaatccactctctggaatgctggaatacccagaatgctagaggccatatagcacgctgatttacacctagactccgaggccaggctacctgagttcagatcctcgctctgccacttactagctgggggcttgggcagatcatttacctcctctgcctgtgtcttcccatctataaaatggggtaatcatagtacctacctcatagggttgttgagaagattagacaagttagtgactgtaaagcactcatgacagtgtctggcatgcagtgtgtgctatcttcatgttggctgttattatcttaatgcacttagacatgagacagcttttgctttcctaatttccaattttgtagataaggaaataggctgagtcatatgactactagttactgacaggacccagtctcctgaactgtttctttttctagtagtttcaggatctgaagtcatctcctttggggttcactaaataggaccttagagctagcctgaaataaatatactgcctcctccccatttggctctctcataaagggtttggatattaagtatgcacattaatattaatatttatttctattagattgacttagtgccttttctttgaaggtgtcctagaggcatacagaaagatccaagattataaattgagggagagtgggccaatgaagagaagccagaggaataaacatggcaagagaccagaagaactgattagcagagccaagtcctccgaaaacatttcattgtatttttggggggtatcacaggcatggcaggacagagacctggccaagtttttcctgccctttcccctagaggaggcctctgattttaattgttgtctctatgaggcccaggtggctgatggcctctcccttgagatgtggtccctgccacacaattctacagaattgcctgtcactctagtgtaggacatgttgtcctcggggagctgtggcatcttgtcttctgtagggaagtcttatttcaggtcagaaggcagcacgtacctctgaattatattgctggttaagtgcagggtatgtgtttttgaccaggaattacttcgttgttttgaacacaacctttctatccacagttgatctacccaaatgaatgaccctgtgagtgtcattcagccatagtggggttatgcttgtgccaggttatttttgcatagtgcatggtttgactgtttgctggttgtgtttgatgcagatgtcatagtagaaagtgtcctggttcaggaactcaaggagccgggttctaggtctcccataatcatggttcctggttttttttctagctgcatgtgagccttggaacagtcacttcattccttttaagcctttgtttgctatagagtgggataatagtacccacacatagccaacctcactgggtggttgtgtcctacagatgaaaaggacttgaaaaaaactctaaaaaccatgcagcgatccttcattcaatagatgtttattaagtgaatgctttgggccaggctgcgtgccacggacataggactgcacagaatgaacaagtccttgtcctgacacttccttctagggggagcactgtgtacacatccagggctacggctagattcattaacactgaatctggattgtcatccgattggattgtcaaatcatggaattggcagggggttctcttgtgatatcatttgttcccctgtggtatgtgaacatttgtctacaagttaatatttcactttaaaaatgaaagctggtgcttccacacagcctaaacctgaaggaagtgaggagtcaaataccacagggctggcttcaggcctgaactgagctctgcggcccctgctgaccctccccagcctcccttctgtgtccctcagatctgtgcttgcccgggttgtgtaaggtagtaccctccatgtctttgcccctggtgccccctcccctcacccaaccagggtccactctagggaactggatgtgatgtgtaccttggcactgtgtcttggccccagtttgacatcctctgagcccccactggttacctgttaagtagggccagccatcaatagcctgtaccttgtttgtagaggaattttaggaaccacagcattaaaacatggaaacatgcttgtattgtaggtttttcgcatgcatttttaaagcctggttttcatgtgagttttgaagttatgaaccagaagcactaaatatgttcaaaccttttgaaaccacaatgtctttgtatatgtgtatatatacctatttttctttaaggtcatttgtgaaatgatacatatgtaataagaaagtactgatctttgtagaggaattggaaaattgtttctttgactaggtgccaaataagaataatttctaccatttatcgaacactttctacgtgtttggcattttacatgttttagtctcagtactaaaaatcttaggagttgggtattatctcagttttatagataaagaaattataggaaagatggacatactatatgaatcccagaacctggcaaatttaaaattagcagtactcttaaatgctggctaaatttggtatgattgtgagatttttcaaatatattcatttttcttcagtcttaactataatctcccttttgtattcttgcccctgagtaattataaacttaaagtcccttctaatagttatgaaaagaaagttataggctaaaaaatataaactcagtaagtctctaactatgaaaaatggaattcctactaatttttaggtttgaatgggattttcaatttaggtttgaatagatttgttcatgactgggagccgcttcccttctttactgaattcatcccattaatacaactacatttaccctacagtttagactttagtatcatggttttgtatttcttcaaatattaaggaatattaaagattttttacaaaaggctagtgttgaaccatgacagctagttttacacacacacgatttttatgtctttgtgttcaatagagggcaccacagcatagatcatgaatgtcttcaatgaagatttgtaggttttattttttcttatagtaagagctaaacaggctgagttaattttttttttctacatcaaactgctaaccttccatgtactatgcagttatgtatatatatcattgtattgggttcagcagacccaggacatccttagttaggatgaaatgattttgcatagctatatattctcagctaaaccagcatataatacatctaataaaatcatgttgaggaaaactgtgcttttcaactgtgtccagtttagggaaaaaaaacagattttgctttgtttagtctaaaactgttatggggaaaggaataacttctgatttgcactataaatatctttctagaaattcttttaaaatcctagaggctattttttattccttttataaaggtttgaaaatcatatactttttaaatggaggtttctacaaatgacattttattgactgttttacaaagtactctttatattaggtttgaaattgattttgggctattagatttgtttgtggaaaatatggcacaaacatgactaaggaaaaaatagtatttaatattatgatggtggcagtcacagccctctctgatagtaagccaaatagtactcaaaataaattaattatgctcacctaaccagatgggaaaacactctcaaaaattttcattttaaatttcagaatgaactatctgactaaaataagcatataaatacatttaaaaattatttttgcttatttaaaactcatggagtatggtggcatgaatttagccagagaaacagaggagattccaaaaaccaaaactgtacctagccgactcactggtttgaactctaggcctgggggagtgttcagatgtcccctccccagccacatctttctggctctttggaattgtgagctgggtgagcctggctccttctcttttcatctgtgtgtcctccagatggcagtattgagcagaaaaagaaaacgctgggaaataatgagtctaatgtacagtaaaattggaaattgaattatagctcaagaaaaaggacagtagccttgaggtcccgatcaacctggactctgatcacttttgtttgctgtacccatgtgttaagttactagcaagttaataacaacacgtgagcagttcaaggctcagtagaattgcttcagacatgaaataaagctaaaatgaatttgtgtccaatatcattggcattagtgctcattactgttgtggtgtaatgcctcaaaccatctaaaatcaattttaaagattacccattattttataaagaaaataaaacacatttccaacagaaacaaagccacgagtacaatcccatgaacagttccttgtacttatggcaggcaggaaaccgctgacagaggccacaggaaacactctgctcagacttcacagacttcacgatccaagttcgtattaatggattgttgctctataactcttctcttaatctgaagtatttaaaaacaagaatggtgaatatttgtaaatgtagaaaataaatctcaaagagtagtaagagggatttactacttagctacttgtacttggtaaattaatcattatcatgtgacatggtcatcttttgggaggacccagggcggaggacacagagggaaaaagaaggatttagctgctttgcttgaggttttgccttttaaaaagcacaaaggttttacttttccttctaatagaccagtaaagaatattttctcaaactgtaaacctgctgaagcaaaggggacagctagattttggttttaatactgtgcatttttaggcatttttgcctttgttaagaaataattgttttattttgtagaaaaggatttggtattataatgaccttggattttcactaaattgatattaatggccaaaagagatttactttccttattacttgtttaaacaagcagaatataaggtaaggttcatttggtctgaaatacatgatctatttttcacagatcgttatatcggaaaaatcttatgttggacaaaattctacttgggttttagtgtgttagttttgtcccctgtatctggtcttagtgtctcctcttacataattattgaactatcagtagagactaaatgatcatatgtcaacatctttgctaaaagataaaccagtttttatttaaatataaaggtatactttgatttgatttcatattctaagatgtgcatttcagagaaaacacattcactaatatgaatttgagcatctgtagattttgctacaggatagtttttaatcttccatgtagttctgatgccctggttgaaatctgttctgtctttgtaaactttgatcttaaatgtgggaagagcagtatgtattcatcacaaaattatcatattttaattatatatatggtaaagttggctgggatcaattttatttggttgctcattttgacaacacagagattcagtgctcctaaagattttggagaaatttacagttaaccttaagtattaaaaaaagccatctctctcatgagctgtcgtaaacatgcccttaagtatataactgtaaagttttaaaatgtaaaatatgctgagaattgtattttcttcatataatttttaatagtagttgaaagttttgatgtttcatgacagcctatcccataaagatcactgaattgacatgctgttggcagtaaattttttaaagtagaataactttctatgactatataagcaaaatatttccataattaatccacatggtaataagagatgggtaaattgaagaaatgtccttgaagttattcttttaacagatgttcttaactattagcttcatgtttttacccacctaaatttccaaataattgaataaaagttaacatatgctttcctccccttaatgggcagagcccataattgatacaaagtttaccacagtagagaaattaccttcagtggtacttttctaatgtttttctttcttctaccctatcactgaccatcctgttcaccaattatttttccttttttttttaatatagagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaaggtatttccttgcattttgatttaatgtatatgtatttatataatacatagtatgcacatatgcacgtgtatagatatatatacacacttcacttttttgttgatataatactaagataatgaaaaaattaattgactgagattttattgagctgtgacagctcatcatagtagtcttcacacacacctccacactgaattaatgaatgcagtagaaattcaattatttgcattctgattatgtgactttcatttagtcagacttgaattattcgcgtttaaattatctagctaaaaaaatacccaactgcactccaaatggctaattaaaagtccaaatttcctgtctctctttgtgactggagataattaaagttctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaa

SEQ ID NO: 2030 - DNA, 10005 bp, Homo sapiens
  source 1..10005: mol_type = genomic DNA
actgcttatttccatcatcctggctgtcttcagggctgttatgttcctgggttatgtgcaagatttcagagtactggcataaatataaatatatgtttggtggtttaaatcctatttagagtgaatgttgagatcatattgtgaattatagatacaagaaatgcatttttttcctcaggtaagactcatttttctactttctctgtacagactaatagcatgtgttttacaatgaaaacatcctgtgtacgaagaagatatagagaattcgtgtggctgaggcagagactccaaagtaatgcgttgctggtgtaagtgatttagagtatactgtggagactttgtcattatattcagtatttaaaattgacgttcattaagatatataagatatgaaggatttttataggcttttgccttgattacaatatgtagctttagtttcttagctactgcatctgaatttaaaatttatcacttaaatttcaccaactttgatgggtataggccatgaaaggcctcagaaatgtttaaagatgggtttttctttaagctgacttcctgatacccttattatataactatataatgtataatcataattatagaataactgtgtgataataatcatcatacataatttgccttcactttgagggatttctgtaacagaagcaccttgagttaatcatttaaaaacattgttttttctttctcctaagacaactgccagaacttccatctaaaaacctgtttttcaacatgaacaatcgccagcacgtggatcagcgtcgccagggtctggaagatttcctcagaaagtgagtgtccagaaacttttgtggccagacaaggggtgtgagcaagtgctttacaagagctgcatggtggtgtggggaagagtgttcctgtttctgaaatgcaaataatctgcactagagcaaaacccagtggcccatttcctatattagagcaccatcttgtggctcacatcatctcgtacatatttgggaccaagtcttctagaaagaaaacaatgaacaaattgaattaaatatctggtcctttaagctgtcaagcagatctaaattacctgggcgtttagctgacaaaagtaaaaatttgccaggaaacaaatatgcctaatcatcaaaaggcacttcttaaaaactgtctttctttacaatgcttagaatttacagaccaaaatcagctcagtaacgggctgctaatatccttctgggttcctctaatagtttaacgctgatctttgaagggaatgtttataaaggagtatttggtggcgtgtgaacagtctcagtgagttattaactctggattactctgtgatggtgggtattgccgttaaagctgcctgagttcacactaccagtgatttccctcccccaatccactctctggaatgctggaatacccagaatgctagaggccatatagcacgctgatttacacctagactccgaggccaggctacctgagttcagatcctcgctctgccacttactagctgggggcttgggcagatcatttacctcctctgcctgtgtcttcccatctataaaatggggtaatcatagtacctacctcatagggttgttgagaagattagacaagttagtgactgtaaagcactcatgacagtgtctggcatgcagtgtgtgctatcttcatgttggctgttattatcttaatgcacttagacatgagacagcttttgctttcctaatttccaattttgtagataaggaaataggctgagtcatatgactactagttactgacaggacccagtctcctgaactgtttctttttctagtagtttcaggatctgaagtcatctcctttggggttcactaaataggaccttagagctagcctgaaataaatatactgcctcctccccatttggctctctcataaagggtttggatattaagtatgcacattaatattaatatttatttctattagattgacttagtgccttttctttgaaggtgtcctagaggcatacagaaagatccaagattataaattgagggagagtgggccaatgaagagaagccagaggaataaacatggcaagagaccagaagaactgattagcagagccaagtcctccgaaaacatttcattgtatttttggggggtatcacaggcatggcaggacagagacctggccaagtttttcctgccctttcccctagaggaggcctctgattttaattgttgtctctatgaggcccaggtggctgatggcctctcccttgagatgtggtccctgccacacaattctacagaattgcctgtcactctagtgtaggacatgttgtcctcggggagctgtggcatcttgtcttctgtagggaagtcttatttcaggtcagaaggcagcacgtacctctgaattatattgctggttaagtgcagggtatgtgtttttgaccaggaattacttcgttgttttgaacacaacctttctatccacagttgatctacccaaatgaatgaccctgtgagtgtcattcagccatagtggggttatgcttgtgccaggttatttttgcatagtgcatggtttgactgtttgctggttgtgtttgatgcagatgtcatagtagaaagtgtcctggttcaggaactcaaggagccgggttctaggtctcccataatcatggttcctggttttttttctagctgcatgtgagccttggaacagtcacttcattccttttaagcctttgtttgctatagagtgggataatagtacccacacatagccaacctcactgggtggttgtgtcctacagatgaaaaggacttgaaaaaaactctaaaaaccatgcagcgatccttcattcaatagatgtttattaagtgaatgctttgggccaggctgcgtgccacggacataggactgcacagaatgaacaagtccttgtcctgacacttccttctagggggagcactgtgtacacatccagggctacggctagattcattaacactgaatctggattgtcatccgattggattgtcaaatcatggaattggcagggggttctcttgtgatatcatttgttcccctgtggtatgtgaacatttgtctacaagttaatatttcactttaaaaatgaaagctggtgcttccacacagcctaaacctgaaggaagtgaggagtcaaataccacagggctggcttcaggcctgaactgagctctgcggcccctgctgaccctccccagcctcccttctgtgtccctcagatctgtgcttgcccgggttgtgtaaggtagtaccctccatgtctttgcccctggtgccccctcccctcacccaaccagggtccactctagggaactggatgtgatgtgtaccttggcactgtgtcttggccccagtttgacatcctctgagcccccactggttacctgttaagtagggccagccatcaatagcctgtaccttgtttgtagaggaattttaggaaccacagcattaaaacatggaaacatgcttgtattgtaggtttttcgcatgcatttttaaagcctggttttcatgtgagttttgaagttatgaaccagaagcactaaatatgttcaaaccttttgaaaccacaatgtctttgtatatgtgtatatatacctatttttctttaaggtcatttgtgaaatgatacatatgtaataagaaagtactgatctttgtagaggaattggaaaattgtttctttgactaggtgccaaataagaataatttctaccatttatcgaacactttctacgtgtttggcattttacatgttttagtctcagtactaaaaatcttaggagttgggtattatctcagttttatagataaagaaattataggaaagatggacatactatatgaatcccagaacctggcaaatttaaaattagcagtactcttaaatgctggctaaatttggtatgattgtgagatttttcaaatatattcatttttcttcagtcttaactataatctcccttttgtattcttgcccctgagtaattataaacttaaagtcccttctaatagttatgaaaagaaagttataggctaaaaaatataaactcagtaagtctctaactatgaaaaatggaattcctactaatttttaggtttgaatgggattttcaatttaggtttgaatagatttgttcatgactgggagccgcttcccttctttactgaattcatcccattaatacaactacatttaccctacagtttagactttagtatcatggttttgtatttcttcaaatattaaggaatattaaagattttttacaaaaggctagtgttgaaccatgacagctagttttacacacacacgatttttatgtctttgtgttcaatagagggcaccacagcatagatcatgaatgtcttcaatgaagatttgtaggttttattttttcttatagtaagagctaaacaggctgagttaattttttttttctacatcaaactgctaaccttccatgtactatgcagttatgtatatatatcattgtattgggttcagcagacccaggacatccttagttaggatgaaatgattttgcatagctatatattctcagctaaaccagcatataatacatctaataaaatcatgttgaggaaaactgtgcttttcaactgtgtccagtttagggaaaaaaaacagattttgctttgtttagtctaaaactgttatggggaaaggaataacttctgatttgcactataaatatctttctagaaattcttttaaaatcctagaggctattttttattccttttataaaggtttgaaaatcatatactttttaaatggaggtttctacaaatgacattttattgactgttttacaaagtactctttatattaggtttgaaattgattttgggctattagatttgtttgtggaaaatatggcacaaacatgactaaggaaaaaatagtatttaatattatgatggtggcagtcacagccctctctgatagtaagccaaatagtactcaaaataaattaattatgctcacctaaccagatgggaaaacactctcaaaaattttcattttaaatttcagaatgaactatctgactaaaataagcatataaatacatttaaaaattatttttgcttatttaaaactcatggagtatggtggcatgaatttagccagagaaacagaggagattccaaaaaccaaaactgtacctagccgactcactggtttgaactctaggcctgggggagtgttcagatgtcccctccccagccacatctttctggctctttggaattgtgagctgggtgagcctggctccttctcttttcatctgtgtgtcctccagatggcagtattgagcagaaaaagaaaacgctgggaaataatgagtctaatgtacagtaaaattggaaattgaattatagctcaagaaaaaggacagtagccttgaggtcccgatcaacctggactctgatcacttttgtttgctgtacccatgtgttaagttactagcaagttaataacaacacgtgagcagttcaaggctcagtagaattgcttcagacatgaaataaagctaaaatgaatttgtgtccaatatcattggcattagtgctcattactgttgtggtgtaatgcctcaaaccatctaaaatcaattttaaagattacccattattttataaagaaaataaaacacatttccaacagaaacaaagccacgagtacaatcccatgaacagttccttgtacttatggcaggcaggaaaccgctgacagaggccacaggaaacactctgctcagacttcacagacttcacgatccaagttcgtattaatggattgttgctctataactcttctcttaatctgaagtatttaaaaacaagaatggtgaatatttgtaaatgtagaaaataaatctcaaagagtagtaagagggatttactacttagctacttgtacttggtaaattaatcattatcatgtgacatggtcatcttttgggaggacccagggcggaggacacagagggaaaaagaaggatttagctgctttgcttgaggttttgccttttaaaaagcacaaaggttttacttttccttctaatagaccagtaaagaatattttctcaaactgtaaacctgctgaagcaaaggggacagctagattttggttttaatactgtgcatttttaggcatttttgcctttgttaagaaataattgttttattttgtagaaaaggatttggtattataatgaccttggattttcactaaattgatattaatggccaaaagagatttactttccttattacttgtttaaacaagcagaatataaggtaaggttcatttggtctgaaatacatgatctatttttcacagatcgttatatcggaaaaatcttatgttggacaaaattctacttgggttttagtgtgttagttttgtcccctgtatctggtcttagtgtctcctcttacataattattgaactatcagtagagactaaatgatcatatgtcaacatctttgctaaaagataaaccagtttttatttaaatataaaggtatactttgatttgatttcatattctaagatgtgcatttcagagaaaacacattcactaatatgaatttgagcatctgtagattttgctacaggatagtttttaatcttccatgtagttctgatgccctggttgaaatctgttctgtctttgtaaactttgatcttaaatgtgggaagagcagtatgtattcatcacaaaattatcatattttaattatatatatggtaaagttggctgggatcaattttatttggttgctcattttgacaacacagagattcagtgctcctaaagattttggagaaatttacagttaaccttaagtattaaaaaaagccatctctctcatgagctgtcgtaaacatgcccttaagtatataactgtaaagttttaaaatgtaaaatatgctgagaattgtattttcttcatataatttttaatagtagttgaaagttttgatgtttcatgacagcctatcccataaagatcactgaattgacatgctgttggcagtaaattttttaaagtagaataactttctatgactatataagcaaaatatttccataattaatccacatggtaataagagatgggtaaattgaagaaatgtccttgaagttattcttttaacagatgttcttaactattagcttcatgtttttacccacctaaatttccaaataattgaataaaagttaacatatgctttcctccccttaatgggcagagcccataattgatacaaagtttaccacagtagagaaattaccttcagtggtacttttctaatgtttttctttcttctaccctatcactgaccatcctgttcaccaattatttttccttttttttttaatatagagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaaggtatttccttgcattttgatttaatgtatatgtatttatataatacatagtatgcacatatgcacgtgtatagatatatatacacacttcacttttttgttgatataatactaagataatgaaaaaattaattgactgagattttattgagctgtgacagctcatcatagtagtcttcacacacacctccacactgaattaatgaatgcagtagaaattcaattatttgcattctgattatgtgactttcatttagtcagacttgaattattcgcgtttaaattatctagctaaaaaaatacccaactgcactccaaatggctaattaaaagtccaaatttcctgtctctctttgtgactggagataattaaagttctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaa

SEQ ID NO: 2031 - DNA, 82435 bp, Homo sapiens; identical to SEQ ID NO: 2027
  source 1..82435: mol_type = genomic DNA

SEQ ID NO: 2032 - DNA, 51182 bp, Homo sapiens
  source 1..51182: mol_type = genomic DNA
ttagtgtagatatagacttttaaaggtaaaaagaaagaataaagatggagggtgtgataatcctatgaagtgtctgggtttgggtcctgagggcagccaattacatcccagactcactggcaatcaacagtccaagccagggtcccatcagctgaatcctgaggtggggatgcttcagtctttacagaacagggtcaaggaagagtccagaaaccgccgtcattggcttcatgaaaaccgagcacgtctttgagatctttttcaaattctgcctctaagtcaagtcctacctggccaaagtcagaagcctgaaagagaaaaaagcaaacaaacacattgaaggatgaaggattacagccatcaaatcactcatacttttttttgtgtttttgtttttgagtcagggtctttccccgtcacccaggctgtggtgcagtggcaccgtcatggctcactgcagccttgaattcctgggctcatgtgatcctcccacctcagctcctgagaagctgaaactacaggcacatgccactatgcccaaagttttaaaacatttttttctctttcagagatcggggtgaggaggccttgctatgttgctcaggctggtctcaaactcctggcctcagatgattccctcacctcggactcccaaaaagctgggattacagatgtgagtcaccatgcccagcctcactcttatttttttaggagcccagcagtaaggcagaatggatggggagatgctgctactaaaatgttgaaaagcatgagactccagctggttgttaatttccacctgacaggcgatttagactgaagggttagttttgatcatggcaaatctgagcatgatgcaaaatagcttaacaatttttgtaaatgcatttcttggaagcccactcgctgaggaaggatgaccctctgttctccaggactacggatatgccaggcactgagtggctctctggtcaaccctttctccctgcagctccatgaatgggtaccagtttacaatctgtggtttgtgaacatgccaactcctggcatggaagaagggaaggaagctgggtggagatgaaaatcttccttaggtacctcccaagaaatatctgtacaagtgaggataaaaatcaggaaaaaccaaagttacaaatgtctgggattgcaggatagctcaaccagctgtccctccctagtaaaggaggatgaaaccaacattggatctgaaggcaattccagatgtttgagtccaatgagaaatttatgtgtaaaaatatgcaagcctgattatccaggaagtttaattgattttatgttgtttacttatttattttcatatttctgaggcaggaagaacaatgtaggcataaactgcctttccttccagtttgaacaaagaggctggatgccatttactgctctcgttgggagcgagctgccgatctgggaacagagcatggtttttttcagcttctgttccagagatccctcccctgtcctgcttgctgttctttttgccactcactccttgcctccaggaatgccgaggtggttttttttctgtaatccttgtcttgtttgagctctccccaggctgaaactgagtgtaatacttgcaaaattctgctgtcccagaaattaggggaaagtagaaaagacgcaaaaaggaagcaggaaatgctctttaccttgtaaaatgttttatggttgcgaaacatcaggcgcatgtctcgcacaaaccatgccaccgtgtacatttccgtaatcagcctttccttaaccaggtccaaccacattgcttcctgaaagggctcaccgtaatctcgaatcttggggacaaagccaccagaggtgacgttagcacagctgtcatcactggaatggatccaacttaaatacaatccaagccttcatttccagggtcataatgataataccatttgacctctttaagccagctattgttctaggcactagataaactaaattctaagccaagtatatgaatatgtaatctccacatttatgggtaccataaataataatgcccatttcatagatgaggaaaccgagggatggagaggtcaaggaacctacccaagatgtctcagcaagaaagtggtagagctgagatgggaacccacacagtttggcatctatgactcttttttttcttttgagatggagtcttgctttgtcacccaggctggagtgcagtggtgcgatcttggctcaccgcaacctctgcttcctgggttcaagcgattctcctgcctcagcctcctgagtagctgggattagaggtgcctgccaccatgcctggctaattttgtatttttagtagagatggggttttgccatgttggccaagctggtctcaaactcctgacttcaagtgatctgcccgccttggcctcccaaagtgctgggattacaggcgtgagccgctgagcccagctggcatctgtgactcttaatctctagtaggaaagacattcttcctaaagagaagatgaaacagatacacaggaggagaagcaacttgcccggtatcccagagcccgtgagcagtggggtggagtttgaaccaggtagtccctctccagagtgtgcagcaaaatccctgctgccccgctccactgctgccacgctgcccttctcttctgttctccagcttcctgagcaaactgcagcacctgccagatcagcccccaaatttctccaaatgcattttatgcaagagaaccgtaaaatgtgacttacattaaatgggatgcccgtaaaaaaggagctttgtggatgacagtaggccttcaagaggaggaactcacatttctgtaaaatgtgaagagggcttgaaagtgaaatgcagcttagaaacagtgaagccaggcgagtgtctagacatgcacacggatggggcagccaagcccagtcagcattccagccatgcttcccaaggcgcacagggtgtgtgggattttgtttagactctgagtttgggcattaaatcgtcatcctttaaagggagacattgaaggctccctttggtacattgccctgaccctgtgcctgtttgtgcttctcgtgtgagaagggaaaagtataggtttggggtttgcatccaactcaccagctggtcctgaggctgcatctgcctctccagggtcttagatacatgatggcactgttggcttcctgaagacctcttcatcctgcagaaggtgcaactccacagcatcctgagaggttggacacaaggtgagcagagggcaaagcccctggaaatggccaccattcctgtggctgccactgtcttccctcaggaaggatgggctcagccatgagggtgggacacctcccagagtgtccaagatccccacatggggtctccagcattggcccttccctcgcatcagtggtagcggcaggcgggcagcctgaggaaggtggtgtcactgttaagtgtgggctctcttttccctgtctgagctgctgggagcacaaaggaaccctgcctgccaggcttgagtgtcagaatctgggctttcacctgcagggacctcaggcctccatcagccaggtgagactatggtgaaatgtgtgacaagccgtgcttcctgtctttcctcaacaggcacagaacataagctggcttttcccgtcccctcctccttttggacaggagtccctgctgtccagggaatagcatactaggaaagggcacttccaggggcagaagcagtgtggggccaagaggctcactggcagtctcagagacccagagaggcccagagtctctggcaccagactgctctgcgtcacaccctcgtccccgacgctcacaggtcctgccctttccatctggaggtgagtgctgtgtgcccgaggcggggctgcatcccactcacctcttggcttccacaggggggatgtgacagtcctcatggaagactcgtggacaagtaccgcagcagagaagttgtcccccttgacagcacacctcgcattcatccgagtttttccgctgcaagggcagataacgtgggcaccgctaggaccatggagacccacgaatgctgaccctgtggggttctagaacacatcatttttgtgtgtgccagagtggatatccaaacccaatttttgatggggggagctgatgccacctccctgggggaaattgcaagacaaatggcacaacaagcagagagtctgggtggtgaccgccgccaccaggacttttcttctctggctgtggcttgccaacaggttctgctgcgttttgagctgtgctgctgcctgctggcaagcttgtgctttgagctgggccactctgggcgcatttgctgagcccaccaggcctctattaatagatctgactgaccaaagtaagaaatgatgataactggcatttgggtgcaggagtatgggaactgttgttcctggtgccttgcctaactgccccatggtcgtaacataacatggccctaaaatgttccacagtgggcatggatgctatgacccagtaaataacacattaaaataattaaaattaagttacctttggcacttacaattggctttacaaaatggaactctatggaccttctctgttaaaatatttaatactgatcaatatgaattaaaacacggctttcaaggattgaaactcattatggaagatctatttagagaaagggtgattatccccactgtttctccatttaacagcccaatttggtctgttcttaggcttggaaagaatgaatggtgcctctcggtgaattactacaacctgaatcctgtgaccccacctgtgatggcccaatgttattgaaattactgactccatccacttagcaagtggtaaatactctgcaggcatagatttgactaatgtgttctgttcagcgcctatttcaacagatctcagctgcaggttgctttcacccccgaagggacacaatagaccgttatctggctaccacggggtacctcgacagttctgccaccatacacaatctttgcaggcaggatttgaactgcatctgacattctctaggagtacaggtgtaacatcaccctgaagacacccttctttcagcaaattcatttgacacactcaggacattactcacaaagaactcatagaaaaggatggggtttgtgtttccacatggtgggattaaactaaaacaaaaaagtatgggccactgccccaggcatagtacagggatccacaccaatttctggccattgtctggtcagttgagggatgctccatccctgacactgtcaaaaaataattattgaccctctgagtactcacagtgttctaataaacctcccagcatccttcaggcctcttgagttcaaggaaacacatccttcatttgtagattttaggtaagcccatttacgctgttacttgcaaaataagcccactttgaatggggccccttctaacaaaaggttctagaatctgtcaaattgcaatacagcagacattagtgccctcctgagtctcattcactgtggaagctttggcaacctcctctcatgcctcctggcatctctggaccacccatgatggccatgggcttctgatacaaaaaaaaaccaaaaccccaaaagctgttctcctcagcctcacactatatgctgatagagtggcaactgctggctgcatccaagcccttctggagacggaggctctcacaggccaagtctgtggctctttacaccagctgcccatcatgtgtgggtcatggaggcagcacgctgcagggcaaccacaaaacacattttgggagtaccagcatcggtctctttgttgtacacatacataagtgagactgcagtggagacagacggacgtgctgccgagcagcagtgacactggatgatggggctgagggcaaggcccgcactggctcattctcagtcgggtaaaccttcatcttattctcccaacctggccctggaaggtgggactgagaggctgggtcaagcatgcccctggctattatgagctgacatgtggcattaggagagttagagggtattaccatgttggggctattaattaatgatctggattttaaagatttttttttttctggttgcaaaagtaacaaatggtcattatagtaattccaattgtacataaaggtataatacagaaggcatatgtccctgtgatctcatctcaaaataagtgcagttgattcttttggctattttttcactcatagacctacctacacgttcacataagcaacaatgggttccttccccacacgtcacaactagcattaagtgtcctgaagctctcctgaccacaaaaccatttggtggctttccattgattgaaggataactccatacttatgaatccatgtatttaaacaaatatctatatcaaaggtctaatattctataagaaaagtttaaaaaaaaaccattctgtagctgtatcagtttattctgcaatactgatagaacttgtgttcgtccctaattttttgctattatgatgttacactgagcacccctgattctcagggtatttcagaccagcatgggaaagatgatttatataatagatggcattgggagaccagtgccttaaactttgaatgaatccagcctggtcaggccagcctccagggcaagatgggggaggcaccattgtctctgctggaagttcacaactaacgggaagctcatgagtggagctgatgtgtctggagaacacatctaagcaagtagaggaggttgaggagggggagttagtgcagccaatagatgactgccatttccagctgtagggatgccctgtagagacaaagctcagttcaaaggcgtcattccatcctggtgctaccaataagaagcatggaggattcagcaatactcagtatgcaatcatggatgatcctcttgtcctttcatatactgttcctgtctatttcaatgccttttcttttgcttttcatgctgcagcattcttttttttttttttctgagacagggtcttgctctgttgccccagctggagtgcagtggcatgatctcgcctcactgcaacctctgcctccagagctcaagtgatcctcccacctcagcctcctgagtagctgggactacaggtgcatgccaccatgcctggctaatttttgtatgttttgtaaagaaggggttttgtcctgttgcccaggctggtctcaaactcctgggctcaagggatccacccaccttggtctcccaaagtgctgggattacatcgctctgtatagcaatacagagtctcactatatcactcaggctggtcttgaactcctgggctcaagcaatcctcctacctcagccttagctgggactacaggtgcacaccaccattcctagttgattaaaaaaaaatttgttagagatggggtcttgctatgttgcctaggcttagagcattttatttctgacacctttggtttatagccatccaaatatccagatctttttctaaaacacatggacatgatgagctttttcatttaatttttattttagagtcatttgcttccccatcccaaattaactatgcaaattaattgttttgaagatgccatgcccaaatgtggaggtgactcagagcttggaaactcagaagctctaaggtgagcctccagacagggaaagtctgcaacatggtgactgagagggtagtagaaattcacttgctatttaactctctcttgagatttattcttggaggacagagcaaaagtccactctgaaagacagaaggagtcaatgaatgaggttattctggaggtttttcttttgtagatactggccttcccacttcctagtgaatgtctgtacccagacatcacactggatctcaaacccaagaagtcaaaaagaaaaattagctccctcccccagtcagtttttcttctggacctcacttagtgataaaatcactttttcccctgtcactcaaacccacgaccctagttcttctttcttaacctttcccatccattcctttctccttccatttctccctctctagattaaaatctttaggatttcatcctagtgataatttcttgagtgttgctgagagaggccttgtgttgggtcctgtcatcatagacactagttgttctcaggacaggaatagtgtgctgtggacatgcagcggagagacagaccacggactgggcagcctggaaatgctgcaggggggccagatgagctgggccttgagtagatgtcaggtagaggatgcaggggagtggttgcaggcatctgtcttcagctagtttctttttaggttcttacatctctcttcacctcaaagccctttgccggcatttaaagttcctgtactcctttacttgcatttaaagttctccaccatcaggaacaatatgtgctcctaactttgtcacccacagttttttttctatgaacatttaactccttataaatcatgctgttgaatcctaacgggagctcttcacatttctgctcttaaagctccacttctccttcaaggatttaaacctgtcacctatctgtcccgtcattataataccttcagcagctctcctagggtcattccttcacaacgtatattccgtttccagttctttgcgttccttccttttccttcgacttcaaattcatttggtgttaaccaagttccatcctcattccgaatgcacttcactgaggatcctgtaagaaaaagcccattcttggatctacccccatcctctgtgaattcaccctgaacctcttcatcctaattgtggccttctacctttccaggtcaagagagacttcctctgtgaggtggaaggagtagcaggggagtctgcgggcctcttctcttggactgaagccagccctaaagcctgactgagtggtgaggggtgggacagaatgtgcattcgtgtagtgcctacatgcagcaaggacatggctgtcagtacagcagggcccatgggtgacttccaggtgggagtggagggtctgattgccagaaataccatgatgtggaagagtttggaaattccttcctaagaagcgtttcttctgcagtctagctagcagggtccatttcctgatcaattacacacacgggtattttcctcccttctagtgagtccttcatctagggattccaaagagcagaagaccaaggaactcaccgtgtttcattttcttcttatataaaatccctttcgcctcaccacaggtcacggggagcttagaacagtgaaaatccacagtgtcacttttgggttttccttaaagtagaagagaacagttttgtgttattcagtcttcactccatcttccttttgaattctcccctccatgaattccaataatgtacagggtattggggaacgttctctggttagtttgcaggaactctttcatctcgagtgacagataagctatgtgtacacagtggcctgcaacaaaccaccactgccaccaacactatatcaaaaaaaaaaacattttagtggaacatatagggcatcttcagtgaatgtgtcttaatttgcaagtgaattggctgtcactgaatagtcttctattctataagcatcctgctgatctctctgtgctgatggaaatgtttctttgcattcatgttgccagaggaaaaaaaaatcttcatttataatcttatttcctgacttaaatgaagacttgggtgagtgaggtggctggcactgaggggatggtgtcagtcttaattatttgctgtttcttttcattttattgcttccctgcttcttcctcgatgaataaaagaaaaccctggagagctttgaactaatttcccagttgctcatggagcagtctggcaactcagaacccctgggtagaaatccagagtttagattcaggggaagcagttgcaagagggtttaaaataaatctcagcaattcctgctgccttcccctccaacctcactatgggtgaattcattaaagagagacagcaggggctgtttctctggggagaaatgaaggggctgtccatgtcttatgttgagttacagaggatgttacacctaaaatgaatctaggagaacacctggtccaactctctcccttgcctcaaacagttattgaaagagctaaaggaaaacaaatggcaaaacaagagcattgacggaaaggtgaaggaacagtatcagcggcgaagaagccattcatttctctggaaagacacaaggcagatagagtgagactgagagaggagggaccctgagaagtgaggatgtgatccccccgacagaaccctacaggatgcctggcctcacaggagcaggggctggcagcaaggctaggcatgggggtggagggtagtgggggtgtgggaacttacggtgggaaaaactttgtttcaacagccagccctcttgcatggagtggccagctccaccatttgtctctagactcaactcagtaaatatggaacagcagatgagagcgtggccttgggagccagactggggggcagggaggagtgggggtgggaggggcttgtaatcctggctctgcaacttactagaaggattacctaagcgtgcattactgttatcaaatttgagtgggaaatttgctgccgcaggttcctaatgtgagggaaaggcagagctccaggtgactctggaccactattgcaaaccttgagggagattagcacagctctggggaccttcccttctacagttctctgtctccacagaaatgtcttctctaattccctgtggtgaatatagctttagggaacacaaatgtcccaaacacattcacaagcagatgagggagcagggggtggctttgggggccacgggtagcaagctgatgtgcagagttgtgaggacaaacatcagtcccttccttacccagtggaggcaggccatcaagtgaggtggggcctttagacccgaggacttccaaagccaactgtcctatgcctgagggcagcctgttcctaatagtgctaagtctggctcagcctcacctactcatcttaccaaccaggccttgaaggatggaaccctgcagccccaggaacccggtgggggatgcttggggctctctaacggcagctggcttgtttgaaaggtgagctgcagcagcggtgagtttaggtccccattaggaagcatgagcaaacaatgaggagcctgctgtgaaaagcaagcaattagagaacagagagctcagggaaaggaaaagcaaggtggagaaaactaagaagaaaagcctaatcgagatgaggaatagcggcatggtaaaaaacgaattcataatccagaagaccaactccaggaattcctacagaacatgaggaaggagcacaaggtggaaattatgcatggaaagaccacaggcctggggagtgatttgggagctctatgatgtatacatgaggggtctggggaggggatgattgggggtggagatggggcggtgggaggaaaagtgatagtcaaggaaacagtaagagcagcagatgcactgtgtcatctatccgcataacaatgtgtaagaaagagaaggcaatgactgtcctcattttatagatgagggacttggggtcagatgtggagagagaattgccggtggtcaccatattacatgaggtggagctggcactggaatttacacatgccagacccagtatctagcgctctttccacatcatcagaaatgccacgagactgcacatcatacaagcaacaacagcacagatactctgcatttaatgagaagttacagacagtgcagaagggagaagaaactgatgctgagggacaactgtcaacgtttgccggggctcctgcctccaccagtgtttgagagtaggtgctttctaggttcatttacatttttagtgtaaaggaaaaagggcttgaaattggaacacataggttgattttagctcattcaagtcttttgccctttaattgaatctgtaaaatgggctgataacactcacttattatggtaattaaatggcaaaatgtagatcaaagtgctttgccaactgtgaagtaatgtacacatttatatggttatcaggaccactgcatgaagttgtatgggttgtgccctgagcaaggactccacctttaaggggtgctctaattcatattagaaacagaatcagtttacctgcttagtacaacaatcttccagcagaaggcagaaaagggtttggtttcaagaattggctctgacagatgaggtagtgaattgaggaaggggcacctttttctaactcacacacatgcatcagataggcccagatactggtattcatacttgaagaagtaccagctgtgtgaggcatggggagctggacatacagcaacacacaagacccatccacttactgacctcacgtgactttcacgcagtgaacaggctgtgcacagatcattcatcacagttaagataagtgccatgaagacaaaatgcaggtctccacaagggcatgtcagggagacccacccctacctgctgggagagagaatgcttccctgtggaagtgacatttaaggtgaggtctgagggcaaaggtctaatatccagaatttacaaggaacttaaacaaatttacaagaaaaaagcaaacaacacctttaaaaagtgggcaaaggacatgaacagacacttctcaaaagaagacatttatgcggccaataaagatatgaaaaaaagctccacatcactgagcattagagagctgcaaatcaaaaccacaatgagataccatctcatgccagtcagaatggcgattattaaaaagttaagaaacaacagatgctggcaaggctgtggagaaataggaacacttttatactattggtgggaatgtaaattagtttaaccattgtgaaagacctcgaagcaattcctcaaagacctagaaccagaaataccatttgactcagcaagcaatcccattactgggtatacacccaaaggaatataaatcattctattataaatatacctgcatgtgtatgttcaccgcagcactattcacaatagcaaagacatgggctcaacctaaatatccatgaattatagactggataaagaatatgtggtacatatacaccacggaatactatgcagccataaaaaggaacaaggtcatgtcctttgcaggggcatgattacagctggaagccattatcctcagcaaactaatgcaggaacggaaaactaaacaccacatgggttctcacttataagtgggagttaaacaatgagaacacatggacacagggaggagaacagcacacattggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcactttggggttgggtgggtgagctgggaggcccatgtgaggaggccctgagcaggaacgaggtgggagcattcggtatctggtgacctatgctgtgaggaatcaggctggtgtgaccctagagacacgggtaggggtggtttatgggtgttggtgacatcctgtgtcttgagctgcgtgctgggtgtgcgggtgcattttctgtgtgtgtgaatccatcaagctgtactcttaggatacatgccattttctgcaagcacatacaccagtgctactcagtgctccagcctacgatgcgacaggggcttgatcagaatcaatgcactgctgtctccactgaggaatcttgctatgaaaacagtgtgcttagcgtcacagttggtttacaagctccttattcttgtagacctgccaagcagcatgcttgtagatggcaccagtctggggaccccaccttgggtagcacctattatactttgataatgaataaaaagggccagtgtggctggcgcctaaaaaaggaagagagggtgacaagaaatgatgctgaagaagcaaggtataaaagcagaagaaaaataaatgcaagaagaggagtgggagggagaggacagagatgcaaagagggccgagggtgcagagaggctgaagcaagcccagggtcccaaccaacacaggaaaaggaacgagaacactgtcaggctgtgcttgaataagggtttcctttaattcctagaatggaagacatagaagttcattttagaatttgacttaaaggtttagtgatcatccttaatcatttttgggtctttgtatagctctgtgttaaagaatccttccaagtatggaaatggccaccatgcacaagggggtgggttaggctggcagcactcctgatgcacccaattcagctggtacccatgacggtggagaacaactttggaggagaagggagagagaagaaggagagggcgggtggagcttccagcagaggccagggctctggggagcccagtggggaggcgctgtggcttgcttgcttacctcttcggtgaatatttttctgaaatctcctttttgagcttgaacagatatctttctcctttttcttttctaaacacagaattaataatcacttatagctacaaacatagatttataagcctcataggttaacaatcttcaagcattttttcctgtttttctaccagtttggagagacaagttacatatgagtccttatgaaaggacttccttgtagcattgactaaggaaatacagcaagctcatgttaataggcagaaaagctaaaaatactacagaagccaaatttccactaattaatatatgtcaatacatttactacaaatactagaataaagggatgtacaggagtccccccttatccacacggcatgtatttcaagccctccagtggatgcctgaaaccatgggtagtgcccacccctgcagatactatgtttcttcaatctgataaccaagacagctactaagtgactgatgggtgggctgcgtatacagcaggacacactggaccaagggatgattcgcatccccgagtgggatacagcaggatggtgcaagactttgtcacgctactcagaacagcgcatcatttttaacttataaattgtttatttctggaactttccatttaatattttcaaactgcagttgacttcaggtaactgaaatcatggatcaaaaaactgcttataaaggggggctactgtatggccttataaatatcacataggaagggctttttaaggaggaagtaatgggcataaagcagtggttaacactgggtgattttgctctcaggggatatctggcaatgtttggaaatctatttgtttgtcaggacggggaagcagctgctactggcatctaatgggtagaggccagagatgtcgctaaacatcccatgacacacacgacagcctccgaagcaaagaattattcagtccaaaatgtcaataatgccaagattgagaaactctggcataaaccatactgctaaaggtaaactgatttgtctatctaactaagcaaatggctccacaaccaaaagcttcttaagttcaaagacagaaaccaaatcagaaaaactaataattataacaaagggttaatttccctaacggatttaacaaaaaaaaatggccagtcttatagaaaaatgggcaaattcaaacagatgaccctcaaaagaaaaaattccaatgtcaaatttatttaaaaaacaggtaaattggtaacgataggctaggtaatgctgtggtaattcacgatcctcccaaatctcagtggtttattacaggtgtcagcaaactatggtctaagggccaaattggcctactgcctgtttatgtaaataaagttttattggaatacagccacgcccatttgtttacgtatttgcctctggctgctgtcacgctacaaaggcagagtcgagtagttgcatcttctggtcctttttggaaaaaatttgccaagctctggtttacaatggcaaaggtttacttctctctcatgctgtttgttcatcataaattagatgaggctcagccctacatcactgacactcatggcttctgcagacagagcagcctctgtctagaacatccctggtcttgggcagagagaaagaagacaaaggggctcttaaagccttggcctgaaagtggctctctaacttgggtccacatttctttcgctaagttatcacatgggcattcctgagtccacaggcagggctgtagacttctgaggaggtggggcactggaacactggagaaccgtaatacaagctaccacagcatgtttgatcacctgccaagtgaaaagaaattcaaagggaaacaccggtggaatatcacccttcacctttggccgtcatcatagacacatcttgttatttctagtgttggtgaaagtggagggaaagggtgtctgtatgatgtaatgggagtataaacagacaatttaggcaatttgacaacaaatatgtcctaacttaaaaatgcagacttgaccaagcaacttcacttctagaaatgaaacattaaaaaacaatcctgcaaatgtgtccactttgaggattggtgccacttccaagactgggttggccagaaccagaaaggagtctcccaaactcaagagagtagtggtgactctaataacagaaatgaaaacagcagacactggggagtagtcatgtaaatccacatggcaaagccaaggtgaactgcaccctgagaacacttcttccaacaaccactgtcacatcaacagatccgtgctctgtcttcatgtccctcttttctgtacgtctccctccttctactattgactttacatatctatctgaccctgtactgctccaagaggccctcctacattgagctattcaaatagcagattccatcattagccttacctttcaatctggactttcgggcacatttagttcttgccttttggaccctcatcatgacctctgagttccaggttgagtcgtctttcctttgagtcaccttatccaccacttggagcttctcttggatgccatgcccaggtgaggctgcccctggaccaaatagacttgtgaatagtttagtgagctcccttctcatgttcccagcccctaccctttcaggagttatcttgccatttctctataattctctcttttcttgtgtgtatctttcttccccccagactcataatacttccttctatttctctttttcaagtcctcattttgtttagtaattacaggtgtatcaattagaatgcaagctccactagtgtagggatttgtgtctgtcttgctcactgctgagttcccaggacctaggacagatacctggcccacaccttacactccactgctgaatgaatgtttaataggcactaaagttttgaaaatattaaatgtatttttctttttaatttgtttttatttcaatagcttttggggtacaagtggtttttggttacatggatgaattatataatggcaaaatctgagactttagtgcactcttcgtctgagtagtgtacattgtacccaatacataggtttttactccccctcctccgtccctctcctttctgagtctccataatccgttatatcactctgtatgcctttgagtactaatatcttagctcccacctataagtgagaacatacagtatttggttttccattccatcacctcacttagaataatggcctccagctccatttaagttgctgcaaaagacattatttcattctttttttatggctgagtaatacaccatggtgtatatatactacattttctttacacattcattggtcaatgggcactgaggttggttccctatctttacaattgtgaattatgcagcaataaacatgtgtgtaggtgtcttcttgatataatgacttattttcctttgggttgatacctagtagtggggttgctggatggaatggtagatctacttttagttatttaagaaatctccatactgttttccatagaggttgtactaatttgcactcccaccagcagtgtataaacattcccttttcaccacgtccatgttaacatctatttttttttgacttcttaataatggccattcttgcaggagtaaggtggtatctcattgtggttttaatcttcatttccctgatgattagtgatgttgagcattttttcagatgtttcttggccatttgaatatcttcttttgaaatatgtctattaatgtcatttgcccactttttgtgggatttttttctataatgtttgagtttcttgtagacgctggatattaattcttcattggatgcataatttgcaaatattttctcccattctgtgggttgtctgtttactctgatgtttatttcctttgctacgaagaagcgtttcagtttaattaagtcccatttatttatttttgtttttgttgcatttgcttttggggtctcagtcatgaattctttgcctaggccaatgtccagaagagtttttcctaggttttcttatagaatttttctggtttcaggtcttaggtttaaatttttgatccatcttgagttaatttttgtataaggtgggaaatagggatccagttttattcttttacatgtggctaaccagttttcccagcaccatttattaaatatggtgtcatttccccaatttatgtttttgtatgctttgtcaaagatcagttggttttaagtatttggctttatttctgagttctctattctgttccattggtcgatgtatctacttttataacagtatcatgctgttttggtaactatagccttgtagtataattttaagtctggtaatgtgatgcctccagatttgttctttttgcttaggattgctttggctttgcaggctcttttttggttccatatgaattttaagattttttttccagttctgtgaaaaatgatgttgatatttgataagaattgcattcaatctgtagattgccttgggcagtgtgatcattttcatattgattcttccaatccatgaacatgggatgtgtttctatatgtttgtgtcatctatgatttctttcagcagtgttttgtagttctccctgtagaaatctttcatctccttggataagtatattcctaggtattttattttattttgttgaagttgttttaaaagggattgagttcttgctttgattctcagcttggtcactgtaggtgtatagcagtgctaatttgtgtacatttgattttgtaacctgagactttactggattcatttatcaaatctaggagtcttctgaaggagtctttagggttttctaggtatatgatcatataatcagggaacagtgatactttgatttcttttccaatttggatgtcatttatttctttctcttttctgattgttctggctaggacttctagtactatgttgaatagaagtggtgaaagtgggcatccttgtcttattccagttctccaggggaatgcattagattttttcccatttagtatcacattggctgtgggtttgtcatatatgacttttataactttgaggtaagccccttctatgcctagtttgttgaggatctttatctaaagggatgctggattttatcaaatgttttttctgcatctattgaaatgatctatggtttttaattctgtttttgtgatgtaccacattattgacttgcatgtgttaaaccatccctaaatccctgggattaaatccacttgatcatggtgtattatatttttgatgggctgctggattcaatctcactgtttgttattggtctgttcatggtttctatttattcccaatttaatctaggaggggtgtatgtctccaggaatttatttatttcctctagatttttctagtttttgtgcatagaggtgttcatagtagtcctgaatgatcttttgtatttctgtggtgtcagttgtaatgtctccagtttcatttctagttgagtttatttgaaacttctctctttttttttggttactctggctaatgttctatcaattttgtttatcttttcaaagaaccagctttttgtttaattgatcttttttattttttgtttcaattttatttcattcttctctcatctttctttttttctgctagctttgggtttctctagttccttgaggcatgacattaggttgtcaatttgtgatctttcagactttttgatgtaggcatttagcgctatgaactttcctcttaaaagcactgcttttgctgtatcctagaagttttgataatttatgtcactgttaccattcatttcaaataattttctaatttccgtcttaatttcagtgttaacccataaatcattcaggagcagattatttaatttccatttatttgttatggttttgaaagttccttttggagttgatttctagttttattccactgtgatctgaggagatacttaatataatttcaatttttttcttctaaaaaaccccccaaaatgggacacacgtgcagaacatgcaggtttcttacataggtatgcatgtgccatggtggcttgctgcacctattgacccatcctctaagttccctcccctcaccacccacaccccaacaggccctggtgtgtgttgttcccctctctgtgtccatgtgttctcaatgatcaactcccacttatgagtgagaacatgcggtgtttggttttctgttcctgtgttactttgctgaggatgatgggttccagcttcatccatgtacctgcaaaggacatgatcttattactttttatggctgcatagtgttccatgatgtatatgtaccacatattctttatccagtctaaatgctggattctttatccagcatttgggttggttccacgtctttgctatggtaaatactgctgcgataaacatacatgtgcatgtgtctttacagtagaatgatttatattcctttggatatatacccagtaatgggattgctgtgtcaaatggtatttctggttctacatccttgaggaatcaccacactgtcttccacaatggttgaactaatttacactcccaccaacagtgtaaaagtattcctatttctccacagcctcaccagcatctattgttttctgacttcttaataattgtcattctgactggcatgagatggtctctcattgcagttttgatttgcaattctctgatgatcagtgatgttgagcgtttttccatatgtttgttggctacgtaaatttttttttttttgagaagtgtctgttcatatcctttgcccattttttgatggagttgtttgtttttttcttgtaaatatgtttaagttccttgtaaattctggatattaaacctttgtcagatgggtggattgcaaaatttttctcccattctgtaggttgcctgttcactctatttctagtttcttttgctgtgctgtagctgtttagtttaattaattcccatttgtcaatcttggcttttgttgtaatagcttttggcttttttatcatgaagactttgcccatgcctatgtcttgaatgatattgcttcagttttcttctagggtttttatggttttgggttttacatttaagtctttaatccatcttcagttattttttgtataagatgtgaggaaggggtccagtttcagttttctgcatatggatagccagttttcctggcaccatttattaaatggggaatccttttgccattgcttgtttttgtcaggtttgttgaagaacagatggttgtagatgtgtcgtgttatttctgaggtctctgttctgctccatggtctatatgtctgttttggtaccagtaccgtgctgttttggttactgtagccttgtcgtattgttcaaagtcaggtagtgggatgcatcccgttttatcctttttgcttaggattgtcctagctatatgggatcttcttcgattccatatgaaatttaaaatagtttttttttctaattctgtgaagaatgtagagacaatataccagaatctctgggacacagctaaagcagtgttaagaggaaaacttgtagcactaaatgcccacatcaggaagctagaaagatctcaaatggacaccctaacatcacaattaaaagagctagagaggcaagagcaagctaatccaaaagctagcagaagacaagaaataagtaagatcagagaaaaattgaaggagatagagacacaaaaaaccctcaaaaaatcaatgaatccaggagctggttttttgaaaaaattaacaaaatagatcactagccatattaataaagaagagagagaagaatcaaatagacagaataaaaatgataagggggaatatcatcactgatcccacagaaatacaaactaccatcagagaatactataaacacctctacacaaatgaactagaaaatctagaagaaatggataaattcctggacacatacaccctatcaagactaaaccaggaagaagttgaatccctgaatagaccaataacaagctctgaaattgaggcagtaattaatagcctaccaacaacacaaaacccaggaccagatggattcacagctgattctaccagaaatacaaagaggagctggtaccattacttctgaaactattccaaacaattgaaaaggagggaactcctccttaactcattttatgaagccagcatcatcctgataccaaaactgggaagagacacaacaaaaaaaaagaaaatttcaggccaatatccctgatgaacatcaatacgaaaatcctcaataaaataatggcaagccaaatccagcagcacatcaaaaaacttattcaccatgatcaagtcggtttcatctctgagatgcaaggttggttcaacatacacaaatcaataagcataatccatcacataaacagaaccaagacaaaaaccacatgattatcttgatagatgcagaaaaggcctttgataaaattctacatcccttcatgttaaaaactctcaataaactaggtattgatggaacatatctcaaaataataagagctatttatgacaaacccacagccaatatcatataaaatgggcaaaagctggaagcattccctttgaaaaccagtacaagacaaggatgccctctctcaccattcctattcaacatagtattagaagttctggccagcacaatcaggcaagagaaagaaataaagcgtattcaaataggaagagaggaagtcaagttgtttctgtttgcagatgacatgattatatacttagaaaaccccatcatctcagcccaaaaacttctcgaactgataagcaacttcaacaaagtctcaggatacaaaatcaatgtgcaaaaatcacaagtatgcctttacaccaacaataggcaagcagagagccaaatcatgatgaactaccattcacaatcactacaaagagaataaaatacctaggaatacagctaacagaggatgggaaggacctcttcaaggagaactacaaaccactcctcaaggaaataagagaggacacaaatggaaaaacattccatcttcatggataagaagaatcaatatcttggaaatggccatactgcccaaagtaatttatagattcaatgttattcccatcaaactataatttcaatttataaaaatttattgagacttgttttgtggctatcatatggtctatcttggagaatgttccatgtgctgatgagaagaatgtaatcttctgtaaatatctattaggtccatttgttctagagtgtagtttacatctattgtttcttttttgactttctgtctcaatgatctctctggtgctgacagtggaatactgaagttccccactattattgtgttgttgtcttatctcttttcttaggtctagtagtaaatgtcttatgaatctgggagctccagtgttagctacatctaaatttaggactgtaatatcttcctgttagattgatccttttatcattatataatgaccttctttgcctttttttactgttgttgctttaaagtctgttttatctgatatgagaaaagctactcctgtttacttttggtttccatttgcatggaatatcttttttcacccttataccttgaatttatatgggtccttgtgtgttaagtgagtctcttgaagatagcagatatttggtttgtgattttgtatccattctgccaatctgtatcttttaagtggagcatttaggcccatttatgttgaacattaatatcaagatgtgaggtactgtttcagtcatcatgttaattgttacctacatacgttgttttcttcattgtgttattgttttatagaccttgtgagttttatgctttcaagagtttgtattctggtgcatatcaatctttcgtttcaagagttagaactccttttggcatttcttataaagctggtctggtagtgacaaattccctcagcatttgtttgtctaaaaatgactttatttctccttcattcataaaacttagctttgccagatacaaaattcttggctgagagttattctgtttaaggagactaaagataagactccaatcccttccagcttgtaaggtttctgctgaggaatcatgtatttttcatccttgcaaatagtaaagatttccctgactattacatcaataggtttcagggggagggcagatgcttgctagaattgagaagccactgctcagttggggccattttggcaagcttagacaaaatcttgaagcacagtatttgttgggagcaaagaggaatttataaattccaaaaattacctgtacctatcaaaagaaaactttggaggtctgaatgtcaagttttcctataagtcattggtagtgaacactcagcaaatgacagagagtatgtttcctccagcctagggaggcagtggggtggggaactaggaagaagaggccagggaggggaagtgcaagcaggcagatatgactttccttctaggccaaaccccaagattgaggcatgctgggaacaagcagaaaaattagagggctttccaaagcagtgagcctcatgtcctaattcatgtttgggagctgggacaagatctcttcccaggctggctcccataaaggtacagaatccaagagaatccccactgaccggcatatcttaggccctttgtgaataattttgagtaaaagaataaagaaaaaggggccaggtgcaggggctcacacctgtatccgagaactttgggaggctagggcaagaggatcacttgaggccaggatttcaagaccagcctggacaacatagcaagacctggtctatacaaaaaatttacaaaataaattaaaaaaagaaaaagggaaaaagaaaggaacagaaagggaagagggagagaatacagaggagaaaaagaaaagtgggatgaagcagaggaaccagaaaaatgcagcttttttgtttcttattctgcaagtaacacagtttgtgcactggagtagacacatgcatgcaggcatgcaagcaagcatgggttgactgaggtagttctgaacactctatgactccaaatctaatccagtttggaactgaaagtctgaatcctgcttggggatttaggtttcttgtgtctattcttctgggctctgaccctagacaggaaacaattctaatctcaaaattgtctgatgcctcatgtccacctcaaccccattccctccctatgataagagaaaagaagactaggtataaaccaagttggtgttaggtttgctcttcctttgttggggagtctactgatggggtggcctaggggacaaggttggggctggctgtgctccaggcacatgtggctggagaggaggtcatgccagctggtcaggtgaggggcctgataaacaccaagagagtaacaatttcacttttcttccttatgtcttgggcattttttttttctgttttctttttgaacttggccatattcttttctccttttttctaaaaaagaaaaaacccacatcttttatggctacaaatattgatctacaaacctgcaatgtcattacttttttaagtaatttttttcctgttttccctgactttgagaaggcaagaaaaccatgtgacctatgtgaaaaaagtactccattttagctggaaattgaattaggggattgaataaagatggatcaggaatatactagaggactaacatttaatatatgtcatttaaaaagttttttggggacagagtcttgttctgttatgcaggctggagtgcagtggcataatctcagctcactgcaatctccacatcctgggtccaagtgattatcgcacctcagcctcctgagtagctggcataacaggtatgcacccccaggctaacttttgcatttttagtagagacggggtttcaccatgttggccaggctggtcttgaactcctggactcaagtgaacctcctgcctcagcctcccaaggtgctgggattacaggcatgagccggcatgccttattaattttaaaattaataagcagtttttcaagactagacaaagattgttataaaccatggatattaaaaggtttcctagccaaaattcagggccagaaattacacagttatgagataaacagatttgaatgtttaaaaaattaaaaatatacagaaggagcaggactgaaaaaaactgttcacagttcaaaaaacaccccgacactattaaagcaaaaacaaaatttaaatatacatagcatatagaaggttaatatccttattagataaagcaaaagatgaatggtaatctaggaaaataagcaaaaaatataagttaaaaatgctcaaggaggaaatgaagatgacaaatttatttagaaatcatctctatattactactaatcaaagaaactcattgtttggatgttaaggatacctaaacatttaaaaagttttattacatccagcattgaggatgtaggaaatgaatactcatatattgttaaagggaatataaatcattatgttttctggacagcaaattggtaacatgtataattaagatatagattttaaccaagtaagcttgtgtttaagaatcaattctaaggaaattattggacaagtgtgcaaagatacaaatacacacaaacctgatttctattttcatataaaaataagaaataaactgtccactagtaggtgattatttaaacaaattgcggtgaatcatacgtaacgtgccatgcagttaaaaaaatagataacattgatacagagatgatacacaatgaaaaaagtgatttatagaatagactatatagtatgagcttatatataaaaagaaaaatgtatgcatacttatacaaaaataaagtgggggaagcagattaaatagatgtttaactttatgatttataattttcttttttttaaaattttattattatattttaagttttagggtacatgtgcacaatgtgcaggtttgttacatatgtatacatgtgccatgttggtatgctgcacccattaactcgtcatttagcattaggtatatctcctaatgctatccctccctcctccccgcaccccacaacagtccccagagtgtgatgttccccttcctgtgtccatgtgctctcattgttcaattcccacctatgagtgagaacatgcagtgtttggttttttgtccttgcaatagtttgcagagaatgatggtttccagtttcatccatgtccctacaaaggacatgaactcatcattttttatggctgcatagtattccatggtgtatatatgccacattttcttaatccagtctatcgttgttggacatttgggttggttccaagtctttgctattgtgaatagtgccacaataaacatacgtgtgcatgtgtctttatagcagcatgatttataatcctttgggtatatacccggtaatgggatggctgggtcaaatggtatttctagtcccagatccctgaggaatcaccacaccgatttccacaatggttgaactagtgtacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatatcctgaatggtattgcttaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatataattttctttttctttgttttgagacagggtcttactacattgtcaagctggtttcaaactcctgggctcaagcaattctcccatgttggcctcccaaagtgctgggattacaggtgtgagctaccatgcctagcctgatttacaattttctacactgaagattttattaggaatattgtatcacacaagacagggtaggctgtgctgcagtaacaaatgaaaccaaattttggtggtttaacattgaaaagtgtatttctctatcacatgaagttctctgtaggacaataggaccctctgtaggactggaagtcctctgtagggccctccagggctgctgtcctctatgtggtaggtcatgctgctttggccttctggcgcctccctcttccacacacttccacaggcgggaaaagaatgtggagagctgcaatgggctcttacatgctgtgacccagaagtgacacccatctctctggcttatttgccagagctagtatagcagagctgcctcctgcaagggggatgataatggagctttccaagtgtctgggaaggggagaagaattggaactagaggagggcagtcataatgcccaccataaacatgggcagggtgagcactgctagttgttcctctttctctggtctccctttttctttagtaataaagcccctgattctgagccccttattcttatagattaaagattacatttcccagcctcctttgaagtcaggtgtggccgtgcaaccagtcctggcaataaaatgatagaatttttttttcttttttgagatggagtcttgctctgttgcccaggctggagtgcagtggcatgatcttggctcactgcaacctctgcctcctgggttcaagcaattctcctgtctcagcctcctgagtagctgggattacaggtgcacaccaccaggctcagctaattttttttgtatttttagcagagatggggtttcaccatgttggccagactggtcttgaacttccaacctgaagtgatccacccacctcggcctcccaatagcaaattattaatgatagcaaattactatctgtgaccggaagcatttagagtccttcagtggaggaggtgtgcccttctttgactttgccattttctctttagctggaacatagacatgctggctggacctcaataaaggggatgccacatgctgaggatgatggagccacatgctgaggatgatggagcaacaagcaagaataagcccaggaccctacagtgtatgacaccagctcttgaccacctacctctcttgctttagctactattattattattattattatttttttttttttttagtggggtgaggtttgctgtcacacacagcaacataatcctctttttttttttttttttttttgagacagagtctcactctgtcacctaggctagagtgtagtggtgtgatcttggctcgctgcaacctctgcctcctgggttcaagcgattctccttcctcagcctcccatgtagctgggattacaggcgcccaccaccacgcctggctagtttttgtatttttagtagagacagggtttcatcatgctggccaggctggtctcgaactcctggcctcaagtgattcacctacctcagcttcccaaagtgctgggattataggcatgagccactgtgctgggccagcaacataatcctaatggtgacagcacactgcttttagaaaagtccaggaacttttctatgttgaaaaaaagtgaaatcatgattttaaaaagcataacgctttttctggcttggatgtcttttatggcctagaatggcataataacagtaaggtaacatcaatccacaccacagagaccaaatagtttcttcttcacacttatgctctgccctgggagattttcccagagagagtttatttccattatccataggatcttggaagtaatgagaaagtaatttttgaataagcagttttctattttgggcaatagtgaattgacaaaggtttgacagtattctttctgccccttcctttctatggagaacgatggctcctgaaaagagttcctggggaccaggttgttaacccggtggcagccagcccttacccaggggatcctgaaaaaaatccattaatcctttccatatcttaatttcctcatctgctaaattggaataggtcattcaatcttctccaagggtggttgtgaaaataaaataaaattatccatgagaaaagttgaaatactactagataagccagtgcaatataggagaaactgttaaaatgataatttagattttaaggtggtaaaatttaatccatttttcctgacaataattagatatttgttgtttgaaaatcacatttgtcatgtgagagttctgtgatttttgtgacaatgaccatatcaccagcaaacagacgaatatctagctgttttttcccctctaaggatagtgttatcaacttactccagaaatgtgaataatggtagcgatagtgaggggtgaattaacatgcacaattttaccagcacatgcccacaactccaccagttgtacatgctcagtcatagtgtcacatgtgtgttttaatgagtttttcgcttctcaattttctcagaaaggccacatgagaaatatggagattggaattctaggaaaaagcttgatccatgggttggatcaagctgcactttcgacaagctgtactttcagtatagtaccatgaatatacttaggacactcattctcagtaatggtgatattgctgccagtagtggaaaaactcattcttgagtgctgagaaaaatcttatatagtgcagatatacatacatacatatggacacattacataaaatggacatatatttgtagtagtaaatatcatgggaagggtcttgattaagaaaaaaaaatccagaagggctctctagcacagtaataatgaaaaaaaaaagttaagaaatattgcctcagtgtaagacagctctgaatttagattcctggtgactgtactctgagaccagcaatctccaagttttaccttgtgtgacccttcgtggtgtactaggcgtcttctgggacctctttccttcattcatttctgaagtgccatcaatgatctctggaaaatgaaagatcttagtaaatgccccttgggaaacaccatggagaatctcccagagacccaggaaggcccttgcacactctgaagttgagtcttggaggctccaggtcttaccctcctaacaatgcatctaccaagagatttggtgctgctcatgacactgtgcctgtctgccactcaggggaggagcagaccgcagttggttagcagtggttactctaccaatggagacatccacagtggggtgcagccatctgaaccccttggccagagtctctcaaagtaaggtctgtgagcccctagggggtctgtcaaaccgtttcagaaaatttgcaaggtcaaattgttttcataatatgatgttatttgcctttttcactatttcaacctttgtacagattgagcaagagcaatggcagataaaactgctggtgccttaagacacatcaaagcagtgtccccaaatctcagcaggaatcactgcatcctttattgccacctactcactgtaccaaaaaaaataaaaataaaagcaagattcacttgagaatgtttttggtgagccagtaaaaattattaattttattaaatttctacccttgagtacatatctgacatcttaatattctatgtgaaaaactgaagagcacatataaagcacttctattgcatcctgaagtaccacagtggcctcaagaaaacacttgtgtgattgagatacaagctcactgtataattccaaatgtatattttccaaacagctgtactattataaaatcttgcattagtagaaggtccattcaaaatgcaaggtggattaatgtattttattgtaacagagtatgaagttaattgatatggtttcaaattttacattacaactaatatttaagaaactatcacttgttgagtgttggtgtagtattaaaggtgaatatccacagatatctcaaaagactgttaaattacctcacccttttaaactagatatctgtgtaaggccagattttctttctatccttcaatcaaagcaacatatcacaactgaatgcagaaacagttgtaggaatccagctgtctttttataaagctcactcacaatcaaagagatttgcacaaacataaaatgatgtcactcttttcactaattttttttgttttagaaaatatatttacttttcataaaataatgctatttatgttaacaggcaattggtttattattgttacttttacatgaattaatattttaaaattattagttttaatttctaatcaggtacatgtagatagacataaacaacataaacagaagctccttagggtcctcaataatttttgagagcataaaggagtcctgagaccaaaaaatttgagagctgctgccccaggccacagctgtccctgtgaacacgtctgtttcttccacaaaacttttcagatgcaacagatgcttgctctctttgttcctcttgttataccccatcctcattctctgtactttttccttttactattgactttacatatctacttaactctgtacctgcttcaggagagaccctcccacactgagccattcaaatggcagattccatcatcagccttaccctctgatctcgactttcgggcacattcagttctcgccttttgggcccttgtctctaccgtggagttacaagttgagtcatctttcttttgaggaacctgatccacccttttgagcttcttttggattccgtgtctagatgaggctgtccctggaccaaataatgacttgttaatagtttaaattggggtcttcagtgagcctcctacagtcccaatcagtgacttcccttctcatgcccctaactcccactctttcagatctctgtacccctgtacctcacttttctcctcctacttctctataattatatccttcttcttatgtgtacctttctttgcctccccaaattaccatctgctttcactcctggtatgacctgttgcaatcaactagataaagctggggaaatcctagagcttatttcctgattttcgtttgtgtcggcctgcaccacgaggtggccacacagtctcgtctaggtggagaggaggtgtcttataaagcacctctccaggttcccccacggcctgtgtgtggtacaagagatttccaaaagtttctaggtgccttcagtgggcaaagtgcaaggtattaaaaaaactgagagggaaggaccctgccaagaaggcggctaccatgagggagagatggaaggtgaggctgagacccagaggaggtgcaatgccagagggtgcagaggtgagtttgcttcattgtggaaaaagaacacaattttcaccggctgttgactttagaagctgatcccacaggatgaccgctgtcctgttgaacaagaacgtttctctgcaggttagaaaggacacagagtgtgcagccatgcttcccgcacgcaagtgcggtgatatccgcaggccacttccggaggaaaaggcatgggtgaacccttaagagggggcggaagcgaaagcccggtgggacccagggctggcgggaagttcaaacacggaagttactgaatatttatccagaagaggtggggcagcctgatagagcctaaaacttgcctttcattgccaagtttagggttttttttctgcataactaaaggagggtttcggagatgagaacacttacagaaaatatgagagtgtggtatgtatattttcagcactactatatatatttttctcttacaattttgaaacatctttttatgtgttttgttttgtaaaaaataaagctgattaattaaatgtaaaataatatgactcttaaaaatatctctgttgggctgcgggcagggaggaatggggagttgtttaatgggtacagggttttagttttacaagataaaagagtcctggagatggatggtggtgatggttgcacaacattgtgaatgtattttaataccattgagctatgcacctaaaaatggttgagatgataaattttatgtcatgtgtattttacccaggtaaaaaattggaaaattggaaaaaagaaaattaaaagcacatcatctgtcacatttaaaataaaacgattcttttaaaaaacctgaaaaatttcatttaaatacaatatgaagaaaggcaaatctggaagggactggagtctactcctttcggtagcttggcagagagatgtcaaaaggtcagagttacctcaacagaactgaccatctgacactgactccagaggtttcccctctctaacaaagtcacttctctgaccagggagtgttcataattgtatagttgcatagacattccctgtctccctaatcctataacgtgtagagcattgtgagagtgggcatctcactactgggctgctggccacggggtgtgcagagtacgtatgtctgccctaaatatgggataataagaatttggagaattgtattggaaatttccctccaataacctttagtttgtatctacaccacgtggtgcccataatgtctatgaccccttttcataacacaataatgaattcataaactatcctttgtcagatcattattcaaattttgggttacagaaagtatggtttctttcatttttttttcattaaaaaaaaattaatagctaatttgtgccaggacattaccatctagcctagaagagacacattatgtaagtaattacaatagagtatttggaaccttccaaaagagccagtgctgggtgctgtagaaattatgggaccagcttggctaatttaggggtcagagtatgtattcctgagatagacataagtcaacacgactgatgaaaaggagataactaaacatttatggggagtagtgtaggttcagaatatagcatccaaagagaatagcacatgccaaggatcaaaggggagagaaatgaaatgggaagaaatgaaagttcagagtggttgactggagttttgagtggaaagagatatattaatagttggagggtaaggcatgagttagactggatagaacttaacaatcacattaaggacagtgaacattaccctaagggcaataggaggccatggacaagatttaagcatggaaataaactaattagattttaatgtagaaaagaagagggtgaaccaatagaccttgtcaatatgctaatagagttcagttagtcacggatgactaaggtttttgcttggcacctgggtagattaagttcctcatttcaagttaaactacaacaggctcccaagggcctgtgaaaccctacataatctgattcttgtttactttttcacttcctaccaccttctttcttcatcatcaccaacaacactggtctttcctctctgcctcaggttctttgcacttttgagtccctctgcctggaccatccaatccaaagtgactcccaccccaacctgcaagtcactattgtaatcctatccattattttctttcatcctgtcatcagtacttgaaattatcttgtttatgtgctttctagtttatattctttccttcccccagccaggatgtaacctccatgagctttcccctttgttttttgcttactttcttactttctctctttaaaaaaaaaatctgtcttcagctttcagaatgggtatatacagttagtgctcactgcatatttgttggaataaatgtctgaatggtacttagaagactaggtttttggtaaagaaggtgaagttaatttcaggcatattgagactgtagtgtcaatgggagacttgcaaacaaagacgcccagtgtgcagctggctatgtgtttcttgaagacaaacctgagttgaagacgtagagttgggagccatcagtataaaggtggtaattgaagttgtgagagtgattgacaaagctcagaagtgtgagttgaataatctgactagtttacaatgaaccaaggaggcccatagagaatacacataacatggtgagagggcattgactaataagtagaatgggggagaaagcagcttgtctctccttcctgcccaggaaggtcacttacttttcttagaatggaatcatttctgttaagtgtcttaaaaggacaccagccctgtgattttggacactgggatcatactaatgataaactaagtcagggaagaggagctttaagccactggcttaggctgccatctattgctctgtttccttttacagctagagttgtctacatatgttatcacctcccattcattatccttcccacacaactggctcctgcctccatcaccaaaatttttcttaaattttccagtgattctttgtgaccaaactcaaggccctcttctctgaatttatcttagtctctcagtatagtcaaccattccctcttggcttgctaacatgttctttcttggtgctcctctgtcttcactggtctcgttccctcagtctgtcttgctagattcctcttccactgggattacttagagcagggctaggtctgtggttctcttttcttctcccatagatcagaatacctttattttattgataactcatatatatacatatatctggtccagatattatatattatctggtccagattttatatatatatatatatatatatatatatatatatatatatatggaccacactttttcagtgagtgccaaattgccatattgtggggaatataacttcctgatttctcagtgttcctgtaaaaagccctagtcccggagacacagaaatgtatgcaatataaatataggaaatacttgctttcacttccccagaaacattttcctcttcccacaccatgagaattagagctatagctatttttctagttaattactctgatctagagggagaatagaacctctcttatctcctgagatggccaaatgggttcacccaggactagcttcctaggttaaatcctaaagtaccaggaaaactggagtggtctttccctaggtatttatatatcacaaggggtaaagcccagaacttggagacatctttaggttgtaaaagccagcaacacctagagtttctctggcctttggaaagatgcatttaaattccaaaggttaggatggagagctttggaacgaggatcttttccattttatctcaaagcagcaaagttttttcttttcctttcaggaggaaaggatgatggctatccctctcatgtatctaaacagaaaaatccatcattctacatcccttatacatgagttgtagtctattttgaatagaaagattccattagctctcttagcattgcctttgggtttgtgtatgggagacagacgctgcaatattgctctggctgataagctggttgtgaatatcagtaaagaattattttccctgaccagataccttgtgttcctgcagcactcatatatataaggagataccaatgcaagtggagtaacatcttagaccctttacagttcttgacaaaacacacatctatacacagctgcatagatggctagcagaaacctctaaaggaacaggtcaataattgaactctaagagttatcccccaatatatttgcatcttccctcagcaatgggcattaccacttacttgttcaagccagaaattgaagagtgggccttgatttttctctttctcatctgtagctaataatatgtcaaatcctgtcaacaatacctgcaaaactgatcttgaattggcactcttctctgcatctccactgtcagatctgaatccaagccaccaagaactctcatggcatctgccccaaaatggctgccctgcctccattctttcccagctccaactcattctttacaccgtagcaaaattgagcttacattgtgtcacttcactgactaaatctcttcaatggcttcccattgcatttagaataaaattcaaccctccacagcttgacctacaagccctgcatgagctgtttccagcctccagcttcctcttgtactctcatcttacctcctgggaggctttttttcttatgtctcctttttggagttgaccagatacatctttttcttttctttcctaaaaagaaaggataatgttttatagttacaaacattgatctcccaatcttgtatgtcaatgatattcagcttttacttttggtcttcaaaccacattgctagaagttcattggtgaccttaggtgatggtacttcagggagtaataggggaagaaggactctaaaatgacagaggaaaaggagaaacgaagaaatagagacagggagtttaggtagctcatttctagaagtttggttgtgaaatgaaggagagagatatggaagtagttgaagtgagatgagaatcaagaaaaagcattttttaatgagctgtgatacatgtaatgcagattcttgtgtgagacatactgctttaatgaatacttgagagagaagggatcatggatactataagatgaggcagaaggattgtcttagaagagaaggagggaactcggagaggagggagacagatgtagttagggtttgtaggactagcagcacaaataaggggattctcatctgatatctccttatggtgcaggagggaaagtcactgattgagcaaaaagcaggaggtgagggggtcagaggtttgaaaaatagggcttgaggtttgaaaggattattgcaggaagtagcattgtcacacagtaaggagagatgatttgtgctggaaccatgaagaccagtgagtgcactctgccctgctgtggaactctctccagcactgctggctttcagatgcagtgtacaggaagtaggtaagtagggtcttccaagacttgccagagagttctaggaaaaggcagagaggaaaggcaggtttaagataatggcaatagattactgaaatgatgaatcttggactgtgagttagtgtcaatgttaaaaagctgggaagcaaagaaaagcagatgatggcttggaaggaggaaaggccagtggactggtgatccaaatgaggttgaaggacaacttcagaggaaacaacaaataaataagcacagaaaaatatatttttgattctttttcttttgttaggattgggctgggaaagagtgatcagaggttgaatgatagctataaaaggagaaaagctcaaggacaggtatcaaaaaaggaattctgaaattaactgttgggaaatcgagccaggtttgaatgacgatagggtctatagcttgcctttgggtatgggaggccaagaattggtggaggaaaaagtcatggaaaatgagaagatgaaggatttgaggggccagagtattggataacagagttgtctgttatccgtgtgtaccctgaaggcatctaggatgatgctgggacttgaaatgacagaaaagcagcttttgaaaggattattggggaaattattggatgatattgatgatgagtgagtgaacattttaattgaatggttaagactcaaaggagaggatcagggaggaaggggctggatggggccagtaggcagcaaaggacagacatctaacctgtctctcaccatgaggtgtgagtgatggatggcagagaatgcctagccatgtcttaagaggaagtgggttcctctctggggaaccaactttcagttaaagagggaagtgcaattaacactctaagaagttgtgaatataggagattgattttttcagaacaggcaattccaatggcatatttcaatacccccaaatgccttctggtttcctgataattttcataaaggcctttttggaagatgcagcaaatggaaactgcagaaacgaactgtgtgtggcatcaggactgtggtcacatagtggtgctcttgacaagatacagtcagaaaaacagaaagcaactctgaattcacccttctgacctctacagaagaaaggcttttcttacctttcttgtctgaaggtgtgctggacacctcctggggctcttctgggtcatttggttctggagaattatctcttatctctgacaaaagaaatataagtcatttcagagctcagatccagtgaagagaaagtgctgagggaagtcaatgcaagaactagaaaagtagaaagtacatgcagcccagggccgggaatctgcttgccctaagaattccctggctctgtcttgatttttgccaacttgtggttattgttacctgtgcgaccatcacagggaactagggcacaactgccccacagcagaggctcagtctgatccttttagagagattatcttatggatggaagagaagtgagtgaagaaggtgcaatgaatggaaattgcaggaataaactgtgctgggtatcatgactatagtcacatggtttctgctcccagcagcccctgctcaaggaatgaagctgagagcggaaagtggtgatattgaaatctgatgtccatgatgaaggggaatgtctttgctgtatgaaaaatacatcttattgctttgacgtctatgtgtggatattctttaactgctctatctgtggttattttacttggagaaatagtggagaaggctaaatgccttatatatttctgtatataaggattgtttgaagaaagcaggagctagcctgtgcttgctagcacctgttaacagcaaagacatataaagctctgctagtttttgctgcacaaagaaagacagagaacttgaagccataacaaataaaggctcatctcacatgaagctgtcacctttttctttacacactgcattgagattggtctcaaatgctggcctgcttaggaataggtgactgaggcaggtggcaagcagtcattagatctttggaataatttattacctttcaagttatattcataatatcaactcttaaactccaagtgatatagaaatgaccagggttgaaagtgaaaattccccacagtcaggtgggggcttggaaggaggaccatccatgtctgctgcagcaattcactattagggccacacagtgtttttgttcatttgctttgcattttgacagagccgttttgagcactactttattgaagtggcctcagaagagtggctctgtcaaacagtccagcctgactcagttcccttgctttcccctggggttcctgccacaaccctttgtggcaggtgaatgtttccctttcaggcgctttgtggcatttggagtccaaacctacaggcactggtggggctctgtccatcatcatccgtggccctatccaagtctaccttttccagacttgcctcctttgccctcccccagggactctgtatccattcagaggtcgggtctcctgcctgttcaagctcccaagtgctgggtgaactggaagctgggccaagattgctgagaggcaggaggagagccccctctctagaagatccgaatggcttttcctcttagtaaacacagaaacaaaggcaagcttttaggttgaccaaaccaagattacctggcatagagcccaagggagagtggggcatctcttgagggtcttctttatctcttatttgggggatcaggttgtcactggccactgaatggaggaagaaaaagttttagatctcaggaacagcaagcagggaccagaatgaggagaaaagagaatgctctattccaacaagtaaaaatgacggggtaacagcaaccaaggcctgggaaaggatggcatagagtgggaaagtaagcaaccattcactctcaattagccacttgttcttccattgctgttagcttcctgattatgttaacctttttggatggtaggtattagaggagtggatgcaatattatttggatcgaagaggacccctcttctcagtactggagagctcagaatccatggtatcatttttgacaatgcccaatatcataccattcttacgtttaatgtaatcaaactccattatgatgatggtttggggaggacaagtgatacaatttgagaagctaaatattaggtctagcagacctttaaacattttatcatcttttctagtaattttgataacattgttcttagaatccaaaccatataaaaatgaagaatgttgaaactctaaggcccccataatcaggtgggggtgaggaatcagctaagggtcactagtgtgagtgttacgcaggttacttgtcaattcagaatggtgttttggttgttggtttgttttgcattgctgcgttggtgaattggccccttctgtttcttttcctttgtattgctcagttctttttcccagggttcccaccatagcctcttggttggcagacgcatgttctcccttcacagtcaccttgagctaagcggtatcagccccagtcagtgttaccttgcacagtgctagtgaggaggctgggcatctcttctgagtcttcttccgcattcattttggatgttaacttgtcattggtcactgaaggaggaaaggaaattattacagattgcagggactggatgtcagggagaagagtgaatgttaaaagtgcctggggcagatagagcatcaaggcacaagggcagagggttggaatgtcccgggagtgggaagcaggtgttctggactctaggtcttacccaccccccggcagtgctcataatccctcttgaaaagggttgtgtttgggtagatgggtgcaagagaagaactaggacaataaaagtcaagatgctgggattggcggcaacatggcacaggcaccttaggctgaggatatacaggtgttggatgggatctgtttctcacctgaagtgcttcttccttcctggatgagtgcagggagaggcaggacagggtcagatgggctgggcgactcactcaggatctcatcgctttgctgggaggatgttccaggctcactgactcttggcgcacagggtgaacagcttggttgagggggttgtggtgggggcagcgccagtggggtatggagggagcttccttctgctaggccagttggggcttcaagtaggattggtgtgtctctgctctgccattcataggaagcaccaactgggattggtgaagggacacacatcagtaccctggagactcagaattacttggggaaggggatttcttaatacatgccttccaataggatgggggcatggagctattcattgtcccccaggtgcagagaactgattcattgtcatcattatccatttgtggccccttaatattttatttatctggtttgggcattgagtgctacaataagtgcatctaagccctgatctaataccaaaatggtttcacacataaaagttgagtttgggtttgtacccaggggtttaacttttctttaatcttggtgtcatataatttagtcaataatgaacatgctatagttttaaaagaggtctctgttttaataaataaacagatcatacttccccgaagcaaataagagaaaataaaaattccttagcagggtgtattaggacatttatattctggtttctgctcatttctgcagagtcagcttctgtgccttctattgtaccctgtgatctggtcacacccagctttctctcccatccacaataccccagacccttggctttctgcatgctattcccttgcatggctagtgctgggtttctcttaagattcttctccatcatttatttcagaagtaaatggtctcaaccagtgaatggaaaaaggaaagtaacttcaaattttggaaagggattcagaacaaaatcatcaggttgaagatcccggaagatgactgaagctcagccaggtcaggggcacatcagtgtgtgggtccccatggttctcagatgttcttaccatagcctttaaggccatgcctctcctagtattgcccagatgctgccaggacagtgggccctctgtagctgcccctacctggaggtggacttgcccctttcactgtccatgtagctcaagaaatcatctctcccttcagggggaagccttttgatggtgaagtgtcagagagcaaaggaggaactgtcaacaatggtgattccactaatgaaaatatccaatgtgagctggtggtcctttgcttgttgttctgaggtaagtgaacatgtgatttggccacagtgttttacttccaacctaaaatgactttactgcctctctctttccctggctgatttcttcccaactctgccactgttctttttcctactcctttatttatccagtctcttttctttctctacgtacttcatgatccattctttctcagaccctctctttctgtggctatgtttgcgattcactccctttctctgtagctaccttttttcccttctctggctttacaatctgccttccagctgtccttgtccggactagtggttaaaatcttgggccctggtattgggagacccaagtaggactcttgctctgcttcttaaccaacaagtaattttgggaagattacctctgggctttaatttctctgtcagtcaaatggggttaaaaatgacttcaaagggttgttttaaagatgatgtgagataatcaaataaagtgtttgcgataaggcaccaaaaaaagatacttattattatccgtccacattcattttttcttcctccctggctctccttgtccttccaccagacctgatctttgtaactttgcatttctgtcaccttatgcattccctatagattttccagtatgccaaattgtatgatttttttccaaattcatagaacacataagaaatgtttatgtcctctagaagttcatcttagagagttgggatcagctttagcaaggggctgctcctgcagctgtaccaatgagagaatatggtccattccaccccagagagaaggcgggggattaacgtgcatattccacagggctagaagtaaacccagacttttaccatagcaactttttaaatgcaaaaagcacttgagaaatctcattaccacgtttgaagcttctgtaaatcgtcaccagattgggatattcacgcaggttaatttgactgaacaatgtcaccagaagagacaggttaaaagtcctctccagttgggtgagaatgttgtgcaccactctggatacagggatcaaatttctacaggcttccagagattcctataaaaatggagtgaaggtttttataaatgactataaaattgaatgggaagttatacatttatggttttctaagttttaagaaagctaccttactcttttaagaagaaattcaacataaaatatatagtcacattctctaaggtagagcggtcacagttttacatgcttatttttgaaactttacacatatttggatgactagcaacaaaaataaataatttagctttcttaaagtaagtctatattctgaatccaactttcaggcacatttgagacgagagaaatttgaaggaaggaaagtggggttaaaggatgctactatgtaattgattctttaaagctgtgggcaggatacttcagcaatggttctagtgatggtcacagaggcaattctgctggttgcttgtgagcctctgctcagtctctctctgtgtctctcaaacttgagataagcctgaatggattccagccacagagaagtcaccctgagaattttccttgcctagaggatggacaaaaggagaaatacggcaagagagaactgattgcaaataattattgaacatctactaggctcggtcagcgagtctttgggtacacagcactgaataagaccaacatggagttgcctatatttgggggtcagggtaggcactgtcaagtggagaagatgagcattaataaacacaaataaatacccatttacaattgagagtagtgttacggagggaaagcatagattgctatggaactgaataactaaggggtcttcatgagatgagttggccaaggagatgtctctgaggagtgctctctgggctgtgatctgaagagggagttggggccaaccagactaagactaagggaagattattggcacttccttgagtctagggctcaattaatgcttttaaaaaccaaaattatataaaaataggtccacttttgtccacatagcatatctcccagtgcctgcctgtctcacatcagaatgcactgtgagcaatattagctgttataaattgggatgatgcctgtagtgagttgaatgttggatggatatatctcagccaagatatatccatctagaatctgtgaatgtgaacttatttggaaaaagtgtctttgcagttgtaattaagttaaggatcttgagataaaatcatctttgattagggtgaccctaaatccaagtgtcctcagaagattaggtagaagactcaaaagagaggtgatgtagagatgaaaacatatcagagtgatgcatctacaaggcaaggaacactaaggatttccaacagctaccagaagctaggagataggcagctatcggattctcctcagggcctctagaaggaaccaaccctgtcaacaccttgattttggacttctggcctccacacctgagagaatatatttctgttgttttaagctacctggtttgtagtcattgttacagcagtccttatgacaccctagaaaccaacatagcccctatgacaccctctctcctaactacccccaccttctgtgataatgaacatgcctgggctgggccttccaaactctggaagccctggtggtttgtggtttgagactttaataatcaggcatattggtgggggctgggctgccatggaagggttcaacatgactcaccatgtacattctcttagtgatgatggagttgtctaggaggccttcaaagaagggaaatggcttgtgtatggcataggcgatccccagcttctggtgcatgaagtgctgaaaaagagcctcttccatggctcttgtcatggtgaacatcctatggaaagaggcatgataaaaaatagaagcaaaggctgggcgcggtggctcatgcctgtaatcccggcactttgggaggccgaggtgggtggatcacctgaggtcaagagattgagaccatcctggccaacatggtgaaactctgtctctactaaaaatacaaaaattagctgggtgtggtggcgcacgcctgtagtcccagctacttgggaggctgaggcgggaaaattgcttgaaccggggaggtggaggttgcagtaagccaagattgtgccactgcactccagcctgggtgacagagtgagactccatctcaaaaaaaaaaaaaaaaaaaatagaagcaaaaccttgaggaatgtgggaagcttctctctgcattaaatgggcagatctaaaggtaagcattctggtcccaaaggcatccttagtagcctgcaaagcaatgtctgcctaaaaggctcatgggtataggaaacaaggacaattcccagcaacaatggaggctgagagtgactgaaaatataatgacagaatcccaaggcgctgcaggtaaacataaggaaggtattaaaagtagctaatatttatggagtgtttcctgtgtgccagactttgttctaagggtttcatatgcagtaacttatctgattttcataaaacccttgcgaggtggttcctatgactgcacctgtttatactgttgaggaactgagacacagaaatgtttaataacttgccccagggttgcacaactagagagtggaagagctgggagcaaatcctgattccaggcttacagtgctaactatgtgttctatggccacactgatctgggttaaacaagatgacctgggctacggctgaagccattaactagcaatgctcatgcaacagggaccaccctaaaatgggtagagttcagctggaaacctggtaatatttggaaactttaacgaaccactcccaatcttcaacacaaatgggccaagcataaataaaagcatgagggctgagaaaggcatacttagtaaaagtgacttaactgacttgttcactgcaaccatttcatgtctcagacatgcgccttttcccatgcccatgcagcatgtattaaagattggccatttatggactgtgaggagatatcaataggttataatgggaagaaagtttacaaatgacattcttgacaaattgtcaagaaaaggaaaagcactaacaaaacattcaatcaacttgacagtttttaacaaacagaacaaacatggattccacttttccaacttcattttgtgttgaacagaaaagtaaatcgtaattaacaactgtttacagggatttaatcccagtggcagattaagcaccctagtctctttctcctcattccccaatttttttaacttggcagaaaaaaatactcatgaaaagaataatccgcaatcgcataggaaaacaagaaaagatgccattgagagtctgtggtggtaaagaagtcttggaagatagagaacagataggagagaaatctactatccacaatatgcacaggggaaggagatagtgcaaagatcagtgcaaagtcagagaaaggcagagtaaacatatactaagaagaggaaggggtcttggaggctccttttagaacaattcattatacagcagcgctcagaacaggaagtctagagcttcctcattcttcatctgtcatgagtcccaaagatgaaagggaggcacagagaggtttagtaactcacccaaggtattcagtggcaaagcagagcttgtctgactctaaagccctgtttctttctatgcaagatactacatctcatatatgactgttcagatttttattatgtaaagagattttgcaaacgaataagcaaaagacaaacatccaactagaaaataaaaaagcaaaatacatgaacagagagtgataaaagaataagccaaatgtgcaatgaataatacgataagcatgttaactagctagtagaaagcataaagaaggccaggcatggtggctcatgcctgtaatcccagcactttgggaggttgaggtgggcggatcagctgaggtcaggagttcgagaccagcctggccaacatggtgaaaccctgtctctactaaaaatacaaaaattagctgggcgtggtggtgcacatctgtagtcccagttactcaggaggctgaggcaggagaatcgcttgaacctgggaggtggaggttgcagtgatctgagatggtgccattgcactccagcctgggtgacagagcgagactccgtctcagaaaacaacaacaacaaacaaccaaaaaaagtgtaaatgaagacaatttgataacatatttgtctatcaaattggccaagatagaaaataatagtaataatctcagacactgtgagtgggaaggtcaacaggtccaaatgttctgaaggctgatttagtaatcagtgtcaaatgtcctaaaacatgtgctcctttgaatttccacttctaataatttatttcaaggaaataatcatgtatttagagaaaatatataaaaagttcatgatacactagagacgaaattaaatgtactctcatttttttcttttccaccagcttcccaagtacctctagtcatttacacaatggataacagatgagccgcctattgcgggcactgaaggatcagagcttaggtgagggtagagggcaaatctcggctccattcacaataacaggctggactctggcgaaaaaaagaggtgtcagtgttccctccatgtgcccccttttaacagtctcctaataagtaccacatgtctgagctctgagagagcctcagagtttaaatagttgaactccaccctgcagctgctgccgcgaagttaactctaagagctgcagtcaccaagagcgaagaataaagcagcaaagacagaaactcacctggactttgagtttgtcgttcctgcccctttccaggggctgggacagggatcactcctcaagattgggagagttacagggagatgctagcaggcaaaacaggaagtctgtgctttgacaaacgcagtaaggggccgggcttccgagaaaagaaaagtgaaagttttcggagtttgccaagccggaagctgaaggcaggtcggtgcctgcagcctctctccacctcctcatgggcactt

SEQ ID NO: 2033 - DNA, 51182 bp, Homo sapiens; identical to SEQ ID NO: 2032
  source 1..51182: mol_type = genomic DNA

SEQ ID NO: 2034 - DNA, 49256 bp, Homo sapiens
  source 1..49256: mol_type = genomic DNA
tgagctttttcatttaatttttattttagagtcatttgcttccccatcccaaattaactatgcaaattaattgttttgaagatgccatgcccaaatgtggaggtgactcagagcttggaaactcagaagctctaaggtgagcctccagacagggaaagtctgcaacatggtgactgagagggtagtagaaattcacttgctatttaactctctcttgagatttattcttggaggacagagcaaaagtccactctgaaagacagaaggagtcaatgaatgaggttattctggaggtttttcttttgtagatactggccttcccacttcctagtgaatgtctgtacccagacatcacactggatctcaaacccaagaagtcaaaaagaaaaattagctccctcccccagtcagtttttcttctggacctcacttagtgataaaatcactttttcccctgtcactcaaacccacgaccctagttcttctttcttaacctttcccatccattcctttctccttccatttctccctctctagattaaaatctttaggatttcatcctagtgataatttcttgagtgttgctgagagaggccttgtgttgggtcctgtcatcatagacactagttgttctcaggacaggaatagtgtgctgtggacatgcagcggagagacagaccacggactgggcagcctggaaatgctgcaggggggccagatgagctgggccttgagtagatgtcaggtagaggatgcaggggagtggttgcaggcatctgtcttcagctagtttctttttaggttcttacatctctcttcacctcaaagccctttgccggcatttaaagttcctgtactcctttacttgcatttaaagttctccaccatcaggaacaatatgtgctcctaactttgtcacccacagttttttttctatgaacatttaactccttataaatcatgctgttgaatcctaacgggagctcttcacatttctgctcttaaagctccacttctccttcaaggatttaaacctgtcacctatctgtcccgtcattataataccttcagcagctctcctagggtcattccttcacaacgtatattccgtttccagttctttgcgttccttccttttccttcgacttcaaattcatttggtgttaaccaagttccatcctcattccgaatgcacttcactgaggatcctgtaagaaaaagcccattcttggatctacccccatcctctgtgaattcaccctgaacctcttcatcctaattgtggccttctacctttccaggtcaagagagacttcctctgtgaggtggaaggagtagcaggggagtctgcgggcctcttctcttggactgaagccagccctaaagcctgactgagtggtgaggggtgggacagaatgtgcattcgtgtagtgcctacatgcagcaaggacatggctgtcagtacagcagggcccatgggtgacttccaggtgggagtggagggtctgattgccagaaataccatgatgtggaagagtttggaaattccttcctaagaagcgtttcttctgcagtctagctagcagggtccatttcctgatcaattacacacacgggtattttcctcccttctagtgagtccttcatctagggattccaaagagcagaagaccaaggaactcaccgtgtttcattttcttcttatataaaatccctttcgcctcaccacaggtcacggggagcttagaacagtgaaaatccacagtgtcacttttgggttttccttaaagtagaagagaacagttttgtgttattcagtcttcactccatcttccttttgaattctcccctccatgaattccaataatgtacagggtattggggaacgttctctggttagtttgcaggaactctttcatctcgagtgacagataagctatgtgtacacagtggcctgcaacaaaccaccactgccaccaacactatatcaaaaaaaaaaacattttagtggaacatatagggcatcttcagtgaatgtgtcttaatttgcaagtgaattggctgtcactgaatagtcttctattctataagcatcctgctgatctctctgtgctgatggaaatgtttctttgcattcatgttgccagaggaaaaaaaaatcttcatttataatcttatttcctgacttaaatgaagacttgggtgagtgaggtggctggcactgaggggatggtgtcagtcttaattatttgctgtttcttttcattttattgcttccctgcttcttcctcgatgaataaaagaaaaccctggagagctttgaactaatttcccagttgctcatggagcagtctggcaactcagaacccctgggtagaaatccagagtttagattcaggggaagcagttgcaagagggtttaaaataaatctcagcaattcctgctgccttcccctccaacctcactatgggtgaattcattaaagagagacagcaggggctgtttctctggggagaaatgaaggggctgtccatgtcttatgttgagttacagaggatgttacacctaaaatgaatctaggagaacacctggtccaactctctcccttgcctcaaacagttattgaaagagctaaaggaaaacaaatggcaaaacaagagcattgacggaaaggtgaaggaacagtatcagcggcgaagaagccattcatttctctggaaagacacaaggcagatagagtgagactgagagaggagggaccctgagaagtgaggatgtgatccccccgacagaaccctacaggatgcctggcctcacaggagcaggggctggcagcaaggctaggcatgggggtggagggtagtgggggtgtgggaacttacggtgggaaaaactttgtttcaacagccagccctcttgcatggagtggccagctccaccatttgtctctagactcaactcagtaaatatggaacagcagatgagagcgtggccttgggagccagactggggggcagggaggagtgggggtgggaggggcttgtaatcctggctctgcaacttactagaaggattacctaagcgtgcattactgttatcaaatttgagtgggaaatttgctgccgcaggttcctaatgtgagggaaaggcagagctccaggtgactctggaccactattgcaaaccttgagggagattagcacagctctggggaccttcccttctacagttctctgtctccacagaaatgtcttctctaattccctgtggtgaatatagctttagggaacacaaatgtcccaaacacattcacaagcagatgagggagcagggggtggctttgggggccacgggtagcaagctgatgtgcagagttgtgaggacaaacatcagtcccttccttacccagtggaggcaggccatcaagtgaggtggggcctttagacccgaggacttccaaagccaactgtcctatgcctgagggcagcctgttcctaatagtgctaagtctggctcagcctcacctactcatcttaccaaccaggccttgaaggatggaaccctgcagccccaggaacccggtgggggatgcttggggctctctaacggcagctggcttgtttgaaaggtgagctgcagcagcggtgagtttaggtccccattaggaagcatgagcaaacaatgaggagcctgctgtgaaaagcaagcaattagagaacagagagctcagggaaaggaaaagcaaggtggagaaaactaagaagaaaagcctaatcgagatgaggaatagcggcatggtaaaaaacgaattcataatccagaagaccaactccaggaattcctacagaacatgaggaaggagcacaaggtggaaattatgcatggaaagaccacaggcctggggagtgatttgggagctctatgatgtatacatgaggggtctggggaggggatgattgggggtggagatggggcggtgggaggaaaagtgatagtcaaggaaacagtaagagcagcagatgcactgtgtcatctatccgcataacaatgtgtaagaaagagaaggcaatgactgtcctcattttatagatgagggacttggggtcagatgtggagagagaattgccggtggtcaccatattacatgaggtggagctggcactggaatttacacatgccagacccagtatctagcgctctttccacatcatcagaaatgccacgagactgcacatcatacaagcaacaacagcacagatactctgcatttaatgagaagttacagacagtgcagaagggagaagaaactgatgctgagggacaactgtcaacgtttgccggggctcctgcctccaccagtgtttgagagtaggtgctttctaggttcatttacatttttagtgtaaaggaaaaagggcttgaaattggaacacataggttgattttagctcattcaagtcttttgccctttaattgaatctgtaaaatgggctgataacactcacttattatggtaattaaatggcaaaatgtagatcaaagtgctttgccaactgtgaagtaatgtacacatttatatggttatcaggaccactgcatgaagttgtatgggttgtgccctgagcaaggactccacctttaaggggtgctctaattcatattagaaacagaatcagtttacctgcttagtacaacaatcttccagcagaaggcagaaaagggtttggtttcaagaattggctctgacagatgaggtagtgaattgaggaaggggcacctttttctaactcacacacatgcatcagataggcccagatactggtattcatacttgaagaagtaccagctgtgtgaggcatggggagctggacatacagcaacacacaagacccatccacttactgacctcacgtgactttcacgcagtgaacaggctgtgcacagatcattcatcacagttaagataagtgccatgaagacaaaatgcaggtctccacaagggcatgtcagggagacccacccctacctgctgggagagagaatgcttccctgtggaagtgacatttaaggtgaggtctgagggcaaaggtctaatatccagaatttacaaggaacttaaacaaatttacaagaaaaaagcaaacaacacctttaaaaagtgggcaaaggacatgaacagacacttctcaaaagaagacatttatgcggccaataaagatatgaaaaaaagctccacatcactgagcattagagagctgcaaatcaaaaccacaatgagataccatctcatgccagtcagaatggcgattattaaaaagttaagaaacaacagatgctggcaaggctgtggagaaataggaacacttttatactattggtgggaatgtaaattagtttaaccattgtgaaagacctcgaagcaattcctcaaagacctagaaccagaaataccatttgactcagcaagcaatcccattactgggtatacacccaaaggaatataaatcattctattataaatatacctgcatgtgtatgttcaccgcagcactattcacaatagcaaagacatgggctcaacctaaatatccatgaattatagactggataaagaatatgtggtacatatacaccacggaatactatgcagccataaaaaggaacaaggtcatgtcctttgcaggggcatgattacagctggaagccattatcctcagcaaactaatgcaggaacggaaaactaaacaccacatgggttctcacttataagtgggagttaaacaatgagaacacatggacacagggaggagaacagcacacattggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcactttggggttgggtgggtgagctgggaggcccatgtgaggaggccctgagcaggaacgaggtgggagcattcggtatctggtgacctatgctgtgaggaatcaggctggtgtgaccctagagacacgggtaggggtggtttatgggtgttggtgacatcctgtgtcttgagctgcgtgctgggtgtgcgggtgcattttctgtgtgtgtgaatccatcaagctgtactcttaggatacatgccattttctgcaagcacatacaccagtgctactcagtgctccagcctacgatgcgacaggggcttgatcagaatcaatgcactgctgtctccactgaggaatcttgctatgaaaacagtgtgcttagcgtcacagttggtttacaagctccttattcttgtagacctgccaagcagcatgcttgtagatggcaccagtctggggaccccaccttgggtagcacctattatactttgataatgaataaaaagggccagtgtggctggcgcctaaaaaaggaagagagggtgacaagaaatgatgctgaagaagcaaggtataaaagcagaagaaaaataaatgcaagaagaggagtgggagggagaggacagagatgcaaagagggccgagggtgcagagaggctgaagcaagcccagggtcccaaccaacacaggaaaaggaacgagaacactgtcaggctgtgcttgaataagggtttcctttaattcctagaatggaagacatagaagttcattttagaatttgacttaaaggtttagtgatcatccttaatcatttttgggtctttgtatagctctgtgttaaagaatccttccaagtatggaaatggccaccatgcacaagggggtgggttaggctggcagcactcctgatgcacccaattcagctggtacccatgacggtggagaacaactttggaggagaagggagagagaagaaggagagggcgggtggagcttccagcagaggccagggctctggggagcccagtggggaggcgctgtggcttgcttgcttacctcttcggtgaatatttttctgaaatctcctttttgagcttgaacagatatctttctcctttttcttttctaaacacagaattaataatcacttatagctacaaacatagatttataagcctcataggttaacaatcttcaagcattttttcctgtttttctaccagtttggagagacaagttacatatgagtccttatgaaaggacttccttgtagcattgactaaggaaatacagcaagctcatgttaataggcagaaaagctaaaaatactacagaagccaaatttccactaattaatatatgtcaatacatttactacaaatactagaataaagggatgtacaggagtccccccttatccacacggcatgtatttcaagccctccagtggatgcctgaaaccatgggtagtgcccacccctgcagatactatgtttcttcaatctgataaccaagacagctactaagtgactgatgggtgggctgcgtatacagcaggacacactggaccaagggatgattcgcatccccgagtgggatacagcaggatggtgcaagactttgtcacgctactcagaacagcgcatcatttttaacttataaattgtttatttctggaactttccatttaatattttcaaactgcagttgacttcaggtaactgaaatcatggatcaaaaaactgcttataaaggggggctactgtatggccttataaatatcacataggaagggctttttaaggaggaagtaatgggcataaagcagtggttaacactgggtgattttgctctcaggggatatctggcaatgtttggaaatctatttgtttgtcaggacggggaagcagctgctactggcatctaatgggtagaggccagagatgtcgctaaacatcccatgacacacacgacagcctccgaagcaaagaattattcagtccaaaatgtcaataatgccaagattgagaaactctggcataaaccatactgctaaaggtaaactgatttgtctatctaactaagcaaatggctccacaaccaaaagcttcttaagttcaaagacagaaaccaaatcagaaaaactaataattataacaaagggttaatttccctaacggatttaacaaaaaaaaatggccagtcttatagaaaaatgggcaaattcaaacagatgaccctcaaaagaaaaaattccaatgtcaaatttatttaaaaaacaggtaaattggtaacgataggctaggtaatgctgtggtaattcacgatcctcccaaatctcagtggtttattacaggtgtcagcaaactatggtctaagggccaaattggcctactgcctgtttatgtaaataaagttttattggaatacagccacgcccatttgtttacgtatttgcctctggctgctgtcacgctacaaaggcagagtcgagtagttgcatcttctggtcctttttggaaaaaatttgccaagctctggtttacaatggcaaaggtttacttctctctcatgctgtttgttcatcataaattagatgaggctcagccctacatcactgacactcatggcttctgcagacagagcagcctctgtctagaacatccctggtcttgggcagagagaaagaagacaaaggggctcttaaagccttggcctgaaagtggctctctaacttgggtccacatttctttcgctaagttatcacatgggcattcctgagtccacaggcagggctgtagacttctgaggaggtggggcactggaacactggagaaccgtaatacaagctaccacagcatgtttgatcacctgccaagtgaaaagaaattcaaagggaaacaccggtggaatatcacccttcacctttggccgtcatcatagacacatcttgttatttctagtgttggtgaaagtggagggaaagggtgtctgtatgatgtaatgggagtataaacagacaatttaggcaatttgacaacaaatatgtcctaacttaaaaatgcagacttgaccaagcaacttcacttctagaaatgaaacattaaaaaacaatcctgcaaatgtgtccactttgaggattggtgccacttccaagactgggttggccagaaccagaaaggagtctcccaaactcaagagagtagtggtgactctaataacagaaatgaaaacagcagacactggggagtagtcatgtaaatccacatggcaaagccaaggtgaactgcaccctgagaacacttcttccaacaaccactgtcacatcaacagatccgtgctctgtcttcatgtccctcttttctgtacgtctccctccttctactattgactttacatatctatctgaccctgtactgctccaagaggccctcctacattgagctattcaaatagcagattccatcattagccttacctttcaatctggactttcgggcacatttagttcttgccttttggaccctcatcatgacctctgagttccaggttgagtcgtctttcctttgagtcaccttatccaccacttggagcttctcttggatgccatgcccaggtgaggctgcccctggaccaaatagacttgtgaatagtttagtgagctcccttctcatgttcccagcccctaccctttcaggagttatcttgccatttctctataattctctcttttcttgtgtgtatctttcttccccccagactcataatacttccttctatttctctttttcaagtcctcattttgtttagtaattacaggtgtatcaattagaatgcaagctccactagtgtagggatttgtgtctgtcttgctcactgctgagttcccaggacctaggacagatacctggcccacaccttacactccactgctgaatgaatgtttaataggcactaaagttttgaaaatattaaatgtatttttctttttaatttgtttttatttcaatagcttttggggtacaagtggtttttggttacatggatgaattatataatggcaaaatctgagactttagtgcactcttcgtctgagtagtgtacattgtacccaatacataggtttttactccccctcctccgtccctctcctttctgagtctccataatccgttatatcactctgtatgcctttgagtactaatatcttagctcccacctataagtgagaacatacagtatttggttttccattccatcacctcacttagaataatggcctccagctccatttaagttgctgcaaaagacattatttcattctttttttatggctgagtaatacaccatggtgtatatatactacattttctttacacattcattggtcaatgggcactgaggttggttccctatctttacaattgtgaattatgcagcaataaacatgtgtgtaggtgtcttcttgatataatgacttattttcctttgggttgatacctagtagtggggttgctggatggaatggtagatctacttttagttatttaagaaatctccatactgttttccatagaggttgtactaatttgcactcccaccagcagtgtataaacattcccttttcaccacgtccatgttaacatctatttttttttgacttcttaataatggccattcttgcaggagtaaggtggtatctcattgtggttttaatcttcatttccctgatgattagtgatgttgagcattttttcagatgtttcttggccatttgaatatcttcttttgaaatatgtctattaatgtcatttgcccactttttgtgggatttttttctataatgtttgagtttcttgtagacgctggatattaattcttcattggatgcataatttgcaaatattttctcccattctgtgggttgtctgtttactctgatgtttatttcctttgctacgaagaagcgtttcagtttaattaagtcccatttatttatttttgtttttgttgcatttgcttttggggtctcagtcatgaattctttgcctaggccaatgtccagaagagtttttcctaggttttcttatagaatttttctggtttcaggtcttaggtttaaatttttgatccatcttgagttaatttttgtataaggtgggaaatagggatccagttttattcttttacatgtggctaaccagttttcccagcaccatttattaaatatggtgtcatttccccaatttatgtttttgtatgctttgtcaaagatcagttggttttaagtatttggctttatttctgagttctctattctgttccattggtcgatgtatctacttttataacagtatcatgctgttttggtaactatagccttgtagtataattttaagtctggtaatgtgatgcctccagatttgttctttttgcttaggattgctttggctttgcaggctcttttttggttccatatgaattttaagattttttttccagttctgtgaaaaatgatgttgatatttgataagaattgcattcaatctgtagattgccttgggcagtgtgatcattttcatattgattcttccaatccatgaacatgggatgtgtttctatatgtttgtgtcatctatgatttctttcagcagtgttttgtagttctccctgtagaaatctttcatctccttggataagtatattcctaggtattttattttattttgttgaagttgttttaaaagggattgagttcttgctttgattctcagcttggtcactgtaggtgtatagcagtgctaatttgtgtacatttgattttgtaacctgagactttactggattcatttatcaaatctaggagtcttctgaaggagtctttagggttttctaggtatatgatcatataatcagggaacagtgatactttgatttcttttccaatttggatgtcatttatttctttctcttttctgattgttctggctaggacttctagtactatgttgaatagaagtggtgaaagtgggcatccttgtcttattccagttctccaggggaatgcattagattttttcccatttagtatcacattggctgtgggtttgtcatatatgacttttataactttgaggtaagccccttctatgcctagtttgttgaggatctttatctaaagggatgctggattttatcaaatgttttttctgcatctattgaaatgatctatggtttttaattctgtttttgtgatgtaccacattattgacttgcatgtgttaaaccatccctaaatccctgggattaaatccacttgatcatggtgtattatatttttgatgggctgctggattcaatctcactgtttgttattggtctgttcatggtttctatttattcccaatttaatctaggaggggtgtatgtctccaggaatttatttatttcctctagatttttctagtttttgtgcatagaggtgttcatagtagtcctgaatgatcttttgtatttctgtggtgtcagttgtaatgtctccagtttcatttctagttgagtttatttgaaacttctctctttttttttggttactctggctaatgttctatcaattttgtttatcttttcaaagaaccagctttttgtttaattgatcttttttattttttgtttcaattttatttcattcttctctcatctttctttttttctgctagctttgggtttctctagttccttgaggcatgacattaggttgtcaatttgtgatctttcagactttttgatgtaggcatttagcgctatgaactttcctcttaaaagcactgcttttgctgtatcctagaagttttgataatttatgtcactgttaccattcatttcaaataattttctaatttccgtcttaatttcagtgttaacccataaatcattcaggagcagattatttaatttccatttatttgttatggttttgaaagttccttttggagttgatttctagttttattccactgtgatctgaggagatacttaatataatttcaatttttttcttctaaaaaaccccccaaaatgggacacacgtgcagaacatgcaggtttcttacataggtatgcatgtgccatggtggcttgctgcacctattgacccatcctctaagttccctcccctcaccacccacaccccaacaggccctggtgtgtgttgttcccctctctgtgtccatgtgttctcaatgatcaactcccacttatgagtgagaacatgcggtgtttggttttctgttcctgtgttactttgctgaggatgatgggttccagcttcatccatgtacctgcaaaggacatgatcttattactttttatggctgcatagtgttccatgatgtatatgtaccacatattctttatccagtctaaatgctggattctttatccagcatttgggttggttccacgtctttgctatggtaaatactgctgcgataaacatacatgtgcatgtgtctttacagtagaatgatttatattcctttggatatatacccagtaatgggattgctgtgtcaaatggtatttctggttctacatccttgaggaatcaccacactgtcttccacaatggttgaactaatttacactcccaccaacagtgtaaaagtattcctatttctccacagcctcaccagcatctattgttttctgacttcttaataattgtcattctgactggcatgagatggtctctcattgcagttttgatttgcaattctctgatgatcagtgatgttgagcgtttttccatatgtttgttggctacgtaaatttttttttttttgagaagtgtctgttcatatcctttgcccattttttgatggagttgtttgtttttttcttgtaaatatgtttaagttccttgtaaattctggatattaaacctttgtcagatgggtggattgcaaaatttttctcccattctgtaggttgcctgttcactctatttctagtttcttttgctgtgctgtagctgtttagtttaattaattcccatttgtcaatcttggcttttgttgtaatagcttttggcttttttatcatgaagactttgcccatgcctatgtcttgaatgatattgcttcagttttcttctagggtttttatggttttgggttttacatttaagtctttaatccatcttcagttattttttgtataagatgtgaggaaggggtccagtttcagttttctgcatatggatagccagttttcctggcaccatttattaaatggggaatccttttgccattgcttgtttttgtcaggtttgttgaagaacagatggttgtagatgtgtcgtgttatttctgaggtctctgttctgctccatggtctatatgtctgttttggtaccagtaccgtgctgttttggttactgtagccttgtcgtattgttcaaagtcaggtagtgggatgcatcccgttttatcctttttgcttaggattgtcctagctatatgggatcttcttcgattccatatgaaatttaaaatagtttttttttctaattctgtgaagaatgtagagacaatataccagaatctctgggacacagctaaagcagtgttaagaggaaaacttgtagcactaaatgcccacatcaggaagctagaaagatctcaaatggacaccctaacatcacaattaaaagagctagagaggcaagagcaagctaatccaaaagctagcagaagacaagaaataagtaagatcagagaaaaattgaaggagatagagacacaaaaaaccctcaaaaaatcaatgaatccaggagctggttttttgaaaaaattaacaaaatagatcactagccatattaataaagaagagagagaagaatcaaatagacagaataaaaatgataagggggaatatcatcactgatcccacagaaatacaaactaccatcagagaatactataaacacctctacacaaatgaactagaaaatctagaagaaatggataaattcctggacacatacaccctatcaagactaaaccaggaagaagttgaatccctgaatagaccaataacaagctctgaaattgaggcagtaattaatagcctaccaacaacacaaaacccaggaccagatggattcacagctgattctaccagaaatacaaagaggagctggtaccattacttctgaaactattccaaacaattgaaaaggagggaactcctccttaactcattttatgaagccagcatcatcctgataccaaaactgggaagagacacaacaaaaaaaaagaaaatttcaggccaatatccctgatgaacatcaatacgaaaatcctcaataaaataatggcaagccaaatccagcagcacatcaaaaaacttattcaccatgatcaagtcggtttcatctctgagatgcaaggttggttcaacatacacaaatcaataagcataatccatcacataaacagaaccaagacaaaaaccacatgattatcttgatagatgcagaaaaggcctttgataaaattctacatcccttcatgttaaaaactctcaataaactaggtattgatggaacatatctcaaaataataagagctatttatgacaaacccacagccaatatcatataaaatgggcaaaagctggaagcattccctttgaaaaccagtacaagacaaggatgccctctctcaccattcctattcaacatagtattagaagttctggccagcacaatcaggcaagagaaagaaataaagcgtattcaaataggaagagaggaagtcaagttgtttctgtttgcagatgacatgattatatacttagaaaaccccatcatctcagcccaaaaacttctcgaactgataagcaacttcaacaaagtctcaggatacaaaatcaatgtgcaaaaatcacaagtatgcctttacaccaacaataggcaagcagagagccaaatcatgatgaactaccattcacaatcactacaaagagaataaaatacctaggaatacagctaacagaggatgggaaggacctcttcaaggagaactacaaaccactcctcaaggaaataagagaggacacaaatggaaaaacattccatcttcatggataagaagaatcaatatcttggaaatggccatactgcccaaagtaatttatagattcaatgttattcccatcaaactataatttcaatttataaaaatttattgagacttgttttgtggctatcatatggtctatcttggagaatgttccatgtgctgatgagaagaatgtaatcttctgtaaatatctattaggtccatttgttctagagtgtagtttacatctattgtttcttttttgactttctgtctcaatgatctctctggtgctgacagtggaatactgaagttccccactattattgtgttgttgtcttatctcttttcttaggtctagtagtaaatgtcttatgaatctgggagctccagtgttagctacatctaaatttaggactgtaatatcttcctgttagattgatccttttatcattatataatgaccttctttgcctttttttactgttgttgctttaaagtctgttttatctgatatgagaaaagctactcctgtttacttttggtttccatttgcatggaatatcttttttcacccttataccttgaatttatatgggtccttgtgtgttaagtgagtctcttgaagatagcagatatttggtttgtgattttgtatccattctgccaatctgtatcttttaagtggagcatttaggcccatttatgttgaacattaatatcaagatgtgaggtactgtttcagtcatcatgttaattgttacctacatacgttgttttcttcattgtgttattgttttatagaccttgtgagttttatgctttcaagagtttgtattctggtgcatatcaatctttcgtttcaagagttagaactccttttggcatttcttataaagctggtctggtagtgacaaattccctcagcatttgtttgtctaaaaatgactttatttctccttcattcataaaacttagctttgccagatacaaaattcttggctgagagttattctgtttaaggagactaaagataagactccaatcccttccagcttgtaaggtttctgctgaggaatcatgtatttttcatccttgcaaatagtaaagatttccctgactattacatcaataggtttcagggggagggcagatgcttgctagaattgagaagccactgctcagttggggccattttggcaagcttagacaaaatcttgaagcacagtatttgttgggagcaaagaggaatttataaattccaaaaattacctgtacctatcaaaagaaaactttggaggtctgaatgtcaagttttcctataagtcattggtagtgaacactcagcaaatgacagagagtatgtttcctccagcctagggaggcagtggggtggggaactaggaagaagaggccagggaggggaagtgcaagcaggcagatatgactttccttctaggccaaaccccaagattgaggcatgctgggaacaagcagaaaaattagagggctttccaaagcagtgagcctcatgtcctaattcatgtttgggagctgggacaagatctcttcccaggctggctcccataaaggtacagaatccaagagaatccccactgaccggcatatcttaggccctttgtgaataattttgagtaaaagaataaagaaaaaggggccaggtgcaggggctcacacctgtatccgagaactttgggaggctagggcaagaggatcacttgaggccaggatttcaagaccagcctggacaacatagcaagacctggtctatacaaaaaatttacaaaataaattaaaaaaagaaaaagggaaaaagaaaggaacagaaagggaagagggagagaatacagaggagaaaaagaaaagtgggatgaagcagaggaaccagaaaaatgcagcttttttgtttcttattctgcaagtaacacagtttgtgcactggagtagacacatgcatgcaggcatgcaagcaagcatgggttgactgaggtagttctgaacactctatgactccaaatctaatccagtttggaactgaaagtctgaatcctgcttggggatttaggtttcttgtgtctattcttctgggctctgaccctagacaggaaacaattctaatctcaaaattgtctgatgcctcatgtccacctcaaccccattccctccctatgataagagaaaagaagactaggtataaaccaagttggtgttaggtttgctcttcctttgttggggagtctactgatggggtggcctaggggacaaggttggggctggctgtgctccaggcacatgtggctggagaggaggtcatgccagctggtcaggtgaggggcctgataaacaccaagagagtaacaatttcacttttcttccttatgtcttgggcattttttttttctgttttctttttgaacttggccatattcttttctccttttttctaaaaaagaaaaaacccacatcttttatggctacaaatattgatctacaaacctgcaatgtcattacttttttaagtaatttttttcctgttttccctgactttgagaaggcaagaaaaccatgtgacctatgtgaaaaaagtactccattttagctggaaattgaattaggggattgaataaagatggatcaggaatatactagaggactaacatttaatatatgtcatttaaaaagttttttggggacagagtcttgttctgttatgcaggctggagtgcagtggcataatctcagctcactgcaatctccacatcctgggtccaagtgattatcgcacctcagcctcctgagtagctggcataacaggtatgcacccccaggctaacttttgcatttttagtagagacggggtttcaccatgttggccaggctggtcttgaactcctggactcaagtgaacctcctgcctcagcctcccaaggtgctgggattacaggcatgagccggcatgccttattaattttaaaattaataagcagtttttcaagactagacaaagattgttataaaccatggatattaaaaggtttcctagccaaaattcagggccagaaattacacagttatgagataaacagatttgaatgtttaaaaaattaaaaatatacagaaggagcaggactgaaaaaaactgttcacagttcaaaaaacaccccgacactattaaagcaaaaacaaaatttaaatatacatagcatatagaaggttaatatccttattagataaagcaaaagatgaatggtaatctaggaaaataagcaaaaaatataagttaaaaatgctcaaggaggaaatgaagatgacaaatttatttagaaatcatctctatattactactaatcaaagaaactcattgtttggatgttaaggatacctaaacatttaaaaagttttattacatccagcattgaggatgtaggaaatgaatactcatatattgttaaagggaatataaatcattatgttttctggacagcaaattggtaacatgtataattaagatatagattttaaccaagtaagcttgtgtttaagaatcaattctaaggaaattattggacaagtgtgcaaagatacaaatacacacaaacctgatttctattttcatataaaaataagaaataaactgtccactagtaggtgattatttaaacaaattgcggtgaatcatacgtaacgtgccatgcagttaaaaaaatagataacattgatacagagatgatacacaatgaaaaaagtgatttatagaatagactatatagtatgagcttatatataaaaagaaaaatgtatgcatacttatacaaaaataaagtgggggaagcagattaaatagatgtttaactttatgatttataattttcttttttttaaaattttattattatattttaagttttagggtacatgtgcacaatgtgcaggtttgttacatatgtatacatgtgccatgttggtatgctgcacccattaactcgtcatttagcattaggtatatctcctaatgctatccctccctcctccccgcaccccacaacagtccccagagtgtgatgttccccttcctgtgtccatgtgctctcattgttcaattcccacctatgagtgagaacatgcagtgtttggttttttgtccttgcaatagtttgcagagaatgatggtttccagtttcatccatgtccctacaaaggacatgaactcatcattttttatggctgcatagtattccatggtgtatatatgccacattttcttaatccagtctatcgttgttggacatttgggttggttccaagtctttgctattgtgaatagtgccacaataaacatacgtgtgcatgtgtctttatagcagcatgatttataatcctttgggtatatacccggtaatgggatggctgggtcaaatggtatttctagtcccagatccctgaggaatcaccacaccgatttccacaatggttgaactagtgtacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatatcctgaatggtattgcttaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatataattttctttttctttgttttgagacagggtcttactacattgtcaagctggtttcaaactcctgggctcaagcaattctcccatgttggcctcccaaagtgctgggattacaggtgtgagctaccatgcctagcctgatttacaattttctacactgaagattttattaggaatattgtatcacacaagacagggtaggctgtgctgcagtaacaaatgaaaccaaattttggtggtttaacattgaaaagtgtatttctctatcacatgaagttctctgtaggacaataggaccctctgtaggactggaagtcctctgtagggccctccagggctgctgtcctctatgtggtaggtcatgctgctttggccttctggcgcctccctcttccacacacttccacaggcgggaaaagaatgtggagagctgcaatgggctcttacatgctgtgacccagaagtgacacccatctctctggcttatttgccagagctagtatagcagagctgcctcctgcaagggggatgataatggagctttccaagtgtctgggaaggggagaagaattggaactagaggagggcagtcataatgcccaccataaacatgggcagggtgagcactgctagttgttcctctttctctggtctccctttttctttagtaataaagcccctgattctgagccccttattcttatagattaaagattacatttcccagcctcctttgaagtcaggtgtggccgtgcaaccagtcctggcaataaaatgatagaatttttttttcttttttgagatggagtcttgctctgttgcccaggctggagtgcagtggcatgatcttggctcactgcaacctctgcctcctgggttcaagcaattctcctgtctcagcctcctgagtagctgggattacaggtgcacaccaccaggctcagctaattttttttgtatttttagcagagatggggtttcaccatgttggccagactggtcttgaacttccaacctgaagtgatccacccacctcggcctcccaatagcaaattattaatgatagcaaattactatctgtgaccggaagcatttagagtccttcagtggaggaggtgtgcccttctttgactttgccattttctctttagctggaacatagacatgctggctggacctcaataaaggggatgccacatgctgaggatgatggagccacatgctgaggatgatggagcaacaagcaagaataagcccaggaccctacagtgtatgacaccagctcttgaccacctacctctcttgctttagctactattattattattattattatttttttttttttttagtggggtgaggtttgctgtcacacacagcaacataatcctctttttttttttttttttttttgagacagagtctcactctgtcacctaggctagagtgtagtggtgtgatcttggctcgctgcaacctctgcctcctgggttcaagcgattctccttcctcagcctcccatgtagctgggattacaggcgcccaccaccacgcctggctagtttttgtatttttagtagagacagggtttcatcatgctggccaggctggtctcgaactcctggcctcaagtgattcacctacctcagcttcccaaagtgctgggattataggcatgagccactgtgctgggccagcaacataatcctaatggtgacagcacactgcttttagaaaagtccaggaacttttctatgttgaaaaaaagtgaaatcatgattttaaaaagcataacgctttttctggcttggatgtcttttatggcctagaatggcataataacagtaaggtaacatcaatccacaccacagagaccaaatagtttcttcttcacacttatgctctgccctgggagattttcccagagagagtttatttccattatccataggatcttggaagtaatgagaaagtaatttttgaataagcagttttctattttgggcaatagtgaattgacaaaggtttgacagtattctttctgccccttcctttctatggagaacgatggctcctgaaaagagttcctggggaccaggttgttaacccggtggcagccagcccttacccaggggatcctgaaaaaaatccattaatcctttccatatcttaatttcctcatctgctaaattggaataggtcattcaatcttctccaagggtggttgtgaaaataaaataaaattatccatgagaaaagttgaaatactactagataagccagtgcaatataggagaaactgttaaaatgataatttagattttaaggtggtaaaatttaatccatttttcctgacaataattagatatttgttgtttgaaaatcacatttgtcatgtgagagttctgtgatttttgtgacaatgaccatatcaccagcaaacagacgaatatctagctgttttttcccctctaaggatagtgttatcaacttactccagaaatgtgaataatggtagcgatagtgaggggtgaattaacatgcacaattttaccagcacatgcccacaactccaccagttgtacatgctcagtcatagtgtcacatgtgtgttttaatgagtttttcgcttctcaattttctcagaaaggccacatgagaaatatggagattggaattctaggaaaaagcttgatccatgggttggatcaagctgcactttcgacaagctgtactttcagtatagtaccatgaatatacttaggacactcattctcagtaatggtgatattgctgccagtagtggaaaaactcattcttgagtgctgagaaaaatcttatatagtgcagatatacatacatacatatggacacattacataaaatggacatatatttgtagtagtaaatatcatgggaagggtcttgattaagaaaaaaaaatccagaagggctctctagcacagtaataatgaaaaaaaaaagttaagaaatattgcctcagtgtaagacagctctgaatttagattcctggtgactgtactctgagaccagcaatctccaagttttaccttgtgtgacccttcgtggtgtactaggcgtcttctgggacctctttccttcattcatttctgaagtgccatcaatgatctctggaaaatgaaagatcttagtaaatgccccttgggaaacaccatggagaatctcccagagacccaggaaggcccttgcacactctgaagttgagtcttggaggctccaggtcttaccctcctaacaatgcatctaccaagagatttggtgctgctcatgacactgtgcctgtctgccactcaggggaggagcagaccgcagttggttagcagtggttactctaccaatggagacatccacagtggggtgcagccatctgaaccccttggccagagtctctcaaagtaaggtctgtgagcccctagggggtctgtcaaaccgtttcagaaaatttgcaaggtcaaattgttttcataatatgatgttatttgcctttttcactatttcaacctttgtacagattgagcaagagcaatggcagataaaactgctggtgccttaagacacatcaaagcagtgtccccaaatctcagcaggaatcactgcatcctttattgccacctactcactgtaccaaaaaaaataaaaataaaagcaagattcacttgagaatgtttttggtgagccagtaaaaattattaattttattaaatttctacccttgagtacatatctgacatcttaatattctatgtgaaaaactgaagagcacatataaagcacttctattgcatcctgaagtaccacagtggcctcaagaaaacacttgtgtgattgagatacaagctcactgtataattccaaatgtatattttccaaacagctgtactattataaaatcttgcattagtagaaggtccattcaaaatgcaaggtggattaatgtattttattgtaacagagtatgaagttaattgatatggtttcaaattttacattacaactaatatttaagaaactatcacttgttgagtgttggtgtagtattaaaggtgaatatccacagatatctcaaaagactgttaaattacctcacccttttaaactagatatctgtgtaaggccagattttctttctatccttcaatcaaagcaacatatcacaactgaatgcagaaacagttgtaggaatccagctgtctttttataaagctcactcacaatcaaagagatttgcacaaacataaaatgatgtcactcttttcactaattttttttgttttagaaaatatatttacttttcataaaataatgctatttatgttaacaggcaattggtttattattgttacttttacatgaattaatattttaaaattattagttttaatttctaatcaggtacatgtagatagacataaacaacataaacagaagctccttagggtcctcaataatttttgagagcataaaggagtcctgagaccaaaaaatttgagagctgctgccccaggccacagctgtccctgtgaacacgtctgtttcttccacaaaacttttcagatgcaacagatgcttgctctctttgttcctcttgttataccccatcctcattctctgtactttttccttttactattgactttacatatctacttaactctgtacctgcttcaggagagaccctcccacactgagccattcaaatggcagattccatcatcagccttaccctctgatctcgactttcgggcacattcagttctcgccttttgggcccttgtctctaccgtggagttacaagttgagtcatctttcttttgaggaacctgatccacccttttgagcttcttttggattccgtgtctagatgaggctgtccctggaccaaataatgacttgttaatagtttaaattggggtcttcagtgagcctcctacagtcccaatcagtgacttcccttctcatgcccctaactcccactctttcagatctctgtacccctgtacctcacttttctcctcctacttctctataattatatccttcttcttatgtgtacctttctttgcctccccaaattaccatctgctttcactcctggtatgacctgttgcaatcaactagataaagctggggaaatcctagagcttatttcctgattttcgtttgtgtcggcctgcaccacgaggtggccacacagtctcgtctaggtggagaggaggtgtcttataaagcacctctccaggttcccccacggcctgtgtgtggtacaagagatttccaaaagtttctaggtgccttcagtgggcaaagtgcaaggtattaaaaaaactgagagggaaggaccctgccaagaaggcggctaccatgagggagagatggaaggtgaggctgagacccagaggaggtgcaatgccagagggtgcagaggtgagtttgcttcattgtggaaaaagaacacaattttcaccggctgttgactttagaagctgatcccacaggatgaccgctgtcctgttgaacaagaacgtttctctgcaggttagaaaggacacagagtgtgcagccatgcttcccgcacgcaagtgcggtgatatccgcaggccacttccggaggaaaaggcatgggtgaacccttaagagggggcggaagcgaaagcccggtgggacccagggctggcgggaagttcaaacacggaagttactgaatatttatccagaagaggtggggcagcctgatagagcctaaaacttgcctttcattgccaagtttagggttttttttctgcataactaaaggagggtttcggagatgagaacacttacagaaaatatgagagtgtggtatgtatattttcagcactactatatatatttttctcttacaattttgaaacatctttttatgtgttttgttttgtaaaaaataaagctgattaattaaatgtaaaataatatgactcttaaaaatatctctgttgggctgcgggcagggaggaatggggagttgtttaatgggtacagggttttagttttacaagataaaagagtcctggagatggatggtggtgatggttgcacaacattgtgaatgtattttaataccattgagctatgcacctaaaaatggttgagatgataaattttatgtcatgtgtattttacccaggtaaaaaattggaaaattggaaaaaagaaaattaaaagcacatcatctgtcacatttaaaataaaacgattcttttaaaaaacctgaaaaatttcatttaaatacaatatgaagaaaggcaaatctggaagggactggagtctactcctttcggtagcttggcagagagatgtcaaaaggtcagagttacctcaacagaactgaccatctgacactgactccagaggtttcccctctctaacaaagtcacttctctgaccagggagtgttcataattgtatagttgcatagacattccctgtctccctaatcctataacgtgtagagcattgtgagagtgggcatctcactactgggctgctggccacggggtgtgcagagtacgtatgtctgccctaaatatgggataataagaatttggagaattgtattggaaatttccctccaataacctttagtttgtatctacaccacgtggtgcccataatgtctatgaccccttttcataacacaataatgaattcataaactatcctttgtcagatcattattcaaattttgggttacagaaagtatggtttctttcatttttttttcattaaaaaaaaattaatagctaatttgtgccaggacattaccatctagcctagaagagacacattatgtaagtaattacaatagagtatttggaaccttccaaaagagccagtgctgggtgctgtagaaattatgggaccagcttggctaatttaggggtcagagtatgtattcctgagatagacataagtcaacacgactgatgaaaaggagataactaaacatttatggggagtagtgtaggttcagaatatagcatccaaagagaatagcacatgccaaggatcaaaggggagagaaatgaaatgggaagaaatgaaagttcagagtggttgactggagttttgagtggaaagagatatattaatagttggagggtaaggcatgagttagactggatagaacttaacaatcacattaaggacagtgaacattaccctaagggcaataggaggccatggacaagatttaagcatggaaataaactaattagattttaatgtagaaaagaagagggtgaaccaatagaccttgtcaatatgctaatagagttcagttagtcacggatgactaaggtttttgcttggcacctgggtagattaagttcctcatttcaagttaaactacaacaggctcccaagggcctgtgaaaccctacataatctgattcttgtttactttttcacttcctaccaccttctttcttcatcatcaccaacaacactggtctttcctctctgcctcaggttctttgcacttttgagtccctctgcctggaccatccaatccaaagtgactcccaccccaacctgcaagtcactattgtaatcctatccattattttctttcatcctgtcatcagtacttgaaattatcttgtttatgtgctttctagtttatattctttccttcccccagccaggatgtaacctccatgagctttcccctttgttttttgcttactttcttactttctctctttaaaaaaaaaatctgtcttcagctttcagaatgggtatatacagttagtgctcactgcatatttgttggaataaatgtctgaatggtacttagaagactaggtttttggtaaagaaggtgaagttaatttcaggcatattgagactgtagtgtcaatgggagacttgcaaacaaagacgcccagtgtgcagctggctatgtgtttcttgaagacaaacctgagttgaagacgtagagttgggagccatcagtataaaggtggtaattgaagttgtgagagtgattgacaaagctcagaagtgtgagttgaataatctgactagtttacaatgaaccaaggaggcccatagagaatacacataacatggtgagagggcattgactaataagtagaatgggggagaaagcagcttgtctctccttcctgcccaggaaggtcacttacttttcttagaatggaatcatttctgttaagtgtcttaaaaggacaccagccctgtgattttggacactgggatcatactaatgataaactaagtcagggaagaggagctttaagccactggcttaggctgccatctattgctctgtttccttttacagctagagttgtctacatatgttatcacctcccattcattatccttcccacacaactggctcctgcctccatcaccaaaatttttcttaaattttccagtgattctttgtgaccaaactcaaggccctcttctctgaatttatcttagtctctcagtatagtcaaccattccctcttggcttgctaacatgttctttcttggtgctcctctgtcttcactggtctcgttccctcagtctgtcttgctagattcctcttccactgggattacttagagcagggctaggtctgtggttctcttttcttctcccatagatcagaatacctttattttattgataactcatatatatacatatatctggtccagatattatatattatctggtccagattttatatatatatatatatatatatatatatatatatatatatatggaccacactttttcagtgagtgccaaattgccatattgtggggaatataacttcctgatttctcagtgttcctgtaaaaagccctagtcccggagacacagaaatgtatgcaatataaatataggaaatacttgctttcacttccccagaaacattttcctcttcccacaccatgagaattagagctatagctatttttctagttaattactctgatctagagggagaatagaacctctcttatctcctgagatggccaaatgggttcacccaggactagcttcctaggttaaatcctaaagtaccaggaaaactggagtggtctttccctaggtatttatatatcacaaggggtaaagcccagaacttggagacatctttaggttgtaaaagccagcaacacctagagtttctctggcctttggaaagatgcatttaaattccaaaggttaggatggagagctttggaacgaggatcttttccattttatctcaaagcagcaaagttttttcttttcctttcaggaggaaaggatgatggctatccctctcatgtatctaaacagaaaaatccatcattctacatcccttatacatgagttgtagtctattttgaatagaaagattccattagctctcttagcattgcctttgggtttgtgtatgggagacagacgctgcaatattgctctggctgataagctggttgtgaatatcagtaaagaattattttccctgaccagataccttgtgttcctgcagcactcatatatataaggagataccaatgcaagtggagtaacatcttagaccctttacagttcttgacaaaacacacatctatacacagctgcatagatggctagcagaaacctctaaaggaacaggtcaataattgaactctaagagttatcccccaatatatttgcatcttccctcagcaatgggcattaccacttacttgttcaagccagaaattgaagagtgggccttgatttttctctttctcatctgtagctaataatatgtcaaatcctgtcaacaatacctgcaaaactgatcttgaattggcactcttctctgcatctccactgtcagatctgaatccaagccaccaagaactctcatggcatctgccccaaaatggctgccctgcctccattctttcccagctccaactcattctttacaccgtagcaaaattgagcttacattgtgtcacttcactgactaaatctcttcaatggcttcccattgcatttagaataaaattcaaccctccacagcttgacctacaagccctgcatgagctgtttccagcctccagcttcctcttgtactctcatcttacctcctgggaggctttttttcttatgtctcctttttggagttgaccagatacatctttttcttttctttcctaaaaagaaaggataatgttttatagttacaaacattgatctcccaatcttgtatgtcaatgatattcagcttttacttttggtcttcaaaccacattgctagaagttcattggtgaccttaggtgatggtacttcagggagtaataggggaagaaggactctaaaatgacagaggaaaaggagaaacgaagaaatagagacagggagtttaggtagctcatttctagaagtttggttgtgaaatgaaggagagagatatggaagtagttgaagtgagatgagaatcaagaaaaagcattttttaatgagctgtgatacatgtaatgcagattcttgtgtgagacatactgctttaatgaatacttgagagagaagggatcatggatactataagatgaggcagaaggattgtcttagaagagaaggagggaactcggagaggagggagacagatgtagttagggtttgtaggactagcagcacaaataaggggattctcatctgatatctccttatggtgcaggagggaaagtcactgattgagcaaaaagcaggaggtgagggggtcagaggtttgaaaaatagggcttgaggtttgaaaggattattgcaggaagtagcattgtcacacagtaaggagagatgatttgtgctggaaccatgaagaccagtgagtgcactctgccctgctgtggaactctctccagcactgctggctttcagatgcagtgtacaggaagtaggtaagtagggtcttccaagacttgccagagagttctaggaaaaggcagagaggaaaggcaggtttaagataatggcaatagattactgaaatgatgaatcttggactgtgagttagtgtcaatgttaaaaagctgggaagcaaagaaaagcagatgatggcttggaaggaggaaaggccagtggactggtgatccaaatgaggttgaaggacaacttcagaggaaacaacaaataaataagcacagaaaaatatatttttgattctttttcttttgttaggattgggctgggaaagagtgatcagaggttgaatgatagctataaaaggagaaaagctcaaggacaggtatcaaaaaaggaattctgaaattaactgttgggaaatcgagccaggtttgaatgacgatagggtctatagcttgcctttgggtatgggaggccaagaattggtggaggaaaaagtcatggaaaatgagaagatgaaggatttgaggggccagagtattggataacagagttgtctgttatccgtgtgtaccctgaaggcatctaggatgatgctgggacttgaaatgacagaaaagcagcttttgaaaggattattggggaaattattggatgatattgatgatgagtgagtgaacattttaattgaatggttaagactcaaaggagaggatcagggaggaaggggctggatggggccagtaggcagcaaaggacagacatctaacctgtctctcaccatgaggtgtgagtgatggatggcagagaatgcctagccatgtcttaagaggaagtgggttcctctctggggaaccaactttcagttaaagagggaagtgcaattaacactctaagaagttgtgaatataggagattgattttttcagaacaggcaattccaatggcatatttcaatacccccaaatgccttctggtttcctgataattttcataaaggcctttttggaagatgcagcaaatggaaactgcagaaacgaactgtgtgtggcatcaggactgtggtcacatagtggtgctcttgacaagatacagtcagaaaaacagaaagcaactctgaattcacccttctgacctctacagaagaaaggcttttcttacctttcttgtctgaaggtgtgctggacacctcctggggctcttctgggtcatttggttctggagaattatctcttatctctgacaaaagaaatataagtcatttcagagctcagatccagtgaagagaaagtgctgagggaagtcaatgcaagaactagaaaagtagaaagtacatgcagcccagggccgggaatctgcttgccctaagaattccctggctctgtcttgatttttgccaacttgtggttattgttacctgtgcgaccatcacagggaactagggcacaactgccccacagcagaggctcagtctgatccttttagagagattatcttatggatggaagagaagtgagtgaagaaggtgcaatgaatggaaattgcaggaataaactgtgctgggtatcatgactatagtcacatggtttctgctcccagcagcccctgctcaaggaatgaagctgagagcggaaagtggtgatattgaaatctgatgtccatgatgaaggggaatgtctttgctgtatgaaaaatacatcttattgctttgacgtctatgtgtggatattctttaactgctctatctgtggttattttacttggagaaatagtggagaaggctaaatgccttatatatttctgtatataaggattgtttgaagaaagcaggagctagcctgtgcttgctagcacctgttaacagcaaagacatataaagctctgctagtttttgctgcacaaagaaagacagagaacttgaagccataacaaataaaggctcatctcacatgaagctgtcacctttttctttacacactgcattgagattggtctcaaatgctggcctgcttaggaataggtgactgaggcaggtggcaagcagtcattagatctttggaataatttattacctttcaagttatattcataatatcaactcttaaactccaagtgatatagaaatgaccagggttgaaagtgaaaattccccacagtcaggtgggggcttggaaggaggaccatccatgtctgctgcagcaattcactattagggccacacagtgtttttgttcatttgctttgcattttgacagagccgttttgagcactactttattgaagtggcctcagaagagtggctctgtcaaacagtccagcctgactcagttcccttgctttcccctggggttcctgccacaaccctttgtggcaggtgaatgtttccctttcaggcgctttgtggcatttggagtccaaacctacaggcactggtggggctctgtccatcatcatccgtggccctatccaagtctaccttttccagacttgcctcctttgccctcccccagggactctgtatccattcagaggtcgggtctcctgcctgttcaagctcccaagtgctgggtgaactggaagctgggccaagattgctgagaggcaggaggagagccccctctctagaagatccgaatggcttttcctcttagtaaacacagaaacaaaggcaagcttttaggttgaccaaaccaagattacctggcatagagcccaagggagagtggggcatctcttgagggtcttctttatctcttatttgggggatcaggttgtcactggccactgaatggaggaagaaaaagttttagatctcaggaacagcaagcagggaccagaatgaggagaaaagagaatgctctattccaacaagtaaaaatgacggggtaacagcaaccaaggcctgggaaaggatggcatagagtgggaaagtaagcaaccattcactctcaattagccacttgttcttccattgctgttagcttcctgattatgttaacctttttggatggtaggtattagaggagtggatgcaatattatttggatcgaagaggacccctcttctcagtactggagagctcagaatccatggtatcatttttgacaatgcccaatatcataccattcttacgtttaatgtaatcaaactccattatgatgatggtttggggaggacaagtgatacaatttgagaagctaaatattaggtctagcagacctttaaacattttatcatcttttctagtaattttgataacattgttcttagaatccaaaccatataaaaatgaagaatgttgaaactctaaggcccccataatcaggtgggggtgaggaatcagctaagggtcactagtgtgagtgttacgcaggttacttgtcaattcagaatggtgttttggttgttggtttgttttgcattgctgcgttggtgaattggccccttctgtttcttttcctttgtattgctcagttctttttcccagggttcccaccatagcctcttggttggcagacgcatgttctcccttcacagtcaccttgagctaagcggtatcagccccagtcagtgttaccttgcacagtgctagtgaggaggctgggcatctcttctgagtcttcttccgcattcattttggatgttaacttgtcattggtcactgaaggaggaaaggaaattattacagattgcagggactggatgtcagggagaagagtgaatgttaaaagtgcctggggcagatagagcatcaaggcacaagggcagagggttggaatgtcccgggagtgggaagcaggtgttctggactctaggtcttacccaccccccggcagtgctcataatccctcttgaaaagggttgtgtttgggtagatgggtgcaagagaagaactaggacaataaaagtcaagatgctgggattggcggcaacatggcacaggcaccttaggctgaggatatacaggtgttggatgggatctgtttctcacctgaagtgcttcttccttcctggatgagtgcagggagaggcaggacagggtcagatgggctgggcgactcactcaggatctcatcgctttgctgggaggatgttccaggctcactgactcttggcgcacagggtgaacagcttggttgagggggttgtggtgggggcagcgccagtggggtatggagggagcttccttctgctaggccagttggggcttcaagtaggattggtgtgtctctgctctgccattcataggaagcaccaactgggattggtgaagggacacacatcagtaccctggagactcagaattacttggggaaggggatttcttaatacatgccttccaataggatgggggcatggagctattcattgtcccccaggtgcagagaactgattcattgtcatcattatccatttgtggccccttaatattttatttatctggtttgggcattgagtgctacaataagtgcatctaagccctgatctaataccaaaatggtttcacacataaaagttgagtttgggtttgtacccaggggtttaacttttctttaatcttggtgtcatataatttagtcaataatgaacatgctatagttttaaaagaggtctctgttttaataaataaacagatcatacttccccgaagcaaataagagaaaataaaaattccttagcagggtgtattaggacatttatattctggtttctgctcatttctgcagagtcagcttctgtgccttctattgtaccctgtgatctggtcacacccagctttctctcccatccacaataccccagacccttggctttctgcatgctattcccttgcatggctagtgctgggtttctcttaagattcttctccatcatttatttcagaagtaaatggtctcaaccagtgaatggaaaaaggaaagtaacttcaaattttggaaagggattcagaacaaaatcatcaggttgaagatcccggaagatgactgaagctcagccaggtcaggggcacatcagtgtgtgggtccccatggttctcagatgttcttaccatagcctttaaggccatgcctctcctagtattgcccagatgctgccaggacagtgggccctctgtagctgcccctacctggaggtggacttgcccctttcactgtccatgtagctcaagaaatcatctctcccttcagggggaagccttttgatggtgaagtgtcagagagcaaaggaggaactgtcaacaatggtgattccactaatgaaaatatccaatgtgagctggtggtcctttgcttgttgttctgaggtaagtgaacatgtgatttggccacagtgttttacttccaacctaaaatgactttactgcctctctctttccctggctgatttcttcccaactctgccactgttctttttcctactcctttatttatccagtctcttttctttctctacgtacttcatgatccattctttctcagaccctctctttctgtggctatgtttgcgattcactccctttctctgtagctaccttttttcccttctctggctttacaatctgccttccagctgtccttgtccggactagtggttaaaatcttgggccctggtattgggagacccaagtaggactcttgctctgcttcttaaccaacaagtaattttgggaagattacctctgggctttaatttctctgtcagtcaaatggggttaaaaatgacttcaaagggttgttttaaagatgatgtgagataatcaaataaagtgtttgcgataaggcaccaaaaaaagatacttattattatccgtccacattcattttttcttcctccctggctctccttgtccttccaccagacctgatctttgtaactttgcatttctgtcaccttatgcattccctatagattttccagtatgccaaattgtatgatttttttccaaattcatagaacacataagaaatgtttatgtcctctagaagttcatcttagagagttgggatcagctttagcaaggggctgctcctgcagctgtaccaatgagagaatatggtccattccaccccagagagaaggcgggggattaacgtgcatattccacagggctagaagtaaacccagacttttaccatagcaactttttaaatgcaaaaagcacttgagaaatctcattaccacgtttgaagcttctgtaaatcgtcaccagattgggatattcacgcaggttaatttgactgaacaatgtcaccagaagagacaggttaaaagtcctctccagttgggtgagaatgttgtgcaccactctggatacagggatcaaatttctacaggcttccagagattcctataaaaatggagtgaaggtttttataaatgactataaaattgaatgggaagttatacatttatggttttctaagttttaagaaagctaccttactcttttaagaagaaattcaacataaaatatatagtcacattctctaaggtagagcggtcacagttttacatgcttatttttgaaactttacacatatttggatgactagcaacaaaaataaataatttagctttcttaaagtaagtctatattctgaatccaactttcaggcacatttgagacgagagaaatttgaaggaaggaaagtggggttaaaggatgctactatgtaattgattctttaaagctgtgggcaggatacttcagcaatggttctagtgatggtcacagaggcaattctgctggttgcttgtgagcctctgctcagtctctctctgtgtctctcaaacttgagataagcctgaatggattccagccacagagaagtcaccctgagaattttccttgcctagaggatggacaaaaggagaaatacggcaagagagaactgattgcaaataattattgaacatctactaggctcggtcagcgagtctttgggtacacagcactgaataagaccaacatggagttgcctatatttgggggtcagggtaggcactgtcaagtggagaagatgagcattaataaacacaaataaatacccatttacaattgagagtagtgttacggagggaaagcatagattgctatggaactgaataactaaggggtcttcatgagatgagttggccaaggagatgtctctgaggagtgctctctgggctgtgatctgaagagggagttggggccaaccagactaagactaagggaagattattggcacttccttgagtctagggctcaattaatgcttttaaaaaccaaaattatataaaaataggtccacttttgtccacatagcatatctcccagtgcctgcctgtctcacatcagaatgcactgtgagcaatattagctgttataaattgggatgatgcctgtagtgagttgaatgttggatggatatatctcagccaagatatatccatctagaatctgtgaatgtgaacttatttggaaaaagtgtctttgcagttgtaattaagttaaggatcttgagataaaatcatctttgattagggtgaccctaaatccaagtgtcctcagaagattaggtagaagactcaaaagagaggtgatgtagagatgaaaacatatcagagtgatgcatctacaaggcaaggaacactaaggatttccaacagctaccagaagctaggagataggcagctatcggattctcctcagggcctctagaaggaaccaaccctgtcaacaccttgattttggacttctggcctccacacctgagagaatatatttctgttgttttaagctacctggtttgtagtcattgttacagcagtccttatgacaccctagaaaccaacatagcccctatgacaccctctctcctaactacccccaccttctgtgataatgaacatgcctgggctgggccttccaaactctggaagccctggtggtttgtggtttgagactttaataatcaggcatattggtgggggctgggctgccatggaagggttcaacatgactcaccatgtacattctcttagtgatgatggagttgtctaggaggccttcaaagaagggaaatggcttgtgtatggcataggcgatccccagcttctggtgcatgaagtgctgaaaaagagcctcttccatggctcttgtcatggtgaacatcctatggaaagaggcatgataaaaaatagaagcaaaggctgggcgcggtggctcatgcctgtaatcccggcactttgggaggccgaggtgggtggatcacctgaggtcaagagattgagaccatcctggccaacatggtgaaactctgtctctactaaaaatacaaaaattagctgggtgtggtggcgcacgcctgtagtcccagctacttgggaggctgaggcgggaaaattgcttgaaccggggaggtggaggttgcagtaagccaagattgtgccactgcactccagcctgggtgacagagtgagactccatctcaaaaaaaaaaaaaaaaaaaatagaagcaaaaccttgaggaatgtgggaagcttctctctgcattaaatgggcagatctaaaggtaagcattctggtcccaaaggcatccttagtagcctgcaaagcaatgtctgcctaaaaggctcatgggtataggaaacaaggacaattcccagcaacaatggaggctgagagtgactgaaaatataatgacagaatcccaaggcgctgcaggtaaacataaggaaggtattaaaagtagctaatatttatggagtgtttcctgtgtgccagactttgttctaagggtttcatatgcagtaacttatctgattttcataaaacccttgcgaggtggttcctatgactgcacctgtttatactgttgaggaactgagacacagaaatgtttaataacttgccccagggttgcacaactagagagtggaagagctgggagcaaatcctgattccaggcttacagtgctaactatgtgttctatggccacactgatctgggttaaacaagatgacctgggctacggctgaagccattaactagcaatgctcatgcaacagggaccaccctaaaatgggtagagttcagctggaaacctggtaatatttggaaactttaacgaaccactcccaatcttcaacacaaatgggccaagcataaataaaagcatgagggctgagaaaggcatacttagtaaaagtgacttaactgacttgttcactgcaaccatttcatgtctcagacatgcgccttttcccatgcccatgcagcatgtattaaagattggccatttatggactgtgaggagatatcaataggttataatgggaagaaagtttacaaatgacattcttgacaaattgtcaagaaaaggaaaagcactaacaaaacattcaatcaacttgacagtttttaacaaacagaacaaacatggattccacttttccaacttcattttgtgttgaacagaaaagtaaatcgtaattaacaactgtttacagggatttaatcccagtggcagattaagcaccctagtctctttctcctcattccccaatttttttaacttggcagaaaaaaatactcatgaaaagaataatccgcaatcgcataggaaaacaagaaaagatgccattgagagtctgtggtggtaaagaagtcttggaagatagagaacagataggagagaaatctactatccacaatatgcacaggggaaggagatagtgcaaagatcagtgcaaagtcagagaaaggcagagtaaacatatactaagaagaggaaggggtcttggaggctccttttagaacaattcattatacagcagcgctcagaacaggaagtctagagcttcctcattcttcatctgtcatgagtcccaaagatgaaagggaggcacagagaggtttagtaactcacccaaggtattcagtggcaaagcagagcttgtctgactctaaagccctgtttctttctatgcaagatactacatctcatatatgactgttcagatttttattatgtaaagagattttgcaaacgaataagcaaaagacaaacatccaactagaaaataaaaaagcaaaatacatgaacagagagtgataaaagaataagccaaatgtgcaatgaataatacgataagcatgttaactagctagtagaaagcataaagaaggccaggcatggtggctcatgcctgtaatcccagcactttgggaggttgaggtgggcggatcagctgaggtcaggagttcgagaccagcctggccaacatggtgaaaccctgtctctactaaaaatacaaaaattagctgggcgtggtggtgcacatctgtagtcccagttactcaggaggctgaggcaggagaatcgcttgaacctgggaggtggaggttgcagtgatctgagatggtgccattgcactccagcctgggtgacagagcgagactccgtctcagaaaacaacaacaacaaacaaccaaaaaaagtgtaaatgaagacaatttgataacatatttgtctatcaaattggccaagatagaaaataatagtaataatctcagacactgtgagtgggaaggtcaacaggtccaaatgttctgaaggctgatttagtaatcagtgtcaaatgtcctaaaacatgtgctcctttgaatttccacttctaataatttatttcaaggaaataatcatgtatttagagaaaatatataaaaagttcatgatacactagagacgaaattaaatgtactctcatttttttcttttccaccagcttcccaagtacctctagtcatttacacaatggataacagatgagccgcctattgcgggcactgaaggatcagagcttaggtgagggtagagggcaaatctcggctccattcacaataacaggctggactctggcgaaaaaaagaggtgtcagtgttccctccatgtgcccccttttaacagtctcctaataagtaccacatgtctgagctctgagagagcctcagagtttaaatagttgaactccaccctgcagctgctgccgcgaagttaactctaagagctgcagtcaccaagagcgaagaataaagcagcaaagacagaaactcacctggactttgagtttgtcgttcctgcccctttccaggggctgggacagggatcactcctcaagattgggagagttacagggagatgctagcaggcaaaacaggaagtctgtgctttgacaaacgcagtaaggggccgggcttccgagaaaagaaaagtgaaagttttcggagtttgccaagccggaagctgaaggcaggtcggtgcctgcagcctctctccacctcctcatgggcacttgtgaggctcccaggacgtcttggcagttggggtttgggggagggcgtgttgccagttgggatcagcccagagagggaggtatgggaggaggaggcataagggtacagccccagcggcaataggaactgggaactcagcgtccaaatgcttccctaaccacatctattttcccatgacttgtcctcattctgtacattttaggttgatgaaaatgttctcaaactggattgtggtgatgtttacataactgaatgaattcactggaatttatccagtgtgttatcaaactctaacaacacacaaaaaaacaaagagaatgtgccagaaatgcctagaacttgtcaggataagattattacaggaagaaattgaaatgaaagggaacctgcacatgaactggaattgtgcagaggcaggcagacctccaggcagaaaaatggctgagagctgggcaggtagttgggagccaggagtctgaggcagaactgggacctgctgattccagagagcagtaactcaagggctggcagggacaccccttctcatgccccttttaaagatccctaatgtacattgacatgtggggcctatgaaaaatcctaaactattggccaggcacagtggctcatgcctataatcccaggactttaggaggccaagatgggaggattgcttgagcctaggagtttgagaccagtctgggcaacatagtgagaccccatctctacaaaaaataaaaaaataaaaaattaactgagtgtggtggcatgcaccttgtagtcctagttagtgaggaggctgaggctggagacttgcttgagcccaggagttcaaggctgcggtgagctatgattgcaccactgcactatagaaatctgtgtaactttgggccaggctcggtggctcacgcctgtaatcccagcactttgggaggctgagatgggtggatcacaaggtcaggagtttgagaccatcctggccaacatggtgaaaccccatctctactaaaaatacaaaaattagccagatgtggtggcgggaacctgtaatcccagctacttgggaggctgaggcaggagaattgcttgaacccaggaggtggaggttgcagtgagccgagatcgcaccactgcactccagcctgggtgacagagcaagactccatctcgaaaaaaaaaaaaaaaaagaattctatgtaactttgattaaatcaataattctcaaatgtatttgacccacaagttcccctaccaggacatccacaaactcctcagataaaagatgggagacatggatctaaagtttaagaagctttgaaaccaaggctaactgcataagagcaagcccttctatgcaggcacaaacagcatatcccaccctagtatgtacagaatagcagacccggccttgcgggtaatggctgtgggtgaaacagaggcatggaagccacagccaggaaaaattcaatgctaacagctgaggagagggtgcattgatgcctcagcatgcagtaacatacagcgctgtgatgcaggggatggcggtggtaaaggaattaaggttattttatgcaaatgtcacatgtcacttacctgaagcccctccccatcacctggaaagccccttcatgggcatctgaggatcctggcagcaagaacttcttcctttagatctattcagagatacaccaggcaaatgcaaaacaaacaaacaaaagtaaagcaggagtgggaaaataaagtcaatgtcaaatcaggcaaaaattgttacatgaaaaaaagacagctgcgaatgaggatgaaagatgtttattctaagccatatatgcttggctgggcacagtggctcaggcctgtagcttagctagcactttgggaggctgaggcaggcagatcacttgaggccaggaattcaagaccagccttgccaacatggcaaaatcccgtctctactaaaaacacaaaaaaattagctgggcgtggtggcacatgcctgtaatccgagctactcgggaggctgaggcatgagaatcgcttgaactcaggagctggaggttgcagtgagctgagactgcgccacagcagttcagcctgagcaacagagtgagatcccgcctcaaaaaaaaaaaaaaaaaaatgcatgcttgagaacatggtaataatgggaaaacgtcacctgttaattcacatgctagtgattatgtactgagataaattatacataattctttttagctccattttattgaggtataaaatttattcattgtaatgtacattttaccaaatgtagttactacaccagtcaagatgtagaccatttctaggcctggagagtcgcttgtgcctataatcccagcattctgggaggtcaaagcaggaggatcgcttgagcccaggtgtttgagaccagcctggacaacagagcaagacctcgtctctacaaaaatacatttttttaaattaattgggcatgttggcatacacctgtggtccccgctatcagggagacagaagtgggagaattgcttgagcccaggaggtccagtctctggtgagcagtgacagagtgagaccctgtctcaaaaaaaaaaaaaaagatacagaccatttctgttaccctagaaagttccctgtgacctttgcaaacaatcccctccttaaggccagcaccaggcaaccactgatctgctttctatcaccacagattagtttcgtgtgtattaaagttttttttttttttttttttatcaatgaaggcacatggaatgcatttttggtgtatggctttcttttcctcatcatcatgcttttgagattcatctctgttgttgtgggtcagtaatttattcttctttagcaggtatgctagccaccaagatcctgctcatcctgtctgatcagcatgatgtcatcaatcagtctgacttttttttttttttttgagacagagtcacggtctgtctccaggctagagtgctgtggcgcaatcttggctcactgcaacctccgcctcccaggttcaagtgattctctttcctcagcctcctgagtagctgggactacaggcacgcatcaccatacctggctaatttttgtatttttagtagagatggggtttcaccatgttggccaggatggtcttgatctcctgacctcgtgatctgcctgcctcagcctcccgaagtgctggggttataggcatgagccaccatgcccagcccagtctgacattctatgggatgtccaggtgatccagatatctttcaactatattatgacaaagggcaagtgagtcaatataacctgcctggactgcctactttcttaacctagtcctctggctttcccatacattctgtgagctacccaatatagttctaagaaattgactttttgcctgagttagccagagtcagtttggattacttttactcccaaatcctgactgataaaaatgttgggcaccagaggttgaattataggcaagagatattcaaggaaatatgatcaatctgggattggttatctgacataattggacataaaaacagtgaacatccccattagcgttcagagtcaggaattttggagttgtgggcaaataggggtaagttggcaaattaaattacagcactggattgtgatcaagactctatacaattcatttccccaattccaggtgtcagattctagcatgcttagcaaaatgaagagaaatcttccaggtagaatgaaagcattgatttacctttggggattatgacctacttggcctaaatctggatgggggaacagagccaggaggcaggccggagccttctgactccactggtcacgtggcagtaaaggaagacattgggaaccagagatggtctgatggtcctacatatgcctggcccaggaatcccttacccaggagaggttctgtagtgagcatagggaaaaacaagatagtgggaaatagaactgaaatttcaggctatccttacctgggctaatgcatggtgttgcaaagtagggctttctagtagtagcagcagtacccctgaagtaccaatcttaccaccagtcagctgaggaacaccaatggccttgtgcttataagcaaaagaagctggcacattttcaaaaatgtccagttcattggtgtcctgggtctgcctactgcctaagggcagagagaagagagagaggggatgctggagcaggcggtatagtctgtaccaggccttgttggagccccatggagactgggaggagaggacagctgtgtctaacagaagcccagcatacttttccttcttgttttaaagagggagggagagggagggagagagagggagagggagggagagggagggagagagagggagagagagggagacagaggagagagaggacagagagagagagagagaggagagagagagagatactggaaaaggtgtcctcatcagtgttctagagtttgtctcaaccagattggtgtttgttcctttggtagaaagaaagcagaagtgtggaaggggtagaaatttcttgcactctgtattttgcaaacttatgtatgcaaatttccttgcatatgtgtaatgaaccagaaaaagtaggattcaggagcacatgttttggaaaaatactgctttgcctctggcttttcaatcctcactactgttctgtcactggccctggattctacccataccctggctctcatcagccccctgtctttgacccatttttctgcctggatttctagtcctgtggttatattttttatatttgccctttgcttccatttgtttatcactcgactttatgctgatatagtgtgtttttgtaaattgtttcaaatcctttacagaatgagggctgggtataaatgaaaaattgtgtgcaaacataaatgtaatacagctatcctcctgtatcatattgtccttgaaggtctagataatctcagctccaaaccctttccccatccagtgagaaggctgtcactctcctcaagatttcagtgaaatggttgaagctcatttttttcccagtcacccctggctgctgttgtaaagtgcccacatatttgagaaaacttagaattgcacctcatttctctgcccaacctcagcacttgcctttggctggaggagttgagagagttgtcttttacctctgtctgctttcatggagtgctaagagcatctcccccactttctaatgcatgctatttcagttctccctggccccatgtccaaacactgggcctaagccatccagcccaggctcactaaggtgcatggccagccctggagcctgactgaagatttgaaatgtctggtcttcacttgtccttctcagccacctcagcaaggggtggggacaaatacagagtttacttcctcctcatgatgccaccttacctcaaaacaactttgatctgcttgagttgaatgacttttccaccctctttccttggcaggaacaagtgaccctgtcttccgtggcctcgtggggctggctctgctcctcctcccttgactgagagacgtcatggagattgggtggagggaggactgtagagttggtgcacccacgtcagctagttaggcaatttc

SEQ ID NO: 2035 - DNA, 43639 bp, Homo sapiens
  source 1..43639: mol_type = genomic DNA
tgagctttttcatttaatttttattttagagtcatttgcttccccatcccaaattaactatgcaaattaattgttttgaagatgccatgcccaaatgtggaggtgactcagagcttggaaactcagaagctctaaggtgagcctccagacagggaaagtctgcaacatggtgactgagagggtagtagaaattcacttgctatttaactctctcttgagatttattcttggaggacagagcaaaagtccactctgaaagacagaaggagtcaatgaatgaggttattctggaggtttttcttttgtagatactggccttcccacttcctagtgaatgtctgtacccagacatcacactggatctcaaacccaagaagtcaaaaagaaaaattagctccctcccccagtcagtttttcttctggacctcacttagtgataaaatcactttttcccctgtcactcaaacccacgaccctagttcttctttcttaacctttcccatccattcctttctccttccatttctccctctctagattaaaatctttaggatttcatcctagtgataatttcttgagtgttgctgagagaggccttgtgttgggtcctgtcatcatagacactagttgttctcaggacaggaatagtgtgctgtggacatgcagcggagagacagaccacggactgggcagcctggaaatgctgcaggggggccagatgagctgggccttgagtagatgtcaggtagaggatgcaggggagtggttgcaggcatctgtcttcagctagtttctttttaggttcttacatctctcttcacctcaaagccctttgccggcatttaaagttcctgtactcctttacttgcatttaaagttctccaccatcaggaacaatatgtgctcctaactttgtcacccacagttttttttctatgaacatttaactccttataaatcatgctgttgaatcctaacgggagctcttcacatttctgctcttaaagctccacttctccttcaaggatttaaacctgtcacctatctgtcccgtcattataataccttcagcagctctcctagggtcattccttcacaacgtatattccgtttccagttctttgcgttccttccttttccttcgacttcaaattcatttggtgttaaccaagttccatcctcattccgaatgcacttcactgaggatcctgtaagaaaaagcccattcttggatctacccccatcctctgtgaattcaccctgaacctcttcatcctaattgtggccttctacctttccaggtcaagagagacttcctctgtgaggtggaaggagtagcaggggagtctgcgggcctcttctcttggactgaagccagccctaaagcctgactgagtggtgaggggtgggacagaatgtgcattcgtgtagtgcctacatgcagcaaggacatggctgtcagtacagcagggcccatgggtgacttccaggtgggagtggagggtctgattgccagaaataccatgatgtggaagagtttggaaattccttcctaagaagcgtttcttctgcagtctagctagcagggtccatttcctgatcaattacacacacgggtattttcctcccttctagtgagtccttcatctagggattccaaagagcagaagaccaaggaactcaccgtgtttcattttcttcttatataaaatccctttcgcctcaccacaggtcacggggagcttagaacagtgaaaatccacagtgtcacttttgggttttccttaaagtagaagagaacagttttgtgttattcagtcttcactccatcttccttttgaattctcccctccatgaattccaataatgtacagggtattggggaacgttctctggttagtttgcaggaactctttcatctcgagtgacagataagctatgtgtacacagtggcctgcaacaaaccaccactgccaccaacactatatcaaaaaaaaaaacattttagtggaacatatagggcatcttcagtgaatgtgtcttaatttgcaagtgaattggctgtcactgaatagtcttctattctataagcatcctgctgatctctctgtgctgatggaaatgtttctttgcattcatgttgccagaggaaaaaaaaatcttcatttataatcttatttcctgacttaaatgaagacttgggtgagtgaggtggctggcactgaggggatggtgtcagtcttaattatttgctgtttcttttcattttattgcttccctgcttcttcctcgatgaataaaagaaaaccctggagagctttgaactaatttcccagttgctcatggagcagtctggcaactcagaacccctgggtagaaatccagagtttagattcaggggaagcagttgcaagagggtttaaaataaatctcagcaattcctgctgccttcccctccaacctcactatgggtgaattcattaaagagagacagcaggggctgtttctctggggagaaatgaaggggctgtccatgtcttatgttgagttacagaggatgttacacctaaaatgaatctaggagaacacctggtccaactctctcccttgcctcaaacagttattgaaagagctaaaggaaaacaaatggcaaaacaagagcattgacggaaaggtgaaggaacagtatcagcggcgaagaagccattcatttctctggaaagacacaaggcagatagagtgagactgagagaggagggaccctgagaagtgaggatgtgatccccccgacagaaccctacaggatgcctggcctcacaggagcaggggctggcagcaaggctaggcatgggggtggagggtagtgggggtgtgggaacttacggtgggaaaaactttgtttcaacagccagccctcttgcatggagtggccagctccaccatttgtctctagactcaactcagtaaatatggaacagcagatgagagcgtggccttgggagccagactggggggcagggaggagtgggggtgggaggggcttgtaatcctggctctgcaacttactagaaggattacctaagcgtgcattactgttatcaaatttgagtgggaaatttgctgccgcaggttcctaatgtgagggaaaggcagagctccaggtgactctggaccactattgcaaaccttgagggagattagcacagctctggggaccttcccttctacagttctctgtctccacagaaatgtcttctctaattccctgtggtgaatatagctttagggaacacaaatgtcccaaacacattcacaagcagatgagggagcagggggtggctttgggggccacgggtagcaagctgatgtgcagagttgtgaggacaaacatcagtcccttccttacccagtggaggcaggccatcaagtgaggtggggcctttagacccgaggacttccaaagccaactgtcctatgcctgagggcagcctgttcctaatagtgctaagtctggctcagcctcacctactcatcttaccaaccaggccttgaaggatggaaccctgcagccccaggaacccggtgggggatgcttggggctctctaacggcagctggcttgtttgaaaggtgagctgcagcagcggtgagtttaggtccccattaggaagcatgagcaaacaatgaggagcctgctgtgaaaagcaagcaattagagaacagagagctcagggaaaggaaaagcaaggtggagaaaactaagaagaaaagcctaatcgagatgaggaatagcggcatggtaaaaaacgaattcataatccagaagaccaactccaggaattcctacagaacatgaggaaggagcacaaggtggaaattatgcatggaaagaccacaggcctggggagtgatttgggagctctatgatgtatacatgaggggtctggggaggggatgattgggggtggagatggggcggtgggaggaaaagtgatagtcaaggaaacagtaagagcagcagatgcactgtgtcatctatccgcataacaatgtgtaagaaagagaaggcaatgactgtcctcattttatagatgagggacttggggtcagatgtggagagagaattgccggtggtcaccatattacatgaggtggagctggcactggaatttacacatgccagacccagtatctagcgctctttccacatcatcagaaatgccacgagactgcacatcatacaagcaacaacagcacagatactctgcatttaatgagaagttacagacagtgcagaagggagaagaaactgatgctgagggacaactgtcaacgtttgccggggctcctgcctccaccagtgtttgagagtaggtgctttctaggttcatttacatttttagtgtaaaggaaaaagggcttgaaattggaacacataggttgattttagctcattcaagtcttttgccctttaattgaatctgtaaaatgggctgataacactcacttattatggtaattaaatggcaaaatgtagatcaaagtgctttgccaactgtgaagtaatgtacacatttatatggttatcaggaccactgcatgaagttgtatgggttgtgccctgagcaaggactccacctttaaggggtgctctaattcatattagaaacagaatcagtttacctgcttagtacaacaatcttccagcagaaggcagaaaagggtttggtttcaagaattggctctgacagatgaggtagtgaattgaggaaggggcacctttttctaactcacacacatgcatcagataggcccagatactggtattcatacttgaagaagtaccagctgtgtgaggcatggggagctggacatacagcaacacacaagacccatccacttactgacctcacgtgactttcacgcagtgaacaggctgtgcacagatcattcatcacagttaagataagtgccatgaagacaaaatgcaggtctccacaagggcatgtcagggagacccacccctacctgctgggagagagaatgcttccctgtggaagtgacatttaaggtgaggtctgagggcaaaggtctaatatccagaatttacaaggaacttaaacaaatttacaagaaaaaagcaaacaacacctttaaaaagtgggcaaaggacatgaacagacacttctcaaaagaagacatttatgcggccaataaagatatgaaaaaaagctccacatcactgagcattagagagctgcaaatcaaaaccacaatgagataccatctcatgccagtcagaatggcgattattaaaaagttaagaaacaacagatgctggcaaggctgtggagaaataggaacacttttatactattggtgggaatgtaaattagtttaaccattgtgaaagacctcgaagcaattcctcaaagacctagaaccagaaataccatttgactcagcaagcaatcccattactgggtatacacccaaaggaatataaatcattctattataaatatacctgcatgtgtatgttcaccgcagcactattcacaatagcaaagacatgggctcaacctaaatatccatgaattatagactggataaagaatatgtggtacatatacaccacggaatactatgcagccataaaaaggaacaaggtcatgtcctttgcaggggcatgattacagctggaagccattatcctcagcaaactaatgcaggaacggaaaactaaacaccacatgggttctcacttataagtgggagttaaacaatgagaacacatggacacagggaggagaacagcacacattggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcactttggggttgggtgggtgagctgggaggcccatgtgaggaggccctgagcaggaacgaggtgggagcattcggtatctggtgacctatgctgtgaggaatcaggctggtgtgaccctagagacacgggtaggggtggtttatgggtgttggtgacatcctgtgtcttgagctgcgtgctgggtgtgcgggtgcattttctgtgtgtgtgaatccatcaagctgtactcttaggatacatgccattttctgcaagcacatacaccagtgctactcagtgctccagcctacgatgcgacaggggcttgatcagaatcaatgcactgctgtctccactgaggaatcttgctatgaaaacagtgtgcttagcgtcacagttggtttacaagctccttattcttgtagacctgccaagcagcatgcttgtagatggcaccagtctggggaccccaccttgggtagcacctattatactttgataatgaataaaaagggccagtgtggctggcgcctaaaaaaggaagagagggtgacaagaaatgatgctgaagaagcaaggtataaaagcagaagaaaaataaatgcaagaagaggagtgggagggagaggacagagatgcaaagagggccgagggtgcagagaggctgaagcaagcccagggtcccaaccaacacaggaaaaggaacgagaacactgtcaggctgtgcttgaataagggtttcctttaattcctagaatggaagacatagaagttcattttagaatttgacttaaaggtttagtgatcatccttaatcatttttgggtctttgtatagctctgtgttaaagaatccttccaagtatggaaatggccaccatgcacaagggggtgggttaggctggcagcactcctgatgcacccaattcagctggtacccatgacggtggagaacaactttggaggagaagggagagagaagaaggagagggcgggtggagcttccagcagaggccagggctctggggagcccagtggggaggcgctgtggcttgcttgcttacctcttcggtgaatatttttctgaaatctcctttttgagcttgaacagatatctttctcctttttcttttctaaacacagaattaataatcacttatagctacaaacatagatttataagcctcataggttaacaatcttcaagcattttttcctgtttttctaccagtttggagagacaagttacatatgagtccttatgaaaggacttccttgtagcattgactaaggaaatacagcaagctcatgttaataggcagaaaagctaaaaatactacagaagccaaatttccactaattaatatatgtcaatacatttactacaaatactagaataaagggatgtacaggagtccccccttatccacacggcatgtatttcaagccctccagtggatgcctgaaaccatgggtagtgcccacccctgcagatactatgtttcttcaatctgataaccaagacagctactaagtgactgatgggtgggctgcgtatacagcaggacacactggaccaagggatgattcgcatccccgagtgggatacagcaggatggtgcaagactttgtcacgctactcagaacagcgcatcatttttaacttataaattgtttatttctggaactttccatttaatattttcaaactgcagttgacttcaggtaactgaaatcatggatcaaaaaactgcttataaaggggggctactgtatggccttataaatatcacataggaagggctttttaaggaggaagtaatgggcataaagcagtggttaacactgggtgattttgctctcaggggatatctggcaatgtttggaaatctatttgtttgtcaggacggggaagcagctgctactggcatctaatgggtagaggccagagatgtcgctaaacatcccatgacacacacgacagcctccgaagcaaagaattattcagtccaaaatgtcaataatgccaagattgagaaactctggcataaaccatactgctaaaggtaaactgatttgtctatctaactaagcaaatggctccacaaccaaaagcttcttaagttcaaagacagaaaccaaatcagaaaaactaataattataacaaagggttaatttccctaacggatttaacaaaaaaaaatggccagtcttatagaaaaatgggcaaattcaaacagatgaccctcaaaagaaaaaattccaatgtcaaatttatttaaaaaacaggtaaattggtaacgataggctaggtaatgctgtggtaattcacgatcctcccaaatctcagtggtttattacaggtgtcagcaaactatggtctaagggccaaattggcctactgcctgtttatgtaaataaagttttattggaatacagccacgcccatttgtttacgtatttgcctctggctgctgtcacgctacaaaggcagagtcgagtagttgcatcttctggtcctttttggaaaaaatttgccaagctctggtttacaatggcaaaggtttacttctctctcatgctgtttgttcatcataaattagatgaggctcagccctacatcactgacactcatggcttctgcagacagagcagcctctgtctagaacatccctggtcttgggcagagagaaagaagacaaaggggctcttaaagccttggcctgaaagtggctctctaacttgggtccacatttctttcgctaagttatcacatgggcattcctgagtccacaggcagggctgtagacttctgaggaggtggggcactggaacactggagaaccgtaatacaagctaccacagcatgtttgatcacctgccaagtgaaaagaaattcaaagggaaacaccggtggaatatcacccttcacctttggccgtcatcatagacacatcttgttatttctagtgttggtgaaagtggagggaaagggtgtctgtatgatgtaatgggagtataaacagacaatttaggcaatttgacaacaaatatgtcctaacttaaaaatgcagacttgaccaagcaacttcacttctagaaatgaaacattaaaaaacaatcctgcaaatgtgtccactttgaggattggtgccacttccaagactgggttggccagaaccagaaaggagtctcccaaactcaagagagtagtggtgactctaataacagaaatgaaaacagcagacactggggagtagtcatgtaaatccacatggcaaagccaaggtgaactgcaccctgagaacacttcttccaacaaccactgtcacatcaacagatccgtgctctgtcttcatgtccctcttttctgtacgtctccctccttctactattgactttacatatctatctgaccctgtactgctccaagaggccctcctacattgagctattcaaatagcagattccatcattagccttacctttcaatctggactttcgggcacatttagttcttgccttttggaccctcatcatgacctctgagttccaggttgagtcgtctttcctttgagtcaccttatccaccacttggagcttctcttggatgccatgcccaggtgaggctgcccctggaccaaatagacttgtgaatagtttagtgagctcccttctcatgttcccagcccctaccctttcaggagttatcttgccatttctctataattctctcttttcttgtgtgtatctttcttccccccagactcataatacttccttctatttctctttttcaagtcctcattttgtttagtaattacaggtgtatcaattagaatgcaagctccactagtgtagggatttgtgtctgtcttgctcactgctgagttcccaggacctaggacagatacctggcccacaccttacactccactgctgaatgaatgtttaataggcactaaagttttgaaaatattaaatgtatttttctttttaatttgtttttatttcaatagcttttggggtacaagtggtttttggttacatggatgaattatataatggcaaaatctgagactttagtgcactcttcgtctgagtagtgtacattgtacccaatacataggtttttactccccctcctccgtccctctcctttctgagtctccataatccgttatatcactctgtatgcctttgagtactaatatcttagctcccacctataagtgagaacatacagtatttggttttccattccatcacctcacttagaataatggcctccagctccatttaagttgctgcaaaagacattatttcattctttttttatggctgagtaatacaccatggtgtatatatactacattttctttacacattcattggtcaatgggcactgaggttggttccctatctttacaattgtgaattatgcagcaataaacatgtgtgtaggtgtcttcttgatataatgacttattttcctttgggttgatacctagtagtggggttgctggatggaatggtagatctacttttagttatttaagaaatctccatactgttttccatagaggttgtactaatttgcactcccaccagcagtgtataaacattcccttttcaccacgtccatgttaacatctatttttttttgacttcttaataatggccattcttgcaggagtaaggtggtatctcattgtggttttaatcttcatttccctgatgattagtgatgttgagcattttttcagatgtttcttggccatttgaatatcttcttttgaaatatgtctattaatgtcatttgcccactttttgtgggatttttttctataatgtttgagtttcttgtagacgctggatattaattcttcattggatgcataatttgcaaatattttctcccattctgtgggttgtctgtttactctgatgtttatttcctttgctacgaagaagcgtttcagtttaattaagtcccatttatttatttttgtttttgttgcatttgcttttggggtctcagtcatgaattctttgcctaggccaatgtccagaagagtttttcctaggttttcttatagaatttttctggtttcaggtcttaggtttaaatttttgatccatcttgagttaatttttgtataaggtgggaaatagggatccagttttattcttttacatgtggctaaccagttttcccagcaccatttattaaatatggtgtcatttccccaatttatgtttttgtatgctttgtcaaagatcagttggttttaagtatttggctttatttctgagttctctattctgttccattggtcgatgtatctacttttataacagtatcatgctgttttggtaactatagccttgtagtataattttaagtctggtaatgtgatgcctccagatttgttctttttgcttaggattgctttggctttgcaggctcttttttggttccatatgaattttaagattttttttccagttctgtgaaaaatgatgttgatatttgataagaattgcattcaatctgtagattgccttgggcagtgtgatcattttcatattgattcttccaatccatgaacatgggatgtgtttctatatgtttgtgtcatctatgatttctttcagcagtgttttgtagttctccctgtagaaatctttcatctccttggataagtatattcctaggtattttattttattttgttgaagttgttttaaaagggattgagttcttgctttgattctcagcttggtcactgtaggtgtatagcagtgctaatttgtgtacatttgattttgtaacctgagactttactggattcatttatcaaatctaggagtcttctgaaggagtctttagggttttctaggtatatgatcatataatcagggaacagtgatactttgatttcttttccaatttggatgtcatttatttctttctcttttctgattgttctggctaggacttctagtactatgttgaatagaagtggtgaaagtgggcatccttgtcttattccagttctccaggggaatgcattagattttttcccatttagtatcacattggctgtgggtttgtcatatatgacttttataactttgaggtaagccccttctatgcctagtttgttgaggatctttatctaaagggatgctggattttatcaaatgttttttctgcatctattgaaatgatctatggtttttaattctgtttttgtgatgtaccacattattgacttgcatgtgttaaaccatccctaaatccctgggattaaatccacttgatcatggtgtattatatttttgatgggctgctggattcaatctcactgtttgttattggtctgttcatggtttctatttattcccaatttaatctaggaggggtgtatgtctccaggaatttatttatttcctctagatttttctagtttttgtgcatagaggtgttcatagtagtcctgaatgatcttttgtatttctgtggtgtcagttgtaatgtctccagtttcatttctagttgagtttatttgaaacttctctctttttttttggttactctggctaatgttctatcaattttgtttatcttttcaaagaaccagctttttgtttaattgatcttttttattttttgtttcaattttatttcattcttctctcatctttctttttttctgctagctttgggtttctctagttccttgaggcatgacattaggttgtcaatttgtgatctttcagactttttgatgtaggcatttagcgctatgaactttcctcttaaaagcactgcttttgctgtatcctagaagttttgataatttatgtcactgttaccattcatttcaaataattttctaatttccgtcttaatttcagtgttaacccataaatcattcaggagcagattatttaatttccatttatttgttatggttttgaaagttccttttggagttgatttctagttttattccactgtgatctgaggagatacttaatataatttcaatttttttcttctaaaaaaccccccaaaatgggacacacgtgcagaacatgcaggtttcttacataggtatgcatgtgccatggtggcttgctgcacctattgacccatcctctaagttccctcccctcaccacccacaccccaacaggccctggtgtgtgttgttcccctctctgtgtccatgtgttctcaatgatcaactcccacttatgagtgagaacatgcggtgtttggttttctgttcctgtgttactttgctgaggatgatgggttccagcttcatccatgtacctgcaaaggacatgatcttattactttttatggctgcatagtgttccatgatgtatatgtaccacatattctttatccagtctaaatgctggattctttatccagcatttgggttggttccacgtctttgctatggtaaatactgctgcgataaacatacatgtgcatgtgtctttacagtagaatgatttatattcctttggatatatacccagtaatgggattgctgtgtcaaatggtatttctggttctacatccttgaggaatcaccacactgtcttccacaatggttgaactaatttacactcccaccaacagtgtaaaagtattcctatttctccacagcctcaccagcatctattgttttctgacttcttaataattgtcattctgactggcatgagatggtctctcattgcagttttgatttgcaattctctgatgatcagtgatgttgagcgtttttccatatgtttgttggctacgtaaatttttttttttttgagaagtgtctgttcatatcctttgcccattttttgatggagttgtttgtttttttcttgtaaatatgtttaagttccttgtaaattctggatattaaacctttgtcagatgggtggattgcaaaatttttctcccattctgtaggttgcctgttcactctatttctagtttcttttgctgtgctgtagctgtttagtttaattaattcccatttgtcaatcttggcttttgttgtaatagcttttggcttttttatcatgaagactttgcccatgcctatgtcttgaatgatattgcttcagttttcttctagggtttttatggttttgggttttacatttaagtctttaatccatcttcagttattttttgtataagatgtgaggaaggggtccagtttcagttttctgcatatggatagccagttttcctggcaccatttattaaatggggaatccttttgccattgcttgtttttgtcaggtttgttgaagaacagatggttgtagatgtgtcgtgttatttctgaggtctctgttctgctccatggtctatatgtctgttttggtaccagtaccgtgctgttttggttactgtagccttgtcgtattgttcaaagtcaggtagtgggatgcatcccgttttatcctttttgcttaggattgtcctagctatatgggatcttcttcgattccatatgaaatttaaaatagtttttttttctaattctgtgaagaatgtagagacaatataccagaatctctgggacacagctaaagcagtgttaagaggaaaacttgtagcactaaatgcccacatcaggaagctagaaagatctcaaatggacaccctaacatcacaattaaaagagctagagaggcaagagcaagctaatccaaaagctagcagaagacaagaaataagtaagatcagagaaaaattgaaggagatagagacacaaaaaaccctcaaaaaatcaatgaatccaggagctggttttttgaaaaaattaacaaaatagatcactagccatattaataaagaagagagagaagaatcaaatagacagaataaaaatgataagggggaatatcatcactgatcccacagaaatacaaactaccatcagagaatactataaacacctctacacaaatgaactagaaaatctagaagaaatggataaattcctggacacatacaccctatcaagactaaaccaggaagaagttgaatccctgaatagaccaataacaagctctgaaattgaggcagtaattaatagcctaccaacaacacaaaacccaggaccagatggattcacagctgattctaccagaaatacaaagaggagctggtaccattacttctgaaactattccaaacaattgaaaaggagggaactcctccttaactcattttatgaagccagcatcatcctgataccaaaactgggaagagacacaacaaaaaaaaagaaaatttcaggccaatatccctgatgaacatcaatacgaaaatcctcaataaaataatggcaagccaaatccagcagcacatcaaaaaacttattcaccatgatcaagtcggtttcatctctgagatgcaaggttggttcaacatacacaaatcaataagcataatccatcacataaacagaaccaagacaaaaaccacatgattatcttgatagatgcagaaaaggcctttgataaaattctacatcccttcatgttaaaaactctcaataaactaggtattgatggaacatatctcaaaataataagagctatttatgacaaacccacagccaatatcatataaaatgggcaaaagctggaagcattccctttgaaaaccagtacaagacaaggatgccctctctcaccattcctattcaacatagtattagaagttctggccagcacaatcaggcaagagaaagaaataaagcgtattcaaataggaagagaggaagtcaagttgtttctgtttgcagatgacatgattatatacttagaaaaccccatcatctcagcccaaaaacttctcgaactgataagcaacttcaacaaagtctcaggatacaaaatcaatgtgcaaaaatcacaagtatgcctttacaccaacaataggcaagcagagagccaaatcatgatgaactaccattcacaatcactacaaagagaataaaatacctaggaatacagctaacagaggatgggaaggacctcttcaaggagaactacaaaccactcctcaaggaaataagagaggacacaaatggaaaaacattccatcttcatggataagaagaatcaatatcttggaaatggccatactgcccaaagtaatttatagattcaatgttattcccatcaaactataatttcaatttataaaaatttattgagacttgttttgtggctatcatatggtctatcttggagaatgttccatgtgctgatgagaagaatgtaatcttctgtaaatatctattaggtccatttgttctagagtgtagtttacatctattgtttcttttttgactttctgtctcaatgatctctctggtgctgacagtggaatactgaagttccccactattattgtgttgttgtcttatctcttttcttaggtctagtagtaaatgtcttatgaatctgggagctccagtgttagctacatctaaatttaggactgtaatatcttcctgttagattgatccttttatcattatataatgaccttctttgcctttttttactgttgttgctttaaagtctgttttatctgatatgagaaaagctactcctgtttacttttggtttccatttgcatggaatatcttttttcacccttataccttgaatttatatgggtccttgtgtgttaagtgagtctcttgaagatagcagatatttggtttgtgattttgtatccattctgccaatctgtatcttttaagtggagcatttaggcccatttatgttgaacattaatatcaagatgtgaggtactgtttcagtcatcatgttaattgttacctacatacgttgttttcttcattgtgttattgttttatagaccttgtgagttttatgctttcaagagtttgtattctggtgcatatcaatctttcgtttcaagagttagaactccttttggcatttcttataaagctggtctggtagtgacaaattccctcagcatttgtttgtctaaaaatgactttatttctccttcattcataaaacttagctttgccagatacaaaattcttggctgagagttattctgtttaaggagactaaagataagactccaatcccttccagcttgtaaggtttctgctgaggaatcatgtatttttcatccttgcaaatagtaaagatttccctgactattacatcaataggtttcagggggagggcagatgcttgctagaattgagaagccactgctcagttggggccattttggcaagcttagacaaaatcttgaagcacagtatttgttgggagcaaagaggaatttataaattccaaaaattacctgtacctatcaaaagaaaactttggaggtctgaatgtcaagttttcctataagtcattggtagtgaacactcagcaaatgacagagagtatgtttcctccagcctagggaggcagtggggtggggaactaggaagaagaggccagggaggggaagtgcaagcaggcagatatgactttccttctaggccaaaccccaagattgaggcatgctgggaacaagcagaaaaattagagggctttccaaagcagtgagcctcatgtcctaattcatgtttgggagctgggacaagatctcttcccaggctggctcccataaaggtacagaatccaagagaatccccactgaccggcatatcttaggccctttgtgaataattttgagtaaaagaataaagaaaaaggggccaggtgcaggggctcacacctgtatccgagaactttgggaggctagggcaagaggatcacttgaggccaggatttcaagaccagcctggacaacatagcaagacctggtctatacaaaaaatttacaaaataaattaaaaaaagaaaaagggaaaaagaaaggaacagaaagggaagagggagagaatacagaggagaaaaagaaaagtgggatgaagcagaggaaccagaaaaatgcagcttttttgtttcttattctgcaagtaacacagtttgtgcactggagtagacacatgcatgcaggcatgcaagcaagcatgggttgactgaggtagttctgaacactctatgactccaaatctaatccagtttggaactgaaagtctgaatcctgcttggggatttaggtttcttgtgtctattcttctgggctctgaccctagacaggaaacaattctaatctcaaaattgtctgatgcctcatgtccacctcaaccccattccctccctatgataagagaaaagaagactaggtataaaccaagttggtgttaggtttgctcttcctttgttggggagtctactgatggggtggcctaggggacaaggttggggctggctgtgctccaggcacatgtggctggagaggaggtcatgccagctggtcaggtgaggggcctgataaacaccaagagagtaacaatttcacttttcttccttatgtcttgggcattttttttttctgttttctttttgaacttggccatattcttttctccttttttctaaaaaagaaaaaacccacatcttttatggctacaaatattgatctacaaacctgcaatgtcattacttttttaagtaatttttttcctgttttccctgactttgagaaggcaagaaaaccatgtgacctatgtgaaaaaagtactccattttagctggaaattgaattaggggattgaataaagatggatcaggaatatactagaggactaacatttaatatatgtcatttaaaaagttttttggggacagagtcttgttctgttatgcaggctggagtgcagtggcataatctcagctcactgcaatctccacatcctgggtccaagtgattatcgcacctcagcctcctgagtagctggcataacaggtatgcacccccaggctaacttttgcatttttagtagagacggggtttcaccatgttggccaggctggtcttgaactcctggactcaagtgaacctcctgcctcagcctcccaaggtgctgggattacaggcatgagccggcatgccttattaattttaaaattaataagcagtttttcaagactagacaaagattgttataaaccatggatattaaaaggtttcctagccaaaattcagggccagaaattacacagttatgagataaacagatttgaatgtttaaaaaattaaaaatatacagaaggagcaggactgaaaaaaactgttcacagttcaaaaaacaccccgacactattaaagcaaaaacaaaatttaaatatacatagcatatagaaggttaatatccttattagataaagcaaaagatgaatggtaatctaggaaaataagcaaaaaatataagttaaaaatgctcaaggaggaaatgaagatgacaaatttatttagaaatcatctctatattactactaatcaaagaaactcattgtttggatgttaaggatacctaaacatttaaaaagttttattacatccagcattgaggatgtaggaaatgaatactcatatattgttaaagggaatataaatcattatgttttctggacagcaaattggtaacatgtataattaagatatagattttaaccaagtaagcttgtgtttaagaatcaattctaaggaaattattggacaagtgtgcaaagatacaaatacacacaaacctgatttctattttcatataaaaataagaaataaactgtccactagtaggtgattatttaaacaaattgcggtgaatcatacgtaacgtgccatgcagttaaaaaaatagataacattgatacagagatgatacacaatgaaaaaagtgatttatagaatagactatatagtatgagcttatatataaaaagaaaaatgtatgcatacttatacaaaaataaagtgggggaagcagattaaatagatgtttaactttatgatttataattttcttttttttaaaattttattattatattttaagttttagggtacatgtgcacaatgtgcaggtttgttacatatgtatacatgtgccatgttggtatgctgcacccattaactcgtcatttagcattaggtatatctcctaatgctatccctccctcctccccgcaccccacaacagtccccagagtgtgatgttccccttcctgtgtccatgtgctctcattgttcaattcccacctatgagtgagaacatgcagtgtttggttttttgtccttgcaatagtttgcagagaatgatggtttccagtttcatccatgtccctacaaaggacatgaactcatcattttttatggctgcatagtattccatggtgtatatatgccacattttcttaatccagtctatcgttgttggacatttgggttggttccaagtctttgctattgtgaatagtgccacaataaacatacgtgtgcatgtgtctttatagcagcatgatttataatcctttgggtatatacccggtaatgggatggctgggtcaaatggtatttctagtcccagatccctgaggaatcaccacaccgatttccacaatggttgaactagtgtacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatatcctgaatggtattgcttaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatataattttctttttctttgttttgagacagggtcttactacattgtcaagctggtttcaaactcctgggctcaagcaattctcccatgttggcctcccaaagtgctgggattacaggtgtgagctaccatgcctagcctgatttacaattttctacactgaagattttattaggaatattgtatcacacaagacagggtaggctgtgctgcagtaacaaatgaaaccaaattttggtggtttaacattgaaaagtgtatttctctatcacatgaagttctctgtaggacaataggaccctctgtaggactggaagtcctctgtagggccctccagggctgctgtcctctatgtggtaggtcatgctgctttggccttctggcgcctccctcttccacacacttccacaggcgggaaaagaatgtggagagctgcaatgggctcttacatgctgtgacccagaagtgacacccatctctctggcttatttgccagagctagtatagcagagctgcctcctgcaagggggatgataatggagctttccaagtgtctgggaaggggagaagaattggaactagaggagggcagtcataatgcccaccataaacatgggcagggtgagcactgctagttgttcctctttctctggtctccctttttctttagtaataaagcccctgattctgagccccttattcttatagattaaagattacatttcccagcctcctttgaagtcaggtgtggccgtgcaaccagtcctggcaataaaatgatagaatttttttttcttttttgagatggagtcttgctctgttgcccaggctggagtgcagtggcatgatcttggctcactgcaacctctgcctcctgggttcaagcaattctcctgtctcagcctcctgagtagctgggattacaggtgcacaccaccaggctcagctaattttttttgtatttttagcagagatggggtttcaccatgttggccagactggtcttgaacttccaacctgaagtgatccacccacctcggcctcccaatagcaaattattaatgatagcaaattactatctgtgaccggaagcatttagagtccttcagtggaggaggtgtgcccttctttgactttgccattttctctttagctggaacatagacatgctggctggacctcaataaaggggatgccacatgctgaggatgatggagccacatgctgaggatgatggagcaacaagcaagaataagcccaggaccctacagtgtatgacaccagctcttgaccacctacctctcttgctttagctactattattattattattattatttttttttttttttagtggggtgaggtttgctgtcacacacagcaacataatcctctttttttttttttttttttttgagacagagtctcactctgtcacctaggctagagtgtagtggtgtgatcttggctcgctgcaacctctgcctcctgggttcaagcgattctccttcctcagcctcccatgtagctgggattacaggcgcccaccaccacgcctggctagtttttgtatttttagtagagacagggtttcatcatgctggccaggctggtctcgaactcctggcctcaagtgattcacctacctcagcttcccaaagtgctgggattataggcatgagccactgtgctgggccagcaacataatcctaatggtgacagcacactgcttttagaaaagtccaggaacttttctatgttgaaaaaaagtgaaatcatgattttaaaaagcataacgctttttctggcttggatgtcttttatggcctagaatggcataataacagtaaggtaacatcaatccacaccacagagaccaaatagtttcttcttcacacttatgctctgccctgggagattttcccagagagagtttatttccattatccataggatcttggaagtaatgagaaagtaatttttgaataagcagttttctattttgggcaatagtgaattgacaaaggtttgacagtattctttctgccccttcctttctatggagaacgatggctcctgaaaagagttcctggggaccaggttgttaacccggtggcagccagcccttacccaggggatcctgaaaaaaatccattaatcctttccatatcttaatttcctcatctgctaaattggaataggtcattcaatcttctccaagggtggttgtgaaaataaaataaaattatccatgagaaaagttgaaatactactagataagccagtgcaatataggagaaactgttaaaatgataatttagattttaaggtggtaaaatttaatccatttttcctgacaataattagatatttgttgtttgaaaatcacatttgtcatgtgagagttctgtgatttttgtgacaatgaccatatcaccagcaaacagacgaatatctagctgttttttcccctctaaggatagtgttatcaacttactccagaaatgtgaataatggtagcgatagtgaggggtgaattaacatgcacaattttaccagcacatgcccacaactccaccagttgtacatgctcagtcatagtgtcacatgtgtgttttaatgagtttttcgcttctcaattttctcagaaaggccacatgagaaatatggagattggaattctaggaaaaagcttgatccatgggttggatcaagctgcactttcgacaagctgtactttcagtatagtaccatgaatatacttaggacactcattctcagtaatggtgatattgctgccagtagtggaaaaactcattcttgagtgctgagaaaaatcttatatagtgcagatatacatacatacatatggacacattacataaaatggacatatatttgtagtagtaaatatcatgggaagggtcttgattaagaaaaaaaaatccagaagggctctctagcacagtaataatgaaaaaaaaaagttaagaaatattgcctcagtgtaagacagctctgaatttagattcctggtgactgtactctgagaccagcaatctccaagttttaccttgtgtgacccttcgtggtgtactaggcgtcttctgggacctctttccttcattcatttctgaagtgccatcaatgatctctggaaaatgaaagatcttagtaaatgccccttgggaaacaccatggagaatctcccagagacccaggaaggcccttgcacactctgaagttgagtcttggaggctccaggtcttaccctcctaacaatgcatctaccaagagatttggtgctgctcatgacactgtgcctgtctgccactcaggggaggagcagaccgcagttggttagcagtggttactctaccaatggagacatccacagtggggtgcagccatctgaaccccttggccagagtctctcaaagtaaggtctgtgagcccctagggggtctgtcaaaccgtttcagaaaatttgcaaggtcaaattgttttcataatatgatgttatttgcctttttcactatttcaacctttgtacagattgagcaagagcaatggcagataaaactgctggtgccttaagacacatcaaagcagtgtccccaaatctcagcaggaatcactgcatcctttattgccacctactcactgtaccaaaaaaaataaaaataaaagcaagattcacttgagaatgtttttggtgagccagtaaaaattattaattttattaaatttctacccttgagtacatatctgacatcttaatattctatgtgaaaaactgaagagcacatataaagcacttctattgcatcctgaagtaccacagtggcctcaagaaaacacttgtgtgattgagatacaagctcactgtataattccaaatgtatattttccaaacagctgtactattataaaatcttgcattagtagaaggtccattcaaaatgcaaggtggattaatgtattttattgtaacagagtatgaagttaattgatatggtttcaaattttacattacaactaatatttaagaaactatcacttgttgagtgttggtgtagtattaaaggtgaatatccacagatatctcaaaagactgttaaattacctcacccttttaaactagatatctgtgtaaggccagattttctttctatccttcaatcaaagcaacatatcacaactgaatgcagaaacagttgtaggaatccagctgtctttttataaagctcactcacaatcaaagagatttgcacaaacataaaatgatgtcactcttttcactaattttttttgttttagaaaatatatttacttttcataaaataatgctatttatgttaacaggcaattggtttattattgttacttttacatgaattaatattttaaaattattagttttaatttctaatcaggtacatgtagatagacataaacaacataaacagaagctccttagggtcctcaataatttttgagagcataaaggagtcctgagaccaaaaaatttgagagctgctgccccaggccacagctgtccctgtgaacacgtctgtttcttccacaaaacttttcagatgcaacagatgcttgctctctttgttcctcttgttataccccatcctcattctctgtactttttccttttactattgactttacatatctacttaactctgtacctgcttcaggagagaccctcccacactgagccattcaaatggcagattccatcatcagccttaccctctgatctcgactttcgggcacattcagttctcgccttttgggcccttgtctctaccgtggagttacaagttgagtcatctttcttttgaggaacctgatccacccttttgagcttcttttggattccgtgtctagatgaggctgtccctggaccaaataatgacttgttaatagtttaaattggggtcttcagtgagcctcctacagtcccaatcagtgacttcccttctcatgcccctaactcccactctttcagatctctgtacccctgtacctcacttttctcctcctacttctctataattatatccttcttcttatgtgtacctttctttgcctccccaaattaccatctgctttcactcctggtatgacctgttgcaatcaactagataaagctggggaaatcctagagcttatttcctgattttcgtttgtgtcggcctgcaccacgaggtggccacacagtctcgtctaggtggagaggaggtgtcttataaagcacctctccaggttcccccacggcctgtgtgtggtacaagagatttccaaaagtttctaggtgccttcagtgggcaaagtgcaaggtattaaaaaaactgagagggaaggaccctgccaagaaggcggctaccatgagggagagatggaaggtgaggctgagacccagaggaggtgcaatgccagagggtgcagaggtgagtttgcttcattgtggaaaaagaacacaattttcaccggctgttgactttagaagctgatcccacaggatgaccgctgtcctgttgaacaagaacgtttctctgcaggttagaaaggacacagagtgtgcagccatgcttcccgcacgcaagtgcggtgatatccgcaggccacttccggaggaaaaggcatgggtgaacccttaagagggggcggaagcgaaagcccggtgggacccagggctggcgggaagttcaaacacggaagttactgaatatttatccagaagaggtggggcagcctgatagagcctaaaacttgcctttcattgccaagtttagggttttttttctgcataactaaaggagggtttcggagatgagaacacttacagaaaatatgagagtgtggtatgtatattttcagcactactatatatatttttctcttacaattttgaaacatctttttatgtgttttgttttgtaaaaaataaagctgattaattaaatgtaaaataatatgactcttaaaaatatctctgttgggctgcgggcagggaggaatggggagttgtttaatgggtacagggttttagttttacaagataaaagagtcctggagatggatggtggtgatggttgcacaacattgtgaatgtattttaataccattgagctatgcacctaaaaatggttgagatgataaattttatgtcatgtgtattttacccaggtaaaaaattggaaaattggaaaaaagaaaattaaaagcacatcatctgtcacatttaaaataaaacgattcttttaaaaaacctgaaaaatttcatttaaatacaatatgaagaaaggcaaatctggaagggactggagtctactcctttcggtagcttggcagagagatgtcaaaaggtcagagttacctcaacagaactgaccatctgacactgactccagaggtttcccctctctaacaaagtcacttctctgaccagggagtgttcataattgtatagttgcatagacattccctgtctccctaatcctataacgtgtagagcattgtgagagtgggcatctcactactgggctgctggccacggggtgtgcagagtacgtatgtctgccctaaatatgggataataagaatttggagaattgtattggaaatttccctccaataacctttagtttgtatctacaccacgtggtgcccataatgtctatgaccccttttcataacacaataatgaattcataaactatcctttgtcagatcattattcaaattttgggttacagaaagtatggtttctttcatttttttttcattaaaaaaaaattaatagctaatttgtgccaggacattaccatctagcctagaagagacacattatgtaagtaattacaatagagtatttggaaccttccaaaagagccagtgctgggtgctgtagaaattatgggaccagcttggctaatttaggggtcagagtatgtattcctgagatagacataagtcaacacgactgatgaaaaggagataactaaacatttatggggagtagtgtaggttcagaatatagcatccaaagagaatagcacatgccaaggatcaaaggggagagaaatgaaatgggaagaaatgaaagttcagagtggttgactggagttttgagtggaaagagatatattaatagttggagggtaaggcatgagttagactggatagaacttaacaatcacattaaggacagtgaacattaccctaagggcaataggaggccatggacaagatttaagcatggaaataaactaattagattttaatgtagaaaagaagagggtgaaccaatagaccttgtcaatatgctaatagagttcagttagtcacggatgactaaggtttttgcttggcacctgggtagattaagttcctcatttcaagttaaactacaacaggctcccaagggcctgtgaaaccctacataatctgattcttgtttactttttcacttcctaccaccttctttcttcatcatcaccaacaacactggtctttcctctctgcctcaggttctttgcacttttgagtccctctgcctggaccatccaatccaaagtgactcccaccccaacctgcaagtcactattgtaatcctatccattattttctttcatcctgtcatcagtacttgaaattatcttgtttatgtgctttctagtttatattctttccttcccccagccaggatgtaacctccatgagctttcccctttgttttttgcttactttcttactttctctctttaaaaaaaaaatctgtcttcagctttcagaatgggtatatacagttagtgctcactgcatatttgttggaataaatgtctgaatggtacttagaagactaggtttttggtaaagaaggtgaagttaatttcaggcatattgagactgtagtgtcaatgggagacttgcaaacaaagacgcccagtgtgcagctggctatgtgtttcttgaagacaaacctgagttgaagacgtagagttgggagccatcagtataaaggtggtaattgaagttgtgagagtgattgacaaagctcagaagtgtgagttgaataatctgactagtttacaatgaaccaaggaggcccatagagaatacacataacatggtgagagggcattgactaataagtagaatgggggagaaagcagcttgtctctccttcctgcccaggaaggtcacttacttttcttagaatggaatcatttctgttaagtgtcttaaaaggacaccagccctgtgattttggacactgggatcatactaatgataaactaagtcagggaagaggagctttaagccactggcttaggctgccatctattgctctgtttccttttacagctagagttgtctacatatgttatcacctcccattcattatccttcccacacaactggctcctgcctccatcaccaaaatttttcttaaattttccagtgattctttgtgaccaaactcaaggccctcttctctgaatttatcttagtctctcagtatagtcaaccattccctcttggcttgctaacatgttctttcttggtgctcctctgtcttcactggtctcgttccctcagtctgtcttgctagattcctcttccactgggattacttagagcagggctaggtctgtggttctcttttcttctcccatagatcagaatacctttattttattgataactcatatatatacatatatctggtccagatattatatattatctggtccagattttatatatatatatatatatatatatatatatatatatatatatggaccacactttttcagtgagtgccaaattgccatattgtggggaatataacttcctgatttctcagtgttcctgtaaaaagccctagtcccggagacacagaaatgtatgcaatataaatataggaaatacttgctttcacttccccagaaacattttcctcttcccacaccatgagaattagagctatagctatttttctagttaattactctgatctagagggagaatagaacctctcttatctcctgagatggccaaatgggttcacccaggactagcttcctaggttaaatcctaaagtaccaggaaaactggagtggtctttccctaggtatttatatatcacaaggggtaaagcccagaacttggagacatctttaggttgtaaaagccagcaacacctagagtttctctggcctttggaaagatgcatttaaattccaaaggttaggatggagagctttggaacgaggatcttttccattttatctcaaagcagcaaagttttttcttttcctttcaggaggaaaggatgatggctatccctctcatgtatctaaacagaaaaatccatcattctacatcccttatacatgagttgtagtctattttgaatagaaagattccattagctctcttagcattgcctttgggtttgtgtatgggagacagacgctgcaatattgctctggctgataagctggttgtgaatatcagtaaagaattattttccctgaccagataccttgtgttcctgcagcactcatatatataaggagataccaatgcaagtggagtaacatcttagaccctttacagttcttgacaaaacacacatctatacacagctgcatagatggctagcagaaacctctaaaggaacaggtcaataattgaactctaagagttatcccccaatatatttgcatcttccctcagcaatgggcattaccacttacttgttcaagccagaaattgaagagtgggccttgatttttctctttctcatctgtagctaataatatgtcaaatcctgtcaacaatacctgcaaaactgatcttgaattggcactcttctctgcatctccactgtcagatctgaatccaagccaccaagaactctcatggcatctgccccaaaatggctgccctgcctccattctttcccagctccaactcattctttacaccgtagcaaaattgagcttacattgtgtcacttcactgactaaatctcttcaatggcttcccattgcatttagaataaaattcaaccctccacagcttgacctacaagccctgcatgagctgtttccagcctccagcttcctcttgtactctcatcttacctcctgggaggctttttttcttatgtctcctttttggagttgaccagatacatctttttcttttctttcctaaaaagaaaggataatgttttatagttacaaacattgatctcccaatcttgtatgtcaatgatattcagcttttacttttggtcttcaaaccacattgctagaagttcattggtgaccttaggtgatggtacttcagggagtaataggggaagaaggactctaaaatgacagaggaaaaggagaaacgaagaaatagagacagggagtttaggtagctcatttctagaagtttggttgtgaaatgaaggagagagatatggaagtagttgaagtgagatgagaatcaagaaaaagcattttttaatgagctgtgatacatgtaatgcagattcttgtgtgagacatactgctttaatgaatacttgagagagaagggatcatggatactataagatgaggcagaaggattgtcttagaagagaaggagggaactcggagaggagggagacagatgtagttagggtttgtaggactagcagcacaaataaggggattctcatctgatatctccttatggtgcaggagggaaagtcactgattgagcaaaaagcaggaggtgagggggtcagaggtttgaaaaatagggcttgaggtttgaaaggattattgcaggaagtagcattgtcacacagtaaggagagatgatttgtgctggaaccatgaagaccagtgagtgcactctgccctgctgtggaactctctccagcactgctggctttcagatgcagtgtacaggaagtaggtaagtagggtcttccaagacttgccagagagttctaggaaaaggcagagaggaaaggcaggtttaagataatggcaatagattactgaaatgatgaatcttggactgtgagttagtgtcaatgttaaaaagctgggaagcaaagaaaagcagatgatggcttggaaggaggaaaggccagtggactggtgatccaaatgaggttgaaggacaacttcagaggaaacaacaaataaataagcacagaaaaatatatttttgattctttttcttttgttaggattgggctgggaaagagtgatcagaggttgaatgatagctataaaaggagaaaagctcaaggacaggtatcaaaaaaggaattctgaaattaactgttgggaaatcgagccaggtttgaatgacgatagggtctatagcttgcctttgggtatgggaggccaagaattggtggaggaaaaagtcatggaaaatgagaagatgaaggatttgaggggccagagtattggataacagagttgtctgttatccgtgtgtaccctgaaggcatctaggatgatgctgggacttgaaatgacagaaaagcagcttttgaaaggattattggggaaattattggatgatattgatgatgagtgagtgaacattttaattgaatggttaagactcaaaggagaggatcagggaggaaggggctggatggggccagtaggcagcaaaggacagacatctaacctgtctctcaccatgaggtgtgagtgatggatggcagagaatgcctagccatgtcttaagaggaagtgggttcctctctggggaaccaactttcagttaaagagggaagtgcaattaacactctaagaagttgtgaatataggagattgattttttcagaacaggcaattccaatggcatatttcaatacccccaaatgccttctggtttcctgataattttcataaaggcctttttggaagatgcagcaaatggaaactgcagaaacgaactgtgtgtggcatcaggactgtggtcacatagtggtgctcttgacaagatacagtcagaaaaacagaaagcaactctgaattcacccttctgacctctacagaagaaaggcttttcttacctttcttgtctgaaggtgtgctggacacctcctggggctcttctgggtcatttggttctggagaattatctcttatctctgacaaaagaaatataagtcatttcagagctcagatccagtgaagagaaagtgctgagggaagtcaatgcaagaactagaaaagtagaaagtacatgcagcccagggccgggaatctgcttgccctaagaattccctggctctgtcttgatttttgccaacttgtggttattgttacctgtgcgaccatcacagggaactagggcacaactgccccacagcagaggctcagtctgatccttttagagagattatcttatggatggaagagaagtgagtgaagaaggtgcaatgaatggaaattgcaggaataaactgtgctgggtatcatgactatagtcacatggtttctgctcccagcagcccctgctcaaggaatgaagctgagagcggaaagtggtgatattgaaatctgatgtccatgatgaaggggaatgtctttgctgtatgaaaaatacatcttattgctttgacgtctatgtgtggatattctttaactgctctatctgtggttattttacttggagaaatagtggagaaggctaaatgccttatatatttctgtatataaggattgtttgaagaaagcaggagctagcctgtgcttgctagcacctgttaacagcaaagacatataaagctctgctagtttttgctgcacaaagaaagacagagaacttgaagccataacaaataaaggctcatctcacatgaagctgtcacctttttctttacacactgcattgagattggtctcaaatgctggcctgcttaggaataggtgactgaggcaggtggcaagcagtcattagatctttggaataatttattacctttcaagttatattcataatatcaactcttaaactccaagtgatatagaaatgaccagggttgaaagtgaaaattccccacagtcaggtgggggcttggaaggaggaccatccatgtctgctgcagcaattcactattagggccacacagtgtttttgttcatttgctttgcattttgacagagccgttttgagcactactttattgaagtggcctcagaagagtggctctgtcaaacagtccagcctgactcagttcccttgctttcccctggggttcctgccacaaccctttgtggcaggtgaatgtttccctttcaggcgctttgtggcatttggagtccaaacctacaggcactggtggggctctgtccatcatcatccgtggccctatccaagtctaccttttccagacttgcctcctttgccctcccccagggactctgtatccattcagaggtcgggtctcctgcctgttcaagctcccaagtgctgggtgaactggaagctgggccaagattgctgagaggcaggaggagagccccctctctagaagatccgaatggcttttcctcttagtaaacacagaaacaaaggcaagcttttaggttgaccaaaccaagattacctggcatagagcccaagggagagtggggcatctcttgagggtcttctttatctcttatttgggggatcaggttgtcactggccactgaatggaggaagaaaaagttttagatctcaggaacagcaagcagggaccagaatgaggagaaaagagaatgctctattccaacaagtaaaaatgacggggtaacagcaaccaaggcctgggaaaggatggcatagagtgggaaagtaagcaaccattcactctcaattagccacttgttcttccattgctgttagcttcctgattatgttaacctttttggatggtaggtattagaggagtggatgcaatattatttggatcgaagaggacccctcttctcagtactggagagctcagaatccatggtatcatttttgacaatgcccaatatcataccattcttacgtttaatgtaatcaaactccattatgatgatggtttggggaggacaagtgatacaatttgagaagctaaatattaggtctagcagacctttaaacattttatcatcttttctagtaattttgataacattgttcttagaatccaaaccatataaaaatgaagaatgttgaaactctaaggcccccataatcaggtgggggtgaggaatcagctaagggtcactagtgtgagtgttacgcaggttacttgtcaattcagaatggtgttttggttgttggtttgttttgcattgctgcgttggtgaattggccccttctgtttcttttcctttgtattgctcagttctttttcccagggttcccaccatagcctcttggttggcagacgcatgttctcccttcacagtcaccttgagctaagcggtatcagccccagtcagtgttaccttgcacagtgctagtgaggaggctgggcatctcttctgagtcttcttccgcattcattttggatgttaacttgtcattggtcactgaaggaggaaaggaaattattacagattgcagggactggatgtcagggagaagagtgaatgttaaaagtgcctggggcagatagagcatcaaggcacaagggcagagggttggaatgtcccgggagtgggaagcaggtgttctggactctaggtcttacccaccccccggcagtgctcataatccctcttgaaaagggttgtgtttgggtagatgggtgcaagagaagaactaggacaataaaagtcaagatgctgggattggcggcaacatggcacaggcaccttaggctgaggatatacaggtgttggatgggatctgtttctcacctgaagtgcttcttccttcctggatgagtgcagggagaggcaggacagggtcagatgggctgggcgactcactcaggatctcatcgctttgctgggaggatgttccaggctcactgactcttggcgcacagggtgaacagcttggttgagggggttgtggtgggggcagcgccagtggggtatggagggagcttccttctgctaggccagttggggcttcaagtaggattggtgtgtctctgctctgccattcataggaagcaccaactgggattggtgaagggacacacatcagtaccctggagactcagaattacttggggaaggggatttcttaatacatgccttccaataggatgggggcatggagctattcattgtcccccaggtgcagagaactgattcattgtcatcattatccatttgtggccccttaatattttatttatctggtttgggcattgagtgctacaataagtgcatctaagccctgatctaataccaaaatggtttcacacataaaagttgagtttgggtttgtacccaggggtttaacttttctttaatcttggtgtcatataatttagtcaataatgaacatgctatagttttaaaagaggtctctgttttaataaataaacagatcatacttccccgaagcaaataagagaaaataaaaattccttagcagggtgtattaggacatttatattctggtttctgctcatttctgcagagtcagcttctgtgccttctattgtaccctgtgatctggtcacacccagctttctctcccatccacaataccccagacccttggctttctgcatgctattcccttgcatggctagtgctgggtttctcttaagattcttctccatcatttatttcagaagtaaatggtctcaaccagtgaatggaaaaaggaaagtaacttcaaattttggaaagggattcagaacaaaatcatcaggttgaagatcccggaagatgactgaagctcagccaggtcaggggcacatcagtgtgtgggtccccatggttctcagatgttcttaccatagcctttaaggccatgcctctcctagtattgcccagatgctgccaggacagtgggccctctgtagctgcccctacctggaggtggacttgcccctttcactgtccatgtagctcaagaaatcatctctcccttcagggggaagccttttgatggtgaagtgtcagagagcaaaggaggaactgtcaacaatggtgattccactaatgaaaatatccaatgtgagctggtggtcctttgcttgttgttctgaggtaagtgaacatgtgatttggccacagtgttttacttccaacctaaaatgactttactgcctctctctttccctggctgatttcttcccaactctgccactgttctttttcctactcctttatttatccagtctcttttctttctctacgtacttcatgatccattctttctcagaccctctctttctgtggctatgtttgcgattcactccctttctctgtagctaccttttttcccttctctggctttacaatctgccttccagctgtccttgtccggactagtggttaaaatcttgggccctggtattgggagacccaagtaggactcttgctctgcttcttaaccaacaagtaattttgggaagattacctctgggctttaatttctctgtcagtcaaatggggttaaaaatgacttcaaagggttgttttaaagatgatgtgagataatcaaataaagtgtttgcgataaggcaccaaaaaaagatacttattattatccgtccacattcattttttcttcctccctggctctccttgtccttccaccagacctgatctttgtaactttgcatttctgtcaccttatgcattccctatagattttccagtatgccaaattgtatgatttttttccaaattcatagaacacataagaaatgtttatgtcctctagaagttcatcttagagagttgggatcagctttagcaaggggctgctcctgcagctgtaccaatgagagaatatggtccattccaccccagagagaaggcgggggattaacgtgcatattccacagggctagaagtaaacccagacttttaccatagcaactttttaaatgcaaaaagcacttgagaaatctcattaccacgtttgaagcttctgtaaatcgtcaccagattgggatattcacgcaggttaatttgactgaacaatgtcaccagaagagacaggttaaaagtcctctccagttgggtgagaatgttgtgcaccactctggatacagggatcaaatttctacaggcttccagagattcctataaaaatggagtgaaggtttttataaatgactataaaattgaatgggaagttatacatttatggttttctaagttttaagaaagctaccttactcttttaagaagaaattcaacataaaatatatagtcacattctctaaggtagagcggtcacagttttacatgcttatttttgaaactttacacatatttggatgactagcaacaaaaataaataatttagctttcttaaagtaagtctatattctgaatccaactttcaggcacatttgagacgagagaaatttgaaggaaggaaagtggggttaaaggatgctactatgtaattgattctttaaagctgtgggcaggatacttcagcaatggttctagtgatggtcacagaggcaattctgctggttgcttgtgagcctctgctcagtctctctctgtgtctctcaaacttgagataagcctgaatggattccagccacagagaagtcaccctgagaattttccttgcctagaggatggacaaaaggagaaatacggcaagagagaactgattgcaaataattattgaacatctactaggctcggtcagcgagtctttgggtacacagcactgaataagaccaacatggagttgcctatatttgggggtcagggtaggcactgtcaagtggagaagatgagcattaataaacacaaataaatacccatttacaattgagagtagtgttacggagggaaagcatagattgctatggaactgaataactaaggggtcttcatgagatgagttggccaaggagatgtctctgaggagtgctctctgggctgtgatctgaagagggagttggggccaaccagactaagactaagggaagattattggcacttccttgagtctagggctcaattaatgcttttaaaaaccaaaattatataaaaataggtccacttttgtccacatagcatatctcccagtgcctgcctgtctcacatcagaatgcactgtgagcaatattagctgttataaattgggatgatgcctgtagtgagttgaatgttggatggatatatctcagccaagatatatccatctagaatctgtgaatgtgaacttatttggaaaaagtgtctttgcagttgtaattaagttaaggatcttgagataaaatcatctttgattagggtgaccctaaatccaagtgtcctcagaagattaggtagaagactcaaaagagaggtgatgtagagatgaaaacatatcagagtgatgcatctacaaggcaaggaacactaaggatttccaacagctaccagaagctaggagataggcagctatcggattctcctcagggcctctagaaggaaccaaccctgtcaacaccttgattttggacttctggcctccacacctgagagaatatatttctgttgttttaagctacctggtttgtagtcattgttacagcagtccttatgacaccctagaaaccaacatagcccctatgacaccctctctcctaactacccccaccttctgtgataatgaacatgcctgggctgggccttccaaactctggaagccctggtggtttgtggtttgagactttaataatcaggcatattggtgggggctgggctgccatggaagggttcaacatgactcaccatgtacattctcttagtgatgatggagttgtctaggaggccttcaaagaagggaaatggcttgtgtatggcataggcgatccccagcttctggtgcatgaagtgctgaaaaagagcctcttccatggctcttgtcatggtgaacatcctatggaaagaggcatgataaaaaatagaagcaaaggctgggcgcggtggctcatgcctgtaatcccggcactttgggaggccgaggtgggtggatcacctgaggtcaagagattgagaccatcctggccaacatggtgaaactctgtctctactaaaaatacaaaaattagctgggtgtggtggcgcacgcctgtagtcccagctacttgggaggctgaggcgggaaaattgcttgaaccggggaggtggaggttgcagtaagccaagattgtgccactgcactccagcctgggtgacagagtgagactccatctcaaaaaaaaaaaaaaaaaaaatagaagcaaaaccttgaggaatgtgggaagcttctctctgcattaaatgggcagatctaaaggtaagcattctggtcccaaaggcatccttagtagcctgcaaagcaatgtctgcctaaaaggctcatgggtataggaaacaaggacaattcccagcaacaatggaggctgagagtgactgaaaatataatgacagaatcccaaggcgctgcaggtaaacataaggaaggtattaaaagtagctaatatttatggagtgtttcctgtgtgccagactttgttctaagggtttcatatgcagtaacttatctgattttcataaaacccttgcgaggtggttcctatgactgcacctgtttatactgttgaggaactgagacacagaaatgtttaataacttgccccagggttgcacaactagagagtggaagagctgggagcaaatcctgattccaggcttacagtgctaactatgtgttctatggccacactgatctgggttaaacaagatgacctgggctacggctgaagccattaactagcaatgctcatgcaacagggaccaccctaaaatgggtagagttcagctggaaacctggtaatatttggaaactttaacgaaccactcccaatcttcaacacaaatgggccaagcataaataaaagcatgagggctgagaaaggcatacttagtaaaagtgacttaactgacttgttcactgcaaccatttcatgtctcagacatgcgccttttcccatgcccatgcagcatgtattaaagattggccatttatggactgtgaggagatatcaataggttataatgggaagaaagtttacaaatgacattcttgacaaattgtcaagaaaaggaaaagcactaacaaaacattcaatcaacttgacagtttttaacaaacagaacaaacatggattccacttttccaacttcattttgtgttgaacagaaaagtaaatcgtaattaacaactgtttacagggatttaatcccagtggcagattaagcaccctagtctctttctcctcattccccaatttttttaacttggcagaaaaaaatactcatgaaaagaataatccgcaatcgcataggaaaacaagaaaagatgccattgagagtctgtggtggtaaagaagtcttggaagatagagaacagataggagagaaatctactatccacaatatgcacaggggaaggagatagtgcaaagatcagtgcaaagtcagagaaaggcagagtaaacatatactaagaagaggaaggggtcttggaggctccttttagaacaattcattatacagcagcgctcagaacaggaagtctagagcttcctcattcttcatctgtcatgagtcccaaagatgaaagggaggcacagagaggtttagtaactcacccaaggtattcagtggcaaagcagagcttgtctgactctaaagccctgtttctttctatgcaagatactacatctcatatatgactgttcagatttttattatgtaaagagattttgcaaacgaataagcaaaagacaaacatccaactagaaaataaaaaagcaaaatacatgaacagagagtgataaaagaataagccaaatgtgcaatgaataatacgataagcatgttaactagctagtagaaagcataaagaaggccaggcatggtggctcatgcctgtaatcccagcactttgggaggttgaggtgggcggatcagctgaggtcaggagttcgagaccagcctggccaacatggtgaaaccctgtctctactaaaaatacaaaaattagctgggcgtggtggtgcacatctgtagtcccagttactcaggaggctgaggcaggagaatcgcttgaacctgggaggtggaggttgcagtgatctgagatggtgccattgcactccagcctgggtgacagagcgagactccgtctcagaaaacaacaacaacaaacaaccaaaaaaagtgtaaatgaagacaatttgataacatatttgtctatcaaattggccaagatagaaaataatagtaataatctcagacactgtgagtgggaaggtcaacaggtccaaatgttctgaaggctgatttagtaatcagtgtcaaatgtcctaaaacatgtgctcctttgaatttccacttctaataatttatttcaaggaaataatcatgtatttagagaaaatatataaaaagttcatgatacactagagacgaaattaaatgtactctcatttttttcttttccaccagcttcccaagtacctctagtcatttacacaatggataacagatgagccgcctattgcgggcactgaaggatcagagcttaggtgagggtagagggcaaatctcggctccattcacaataacaggctggactctggcgaaaaaaagaggtgtcagtgttccctccatgtgcccccttttaacagtctcctaataagtaccacatgtctgagctctgagagagcctcagagtttaaatagttgaactccaccctgcagctgctgccgcgaagttaactctaagagctgcagtcaccaagagcgaagaataaagcagcaaagacagaaactcacctggactttgagtttgtcgttcctgcccctttccaggggctgggacagggatcactcctcaagattgggagagttacagggagatgctagcaggcaaaacaggaagtctgtgctttgacaaacgcagtaaggggccgggcttccgagaaaagaaaagtgaaagttttcggagtttgccaagccggaagctgaaggcaggtcggtgcctgcagcctctctccacctcctcatgggcactt

SEQ ID NO: 2036 - DNA, 13347 bp, Homo sapiens
  source 1..13347: mol_type = genomic DNA
acttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggtgggtcatcgtctcctttcccgtctgtccttcatctctggtagggttccctttcatacttgttatttaatgtctacccagcttcactctacaggtatacaatagaattcagttacaaataaataacgaggcaatcagattttttaaattgcagggattggctgttggagaaactcaaggatgccgtgactcacatcatcttcctattctcttacatctgcaaatggctggactggagctgtttgaacatcatgcctgttctgaggctttgtgtaggattggatgattccccgtgacctctgaaccctctcttctcccccaggcctcctttatccccactccaaaagacaactctgtctaaaaaggatctttttagaagaattaaaatccaaacgcctgtctgttgtcacactttccaggctgtgtagttggggaccggttctgctctgagcccatctatgtggctcttagccctagaatcacttcaggatctctgaatacttggtaggaggaagtgaaagcagatgagacccaacaaaaaaggcaagcaggtagagagtgagtgctgcttctgctttttttattcttctgttctggtattttttacatatctggtcagagaagcctggaaatcatctttaaaaaatgtaagacaatgagaccagtctgaccaacgtggagaaaccctgtctttactaaaaatacaaaattagctgggtgtcatggtgtatgcctgtaattccagctactcaggaggctgaggcaggataatcgcttgaaccagggaggcagaggttttggcgagccaagatcacaccattacactttagcctgggcaacaagagtgaaattccatctcaaaaaaaaaaaaaaaaaaagacaagtacatcaatacggtcatttcttcttatctgtggattctgtatccatggatctaaccaaccatgaatgcaaaatattttctaaaaattaaaaacataaataacaacaataaaaagtaatataaaaatttaaaatacagtataactatttgtatagcatttacattgtattaggtattataagtctagagatgatttaaaatatacaggaggatgtgcataggttatatgtaaatactacaccttttatatcagggacttgagcatccatggattttggtatccatggagggtcctggaaccaattccccctggataccaagggatgactgtacattcttgataaaaatgaaaatgtgtggaatgtaaaaatgtatggaaacttgtctaattgggactctgtgctaaggctacttctggcgctggtacagccccaagaaagcaaaagctattgctattatcagcagtagtggtggcaccagactggttttcagtgcccagtgccaccactcccagacaggcatccctgtcatctctctttcacttgctctctagtgaagggaagatgagccagcggagctcaaagtccagccagcccatggtcaccaagcaggaagaagacggcactgagaggtgacaatgggctaatgctaacctcaaagaatgagttaggaagtgttgcctctgctcttatttttggaggaaattggggaggatgatgtcatttcttccttaaatatctggtaggattagctagtgataccatctgggcctagtactttcctttctggagggctattaattatcgattcaaatttctttaatagatgtaggcctattcagacaacctatctcttgtgcaagttttggttagtttgcctcttaaagaatttgttcatttcatctgtgaccaaatttgtaggtgtagagtccatagttttcctttattacctttccattgtccatggaattcgtagtgatgacccttctttcattctgatgatttccgtcttctctatttttttctttgttaggctggctagaggtttattaattaactctttgaaaagaaaatcagcttttggtttcattaagtttctcgaatgttttcctgtttcaatttttttaacttccactttaattttaattttttttcctgcttgcatcaggcttaaattgctccttttttctctagtttcctcagatgaaagcttagattattgacttagatctttcttcttttctattgtatgcatttaatactatacatttccttctaagtgctgcttttgttgcatcccattcattttaataagttgttttccttttcatttacttcaaaatatttttaaaattcttttaggacttcttatttgaccctagaactcttttggttaatctggaaatattttggaattttccagctatttttctgttactgatttctagtttatggtctgagaacaaacttttaggatttctattcttttaaatttgttaaggtatgttttatggcccaaaatgaagtacatcttggcaaatattctatgtgagcttaaaaagtacatgcattctgctattgttaaatggagtaccgtataagtgtcagttagaccaagctgattgctattgctcatcaggtcaactacacccttactgatttttctgcctgtgtgatatgtcaattaataaaaaagaagtgttgaagccttcaataatagtagtgaatttgtctatttctctttatagttctatcagtttttgcctcatacattttgccattagtttgttagttgcatacacattaaggattgtgtaccttcttggagaattgacccttttatcataatgtaatgtccctctttaatccctgacaattttccttgttctgaagcttctttgtctgaaattgatatagctactataccttttctttgattagtgttggcatggtatatcttgctccatccctttatgtttaacctatctgtatttttatatttacaatgactttcttatagacaacatatagtcgggtgttttgtgttttttatgtactctgttgatctcttgtcttttaattggtgttttagaccattggcattaaagtgattattaatatagttagattaatatctaccacatttgtaaatgtttcattgtacctatcgtttttatcttttcttccttttttcctgccttttctggtttaattgagcattttatgcttctattttctctcccttcttagcatatcaattatacttcctttaaaacatttttagtggttccctgaagtttgtaatatatatttacagcgaatcatgcccattttaaattacactatatcacttcatgagtagagaatacaccatgcaactgaatgtcccaaattctgccctcctgttctttttaacattgtgaaatgactgacaatgttaaaaagaacaggagggcttccagtcattccatttatttatgtcccataaccactcaatatgttgttgattctattaatttgaataaatggcttcattttaggttaacttggagtaggaaaaatgaaaacattttattatatctgcatttatttcttctctggtgctctttctttctctatgtaaatctgagtttctggcccacatcatttttccctttgcatgaagaaattctttttttttttttttttttttttttttttgagatggagtctcactctgttgcccaggctggagtacagtggtgcaatctcggctctctgcacactccgcctcctgggttcacgccattctcctgcctcagcctcctgagtagctgggactacaggcgcccaccaccacgcctggctaattttttgtatttttagtagagacgggatttcaccatgttagccaggatggtcaagaaattcttttaacattttcacatggagtaggctttctggcaaagaatttcctcagtttttgtttgtttgagaaaatctttatttctactttacttggaaggttaatttcacaggatatggaagcctacataggctttttttttctttcatcactttaaatatttctttccactttctttgcttgcatggtttttaatgagaaatctgatgtaattttatccttgttctttcacaggtaggggttttttgttttttttccctaccccctggcttttttcaatattttctctgtctttcgtattctgcagtttgaatataaaattgtaattgccaaactagactcttcttgtccattgcccagaaaagccacacattgagaatagtaggagttgcaggagagagagaatttaataatcgcagggccagccaagcgggagatgtttctgaaatccatctccccaagaattcagagactaggctttttaaaggatagttaggcagacagggggctggggaacagggaagtgctgattgcttaggttgggaatgaaatcacagggggttgaagctgtgttcttgtgctgagtcatttcctgggtaggggtcacaggacctggttaccaatcctgtggtattagctgttccattagaatgcaaggtctgaaaaatacctcaaaccccagtcttaggttttacaatactgaagttatctataggagcaattgcggtggttatggatcatgtgacctccagctacatgactcctgaaccataattctaatcttgtatccaatttgttagttttacaaaagtggttttggtcccagagcaaggagggggtaagttttgggaagggattgttataatctttgttttaaagttaaactataaactaaattcttctcattgttagcttggcatacacccaggaatgagcaaggacagcttgtgaggttagaagcaagatggagtcagttaatttagattcctctcactgtcatgatttttgcaaaggtggtttcaatatgtctaagtctagatcatttgatatttatgcagcttggtgtttgatgagtttcctgaatctgtggtttgttgtctgtcattacttttggaaaattcttggctatcactacttgaatatttcttctgctctattttctctttcttctccttctcgtattccaattacatatttgtcacactttctgaaattattccagcattcttggatattgtgttctgttttgttttttcctttttttttcctctttgcatttctatttgagaagtttcttttgacatatcttcaattcactgattctttccttggccatgtccaggctactgatgaactcatcaaaggtattcttcatttctgttacattgtttttcatttctagcatttcatttttcattatgtctttgagttgtcatctttctgctcacttaaccatctgttcatgcgtattgtgtgcttttttctttagagcccttaacatattaactaaccatagttattttaaatttctgtctaaaaacttgaaaatccatcatatctgagtctggttttgatgattactttgtctcttcacactgtgttacttcttgccttttggcatgtcttataattttttttttaagtcagacatgataagtcaggtaataggaactgaggcaaataagccttcaatgtgaggttttatattaatctgggtaggaaatgggccatatctaatgtttgttctagctgtaggtggcagaggtgtcaaattcctctagcgttcttgtttttctttcccctgctttctctgggtttctctgagaactcctttttaaatagtctgtttcttgtagttcttccagctgtaatctgctcttattatacaggaaccctgttgatggaatggtaacgtgtcagagggggaagtggtctataatcttatgattacatctcgatcttttaatggaactgcaccttgggctattacttttaaaagaatttctccctccacccttttttttcaatttttttgagatggagtcttgctttgttgcccaggctatagtgcagtggcgtggtctcggctcactgcaacttctgcctcctaggttcaagtgattctcctgcctctgcctcctgagtagcagagattacaggtgcctgccaccatgcccagctaattttcttttgtgtttttagtagagacggggtttcaccatgttggccaggctggtctcaaactcctggctttgtgatccacccgtctcagtctcccaaaatgctgggattacaggtgtgagccaccgtgcccagcctcacctccaccctttttagaagtgacaagatggccagaaggggctagattttggtagtcacccttcccctagaatggttaaagcattttccctggagagcaggcccttgtcatggagaatgctttggctttttaaaaacttttcttttccctcttcttgccagaaggataaagagatttttcttggggtttgtggaggtaaaatccataaaaggttgggggcctgccctgagatgatgacccccaggagtttctcatgctcatgctcctccacactcagcctccagcaattcatcaaacataccaggctatgacttcagtgcctgctgcctcagatagttgatctcggctaattctctggatttgcctgtatctccagattttggggcagtttgccttgtgactttggttatttgagagatagaagaaaagttgttaattcatagtttgttcagcagggttgttgttgttgttgtgaggatgggagcgatgacttccaatgtctttgcgtgttgaagctgaaaccagaggtctagtgaacttttacatttttgaagtttagacttttttcttaagacaaactttctttttgttttaaattttggttttattatagtattatcttatagccagagcatgtaacctgttcaatttctcttcattattatttattgaaattacttcagggccaaatacctggtatgatcttgtgtgtttaacacagtgttattaaaaatcaattttgccagtttttaaaacttacattttgtgtatctttgttcttttatttttatctacttgagaagctaaggactggaagtaagatgttttttaacagccttgaaagatttccccattagtaatctttaatcttactttttaaatgtgagtattgagaattttaccttctttctcatttgtatttgcttaatgaaacttatccatcttttgactgttaacatttttaatgttattttatctctgttatgtctcttgtagttagattctattttgaccatttataatttaagatggtagcttaatctgttttaaatatcttgttgcttatggattttttatttttatattttatgcctctttattttctataagaaaaagagcatgtttttctttctcattattttgtaaagtttgtagcctcattttgactctatttgttacacttgggtttctaattaattctttaatgtatatttctctaactgagaccatcaaatttataactatatcatttgaatttgtatttgaaataagttacttaactcaattttttacttgtcctcactcaatttaaaaaactttaccaagatatcgcaccactgcactccagcctgggtgacagagcgagattccgtctcaaaacaaaacaaaaaaaacattaaaatagaatctaaagtttaagattgaaattactataattttattatatgcagtatatatcctctctttttagaacagtgcttctcaagtatttgggttcaggatatttttatatttttaaaaattatcgagaaccccaaagaactggcttttgtttattgggttatatctgttgctatttacgatattagaaattaaaactttgaacacttaaaatatgtatttattcatttagaaataatagtagtgaatttattacccgtgaatatgtgatgtgtttttatgaaaaataataaaacttttcaaaatagaaataaattagccagaggattagcattgctttacatttttatacgtcttttaaatataagtagaaggcagctagaccctcctatctgcttctgcattcaatccgttgtgacatcacaggccatttagcctctgaaaaatttcattgtatattcatgagagaatgagaaagataaagggaaaataatatgttattatgtgaagagttttacttggtgacacctgaaagggtcttgcacaatcctagggggtccctaaccccactttgagaattactgttctaagataatttatacatttgagacatcagtattgtaactggttttaatgatgcttccagttcctctacaataaggctttactgatactgatttcttgattctgttaatgtagtacatcatcaaataattcgtcctacacagtgtcagtaaaaatggagtagggtgatctataggaacaaacaattcccaaatctcaacgggtcaccagccctctgcacagaggaccctcatcctggactctgtctctggctgaggagcagccaccccatctgaaatgacagtcactgtggtagaggaacagagagcatgcctaaccaggtgctgcctctgagctcttctgccagagtgatacccattgctccaagggaggtacaatcttaccttggcccagaagaaaagaacattgaaaaatgtgtgaccaacacagaaggtgcatgagcaaaatattctttgagtccttgtctatctaagtattgattctgccctcatacgtgaatcattgaataaggtatacatttttccattttaatttttttggacccattctcaagaactgaatgggtatacactttttttagtagtttcctcttacctctaggtttataggtttgcatcattgctttagacatttagggtttcaaattcacttatttttccctttagggcttttccccatatgttctgggaaattctccctcctttatcttataaaaattttcattcactttttaaaaatttcacaatcattttgaatttccaaggtcgttttattttctggttgtttcttttctgcatggaatttttggtacaatatattctctttctgtgtgataatatttgttgtttagaaattcttttttgttccctgaaacatctgtatttccgctagggtaattttttgccttttgcttatcttggttttactccttaatgttgtaggtttccacaaatgctgtggtctgttgtagtctgttcatgcttaccagcaagatgctgaaaagtaaacttgaaactccatttaatgagatgggcttgcaaacttgtgggcttcactgagcaaataccaaatccctgaaggtaaaggccttttctctgagtcatttatatttttcttaagaggaaacctccagtcttctgcctgattgtgggtgttctgtgtcgtagagcaaactgtttttaattttgcctttggaacaatctctcgattttcatctctgcatctccttctcaaccaccactgcatctctgggaggctgcaggacacgctggatccttttctgacctcaggaagcatcctccaccttcaatagcaatgagtacccctcagaccactttttctctttcatacttaggttaaaatttctcatctaattcctttctcttcatcattgtaactttaattcctttactgtcattttaggagatattctagtgaaagaggagaaaaacagttgtcattaatcaacgattttaaaccagaaggctttttcttttttaaaagaattcaatggataaatggtgcatgtctggagaatgggaaattttagtgatcctctattctatcctgatgcatgtttaaggaatggaaagtcccaatgaccatttcctggtgggataaaaaaaatcctggaagtcttcataccgtttagaaatacagataaatttgttaaggcctattagcaaggggaacaatttagcaagtaggaatcagaactacaaacttttgtgattaaaaattagtttcccaggcacagccttaatgtctgaaatccagaggtctccaagtttagacagattaatgtgtcctagttttgcatatccacacaaatctccatgttggaccagagaaagagtgattttcttgtgactgtttttttttttttttttttttttttgagatggagtcttgcctctgtcactcaggctggagtgcagtggcacgatctcagctcactgcaagctccgcctcctgggttcacgccattctcctgtctcagcctctcgagtagctgggactacaggcacctgccaccatgcccggctaattttttgtatttttagtagagacaggtttcaccatgttagccaggatggtctcgatctcctgaccttgtgatccgcctgtctcggcctcccaaagtgctgggattacaggcgtgagccaccgcgcccggccttcttgtgtattcttaatcaaaccttaccagatgagagtctttgaaccaattttatgatgcagaatgccaccctccttttgcagttacagatggaggagatacatctcctttacatctcctgagatttcctctctttgttgttaactaagaagacttgcagttcagtgttaggttctgtaatatctcagccagatttttatttctttctctgtaagttaaagttctccagagaaacagaaccaataggatgtgtatatacagagaaagagatttgttataaggaattggctcttgcaattatgaaggctggcaagtccaaaatctgtagtgtgggcctgctgtttggagacccaggagagctgatggtgcagctccagtctgaatgcagtctactagaggattctttctttcttggggacactagtcttttggttctattcaggctttcaattggttgggcaagccccacccacattatggaaggcaatctgccctactccaaattcaccaatgtaaatgttaatcttatccaaaaacaccctcaaagttggcatataaaattaattaccacagtatcatgtcaattcctataaagattttgacatcttttaattgcatattttccctagagagttcaggtgaaggtctctttataatagtttgattggaacagggtgagcctttttacttctatgtacaggtctttcttaagttcactgttttcatcttttccaccttgatttttcccaaaataaataaattccattcattctggtctccctacaagaatgcttattttatacatgttggctctccattggccatccttcatgtctaaaatcttctaaccaccacaaacctcttggaaactcagtgtctacttccacgttgtatctttgtttcttaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaagtaagtaagaatttccaaatgatgataaaccaggtccatactcaattatgccaaacttcaagatgcaatgagcaggctaaagggcctcctgtgagtggggaccttcaccattctgtaggttaggaggtgacaggagaagcaggcatcacagaaaacctcccttcttctgtagtaaatgttgggggagggccacagtgagggaggtggggcaggagagagaatgggaatgctgtatgggtgcagatcatcctaggtacttgtaaacaatctactaatggtagccataattaaaataaataagtgacctaggcagcattttattccaaagcctacttatttgaaacacttgaaactgagatttttttgaaactcacagtgaagttgtgtcattttaggttacatttggaagtggatgcttgctactgtctctccaaatcattgtttgatctttggacatttctagagccctagaatgcaagttaatgttagcagtggatgcccttagggatactgaggacaaggcttcttcttgtctttgtgaattttctgtgccctttggccaggagtcatagtgggggctggttgattggtttcctggagctcgtcaggccaggccaatcctagtagtggttattgtccatgcaacagaacagccttgttaaggccactcctgaaataacctggccaggctctaaagccatacacaacattcaactttgaacccacacttattatttaaaattactctctccccttaagtgtacaacaatgtcagagagtcaggttcaaaaaattagagtgtatttttatggtggaggacatttaagaagtcatccaaatatacgcaaaattctaacatttcacaagagaacagatgttctatctacaacctaaaagtcttttgtaacccataaatctctagctacataattctccatttaatatttttaagcattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatggtaactatagctctcaacagctttgggggattcaagcccatttcattcattgattcattcattcactcttcattcatatttgacaaatatttgactgagtgactattacatgccaagcccagggggaatataatgatgaaaaaacacacatgtcccatgtccttatggagtttacatacagtgggagtgacagacgttaaccaagtaatcctgcaaatggttgctcagccaggacttgattttgatgctgtaaaacatagggttgaagtctctatttttttgaaggaatacatgagtgatgtcttttcatgggaaaggaggaagccttctctgatatttgcagatatgttcaaagataaaacaattttctttgtattagaaaatttatcatccagtgcagtcctgtgtcaacttgtttctccaaacaaagactggagaagtcacgaagagagcctagcacatactggtacactgaggaggagctgcatgtgaaagctatgaagacagaaaagggggttggtgggggcctttccgaaccatgtggttgaattgcagactgtgggaggcagggtgtgagagctgactctggagaaagaagttgaagtggattctggaaggcttgacaccctgtgctaaggaatctggagtttaatttttggaaaataaagaaggaataaagggcatttaaacgggaa

SEQ ID NO: 2037 - DNA, 87486 bp, Homo sapiens
  source 1..87486: mol_type = genomic DNA
acttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggtgggtcatcgtctcctttcccgtctgtccttcatctctggtagggttccctttcatacttgttatttaatgtctacccagcttcactctacaggtatacaatagaattcagttacaaataaataacgaggcaatcagattttttaaattgcagggattggctgttggagaaactcaaggatgccgtgactcacatcatcttcctattctcttacatctgcaaatggctggactggagctgtttgaacatcatgcctgttctgaggctttgtgtaggattggatgattccccgtgacctctgaaccctctcttctcccccaggcctcctttatccccactccaaaagacaactctgtctaaaaaggatctttttagaagaattaaaatccaaacgcctgtctgttgtcacactttccaggctgtgtagttggggaccggttctgctctgagcccatctatgtggctcttagccctagaatcacttcaggatctctgaatacttggtaggaggaagtgaaagcagatgagacccaacaaaaaaggcaagcaggtagagagtgagtgctgcttctgctttttttattcttctgttctggtattttttacatatctggtcagagaagcctggaaatcatctttaaaaaatgtaagacaatgagaccagtctgaccaacgtggagaaaccctgtctttactaaaaatacaaaattagctgggtgtcatggtgtatgcctgtaattccagctactcaggaggctgaggcaggataatcgcttgaaccagggaggcagaggttttggcgagccaagatcacaccattacactttagcctgggcaacaagagtgaaattccatctcaaaaaaaaaaaaaaaaaaagacaagtacatcaatacggtcatttcttcttatctgtggattctgtatccatggatctaaccaaccatgaatgcaaaatattttctaaaaattaaaaacataaataacaacaataaaaagtaatataaaaatttaaaatacagtataactatttgtatagcatttacattgtattaggtattataagtctagagatgatttaaaatatacaggaggatgtgcataggttatatgtaaatactacaccttttatatcagggacttgagcatccatggattttggtatccatggagggtcctggaaccaattccccctggataccaagggatgactgtacattcttgataaaaatgaaaatgtgtggaatgtaaaaatgtatggaaacttgtctaattgggactctgtgctaaggctacttctggcgctggtacagccccaagaaagcaaaagctattgctattatcagcagtagtggtggcaccagactggttttcagtgcccagtgccaccactcccagacaggcatccctgtcatctctctttcacttgctctctagtgaagggaagatgagccagcggagctcaaagtccagccagcccatggtcaccaagcaggaagaagacggcactgagaggtgacaatgggctaatgctaacctcaaagaatgagttaggaagtgttgcctctgctcttatttttggaggaaattggggaggatgatgtcatttcttccttaaatatctggtaggattagctagtgataccatctgggcctagtactttcctttctggagggctattaattatcgattcaaatttctttaatagatgtaggcctattcagacaacctatctcttgtgcaagttttggttagtttgcctcttaaagaatttgttcatttcatctgtgaccaaatttgtaggtgtagagtccatagttttcctttattacctttccattgtccatggaattcgtagtgatgacccttctttcattctgatgatttccgtcttctctatttttttctttgttaggctggctagaggtttattaattaactctttgaaaagaaaatcagcttttggtttcattaagtttctcgaatgttttcctgtttcaatttttttaacttccactttaattttaattttttttcctgcttgcatcaggcttaaattgctccttttttctctagtttcctcagatgaaagcttagattattgacttagatctttcttcttttctattgtatgcatttaatactatacatttccttctaagtgctgcttttgttgcatcccattcattttaataagttgttttccttttcatttacttcaaaatatttttaaaattcttttaggacttcttatttgaccctagaactcttttggttaatctggaaatattttggaattttccagctatttttctgttactgatttctagtttatggtctgagaacaaacttttaggatttctattcttttaaatttgttaaggtatgttttatggcccaaaatgaagtacatcttggcaaatattctatgtgagcttaaaaagtacatgcattctgctattgttaaatggagtaccgtataagtgtcagttagaccaagctgattgctattgctcatcaggtcaactacacccttactgatttttctgcctgtgtgatatgtcaattaataaaaaagaagtgttgaagccttcaataatagtagtgaatttgtctatttctctttatagttctatcagtttttgcctcatacattttgccattagtttgttagttgcatacacattaaggattgtgtaccttcttggagaattgacccttttatcataatgtaatgtccctctttaatccctgacaattttccttgttctgaagcttctttgtctgaaattgatatagctactataccttttctttgattagtgttggcatggtatatcttgctccatccctttatgtttaacctatctgtatttttatatttacaatgactttcttatagacaacatatagtcgggtgttttgtgttttttatgtactctgttgatctcttgtcttttaattggtgttttagaccattggcattaaagtgattattaatatagttagattaatatctaccacatttgtaaatgtttcattgtacctatcgtttttatcttttcttccttttttcctgccttttctggtttaattgagcattttatgcttctattttctctcccttcttagcatatcaattatacttcctttaaaacatttttagtggttccctgaagtttgtaatatatatttacagcgaatcatgcccattttaaattacactatatcacttcatgagtagagaatacaccatgcaactgaatgtcccaaattctgccctcctgttctttttaacattgtgaaatgactgacaatgttaaaaagaacaggagggcttccagtcattccatttatttatgtcccataaccactcaatatgttgttgattctattaatttgaataaatggcttcattttaggttaacttggagtaggaaaaatgaaaacattttattatatctgcatttatttcttctctggtgctctttctttctctatgtaaatctgagtttctggcccacatcatttttccctttgcatgaagaaattctttttttttttttttttttttttttttttgagatggagtctcactctgttgcccaggctggagtacagtggtgcaatctcggctctctgcacactccgcctcctgggttcacgccattctcctgcctcagcctcctgagtagctgggactacaggcgcccaccaccacgcctggctaattttttgtatttttagtagagacgggatttcaccatgttagccaggatggtcaagaaattcttttaacattttcacatggagtaggctttctggcaaagaatttcctcagtttttgtttgtttgagaaaatctttatttctactttacttggaaggttaatttcacaggatatggaagcctacataggctttttttttctttcatcactttaaatatttctttccactttctttgcttgcatggtttttaatgagaaatctgatgtaattttatccttgttctttcacaggtaggggttttttgttttttttccctaccccctggcttttttcaatattttctctgtctttcgtattctgcagtttgaatataaaattgtaattgccaaactagactcttcttgtccattgcccagaaaagccacacattgagaatagtaggagttgcaggagagagagaatttaataatcgcagggccagccaagcgggagatgtttctgaaatccatctccccaagaattcagagactaggctttttaaaggatagttaggcagacagggggctggggaacagggaagtgctgattgcttaggttgggaatgaaatcacagggggttgaagctgtgttcttgtgctgagtcatttcctgggtaggggtcacaggacctggttaccaatcctgtggtattagctgttccattagaatgcaaggtctgaaaaatacctcaaaccccagtcttaggttttacaatactgaagttatctataggagcaattgcggtggttatggatcatgtgacctccagctacatgactcctgaaccataattctaatcttgtatccaatttgttagttttacaaaagtggttttggtcccagagcaaggagggggtaagttttgggaagggattgttataatctttgttttaaagttaaactataaactaaattcttctcattgttagcttggcatacacccaggaatgagcaaggacagcttgtgaggttagaagcaagatggagtcagttaatttagattcctctcactgtcatgatttttgcaaaggtggtttcaatatgtctaagtctagatcatttgatatttatgcagcttggtgtttgatgagtttcctgaatctgtggtttgttgtctgtcattacttttggaaaattcttggctatcactacttgaatatttcttctgctctattttctctttcttctccttctcgtattccaattacatatttgtcacactttctgaaattattccagcattcttggatattgtgttctgttttgttttttcctttttttttcctctttgcatttctatttgagaagtttcttttgacatatcttcaattcactgattctttccttggccatgtccaggctactgatgaactcatcaaaggtattcttcatttctgttacattgtttttcatttctagcatttcatttttcattatgtctttgagttgtcatctttctgctcacttaaccatctgttcatgcgtattgtgtgcttttttctttagagcccttaacatattaactaaccatagttattttaaatttctgtctaaaaacttgaaaatccatcatatctgagtctggttttgatgattactttgtctcttcacactgtgttacttcttgccttttggcatgtcttataattttttttttaagtcagacatgataagtcaggtaataggaactgaggcaaataagccttcaatgtgaggttttatattaatctgggtaggaaatgggccatatctaatgtttgttctagctgtaggtggcagaggtgtcaaattcctctagcgttcttgtttttctttcccctgctttctctgggtttctctgagaactcctttttaaatagtctgtttcttgtagttcttccagctgtaatctgctcttattatacaggaaccctgttgatggaatggtaacgtgtcagagggggaagtggtctataatcttatgattacatctcgatcttttaatggaactgcaccttgggctattacttttaaaagaatttctccctccacccttttttttcaatttttttgagatggagtcttgctttgttgcccaggctatagtgcagtggcgtggtctcggctcactgcaacttctgcctcctaggttcaagtgattctcctgcctctgcctcctgagtagcagagattacaggtgcctgccaccatgcccagctaattttcttttgtgtttttagtagagacggggtttcaccatgttggccaggctggtctcaaactcctggctttgtgatccacccgtctcagtctcccaaaatgctgggattacaggtgtgagccaccgtgcccagcctcacctccaccctttttagaagtgacaagatggccagaaggggctagattttggtagtcacccttcccctagaatggttaaagcattttccctggagagcaggcccttgtcatggagaatgctttggctttttaaaaacttttcttttccctcttcttgccagaaggataaagagatttttcttggggtttgtggaggtaaaatccataaaaggttgggggcctgccctgagatgatgacccccaggagtttctcatgctcatgctcctccacactcagcctccagcaattcatcaaacataccaggctatgacttcagtgcctgctgcctcagatagttgatctcggctaattctctggatttgcctgtatctccagattttggggcagtttgccttgtgactttggttatttgagagatagaagaaaagttgttaattcatagtttgttcagcagggttgttgttgttgttgtgaggatgggagcgatgacttccaatgtctttgcgtgttgaagctgaaaccagaggtctagtgaacttttacatttttgaagtttagacttttttcttaagacaaactttctttttgttttaaattttggttttattatagtattatcttatagccagagcatgtaacctgttcaatttctcttcattattatttattgaaattacttcagggccaaatacctggtatgatcttgtgtgtttaacacagtgttattaaaaatcaattttgccagtttttaaaacttacattttgtgtatctttgttcttttatttttatctacttgagaagctaaggactggaagtaagatgttttttaacagccttgaaagatttccccattagtaatctttaatcttactttttaaatgtgagtattgagaattttaccttctttctcatttgtatttgcttaatgaaacttatccatcttttgactgttaacatttttaatgttattttatctctgttatgtctcttgtagttagattctattttgaccatttataatttaagatggtagcttaatctgttttaaatatcttgttgcttatggattttttatttttatattttatgcctctttattttctataagaaaaagagcatgtttttctttctcattattttgtaaagtttgtagcctcattttgactctatttgttacacttgggtttctaattaattctttaatgtatatttctctaactgagaccatcaaatttataactatatcatttgaatttgtatttgaaataagttacttaactcaattttttacttgtcctcactcaatttaaaaaactttaccaagatatcgcaccactgcactccagcctgggtgacagagcgagattccgtctcaaaacaaaacaaaaaaaacattaaaatagaatctaaagtttaagattgaaattactataattttattatatgcagtatatatcctctctttttagaacagtgcttctcaagtatttgggttcaggatatttttatatttttaaaaattatcgagaaccccaaagaactggcttttgtttattgggttatatctgttgctatttacgatattagaaattaaaactttgaacacttaaaatatgtatttattcatttagaaataatagtagtgaatttattacccgtgaatatgtgatgtgtttttatgaaaaataataaaacttttcaaaatagaaataaattagccagaggattagcattgctttacatttttatacgtcttttaaatataagtagaaggcagctagaccctcctatctgcttctgcattcaatccgttgtgacatcacaggccatttagcctctgaaaaatttcattgtatattcatgagagaatgagaaagataaagggaaaataatatgttattatgtgaagagttttacttggtgacacctgaaagggtcttgcacaatcctagggggtccctaaccccactttgagaattactgttctaagataatttatacatttgagacatcagtattgtaactggttttaatgatgcttccagttcctctacaataaggctttactgatactgatttcttgattctgttaatgtagtacatcatcaaataattcgtcctacacagtgtcagtaaaaatggagtagggtgatctataggaacaaacaattcccaaatctcaacgggtcaccagccctctgcacagaggaccctcatcctggactctgtctctggctgaggagcagccaccccatctgaaatgacagtcactgtggtagaggaacagagagcatgcctaaccaggtgctgcctctgagctcttctgccagagtgatacccattgctccaagggaggtacaatcttaccttggcccagaagaaaagaacattgaaaaatgtgtgaccaacacagaaggtgcatgagcaaaatattctttgagtccttgtctatctaagtattgattctgccctcatacgtgaatcattgaataaggtatacatttttccattttaatttttttggacccattctcaagaactgaatgggtatacactttttttagtagtttcctcttacctctaggtttataggtttgcatcattgctttagacatttagggtttcaaattcacttatttttccctttagggcttttccccatatgttctgggaaattctccctcctttatcttataaaaattttcattcactttttaaaaatttcacaatcattttgaatttccaaggtcgttttattttctggttgtttcttttctgcatggaatttttggtacaatatattctctttctgtgtgataatatttgttgtttagaaattcttttttgttccctgaaacatctgtatttccgctagggtaattttttgccttttgcttatcttggttttactccttaatgttgtaggtttccacaaatgctgtggtctgttgtagtctgttcatgcttaccagcaagatgctgaaaagtaaacttgaaactccatttaatgagatgggcttgcaaacttgtgggcttcactgagcaaataccaaatccctgaaggtaaaggccttttctctgagtcatttatatttttcttaagaggaaacctccagtcttctgcctgattgtgggtgttctgtgtcgtagagcaaactgtttttaattttgcctttggaacaatctctcgattttcatctctgcatctccttctcaaccaccactgcatctctgggaggctgcaggacacgctggatccttttctgacctcaggaagcatcctccaccttcaatagcaatgagtacccctcagaccactttttctctttcatacttaggttaaaatttctcatctaattcctttctcttcatcattgtaactttaattcctttactgtcattttaggagatattctagtgaaagaggagaaaaacagttgtcattaatcaacgattttaaaccagaaggctttttcttttttaaaagaattcaatggataaatggtgcatgtctggagaatgggaaattttagtgatcctctattctatcctgatgcatgtttaaggaatggaaagtcccaatgaccatttcctggtgggataaaaaaaatcctggaagtcttcataccgtttagaaatacagataaatttgttaaggcctattagcaaggggaacaatttagcaagtaggaatcagaactacaaacttttgtgattaaaaattagtttcccaggcacagccttaatgtctgaaatccagaggtctccaagtttagacagattaatgtgtcctagttttgcatatccacacaaatctccatgttggaccagagaaagagtgattttcttgtgactgtttttttttttttttttttttttttgagatggagtcttgcctctgtcactcaggctggagtgcagtggcacgatctcagctcactgcaagctccgcctcctgggttcacgccattctcctgtctcagcctctcgagtagctgggactacaggcacctgccaccatgcccggctaattttttgtatttttagtagagacaggtttcaccatgttagccaggatggtctcgatctcctgaccttgtgatccgcctgtctcggcctcccaaagtgctgggattacaggcgtgagccaccgcgcccggccttcttgtgtattcttaatcaaaccttaccagatgagagtctttgaaccaattttatgatgcagaatgccaccctccttttgcagttacagatggaggagatacatctcctttacatctcctgagatttcctctctttgttgttaactaagaagacttgcagttcagtgttaggttctgtaatatctcagccagatttttatttctttctctgtaagttaaagttctccagagaaacagaaccaataggatgtgtatatacagagaaagagatttgttataaggaattggctcttgcaattatgaaggctggcaagtccaaaatctgtagtgtgggcctgctgtttggagacccaggagagctgatggtgcagctccagtctgaatgcagtctactagaggattctttctttcttggggacactagtcttttggttctattcaggctttcaattggttgggcaagccccacccacattatggaaggcaatctgccctactccaaattcaccaatgtaaatgttaatcttatccaaaaacaccctcaaagttggcatataaaattaattaccacagtatcatgtcaattcctataaagattttgacatcttttaattgcatattttccctagagagttcaggtgaaggtctctttataatagtttgattggaacagggtgagcctttttacttctatgtacaggtctttcttaagttcactgttttcatcttttccaccttgatttttcccaaaataaataaattccattcattctggtctccctacaagaatgcttattttatacatgttggctctccattggccatccttcatgtctaaaatcttctaaccaccacaaacctcttggaaactcagtgtctacttccacgttgtatctttgtttcttaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaagtaagtaagaatttccaaatgatgataaaccaggtccatactcaattatgccaaacttcaagatgcaatgagcaggctaaagggcctcctgtgagtggggaccttcaccattctgtaggttaggaggtgacaggagaagcaggcatcacagaaaacctcccttcttctgtagtaaatgttgggggagggccacagtgagggaggtggggcaggagagagaatgggaatgctgtatgggtgcagatcatcctaggtacttgtaaacaatctactaatggtagccataattaaaataaataagtgacctaggcagcattttattccaaagcctacttatttgaaacacttgaaactgagatttttttgaaactcacagtgaagttgtgtcattttaggttacatttggaagtggatgcttgctactgtctctccaaatcattgtttgatctttggacatttctagagccctagaatgcaagttaatgttagcagtggatgcccttagggatactgaggacaaggcttcttcttgtctttgtgaattttctgtgccctttggccaggagtcatagtgggggctggttgattggtttcctggagctcgtcaggccaggccaatcctagtagtggttattgtccatgcaacagaacagccttgttaaggccactcctgaaataacctggccaggctctaaagccatacacaacattcaactttgaacccacacttattatttaaaattactctctccccttaagtgtacaacaatgtcagagagtcaggttcaaaaaattagagtgtatttttatggtggaggacatttaagaagtcatccaaatatacgcaaaattctaacatttcacaagagaacagatgttctatctacaacctaaaagtcttttgtaacccataaatctctagctacataattctccatttaatatttttaagcattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatggtaactatagctctcaacagctttgggggattcaagcccatttcattcattgattcattcattcactcttcattcatatttgacaaatatttgactgagtgactattacatgccaagcccagggggaatataatgatgaaaaaacacacatgtcccatgtccttatggagtttacatacagtgggagtgacagacgttaaccaagtaatcctgcaaatggttgctcagccaggacttgattttgatgctgtaaaacatagggttgaagtctctatttttttgaaggaatacatgagtgatgtcttttcatgggaaaggaggaagccttctctgatatttgcagatatgttcaaagataaaacaattttctttgtattagaaaatttatcatccagtgcagtcctgtgtcaacttgtttctccaaacaaagactggagaagtcacgaagagagcctagcacatactggtacactgaggaggagctgcatgtgaaagctatgaagacagaaaagggggttggtgggggcctttccgaaccatgtggttgaattgcagactgtgggaggcagggtgtgagagctgactctggagaaagaagttgaagtggattctggaaggcttgacaccctgtgctaaggaatctggagtttaatttttggaaaataaagaaggaataaagggcatttaaacgggaaaagtaaaagaagtcagtatgaagaatgggatgtgttgatttgtgaatactataccttgattcaaaaaagaggtatcttgttttcatattatgatacatccaagtcagagaaaggtctagaggaagtcaaatactgtgcatgcctcctttggtatccatgagggattggtttcaggaatacccaccactctcagtcctgaatgcttaagtcccttatataaaatggcgtagtatttgtgtataacctatgcacattgcaccagtatactttaaatcatctctagattacaatacctaatacaatgtaaatgctatgtaaatagttgttaaattgtatttttcatttgattatttttaatttttgtattgttattttatttatttatttattgagatggagttcactctgtcacccaggctggagtgcagtggtgtgatcttggctactgcaacctccacctcctgggttcaagtgattttcctgcctcagcctcctgagtatctgggattacagtcacccaccaccacacccggttaattcttttgtatttttagtagagacagggtttcgccatgttggcaaggctggtcttgaacccccgacctcaggtgatctgcctgccttggcttccccaaatgctgggattacagacatgagccaccatgcctggcctgttattatctttaacttttgtcccacgtttttaatctgagggtgggtgaatccacagatcccaagccaactgtacctaggcacaaattttgagtcaatatttgtattttaaccagggtgttccaggctgtggcaatgaagggaatgatgttacttctactgcccacatctcaggggctctgattctgtctgtggactgtggggatcctcctggccccagcatccacatctcatatgttagtatctggcacttcctgtgtttgggtgacaggtacctgaggctcacgactgcccactgcctcagactatgagtagaaatgtgagaaatgggcagaagtagaatgaattgtaaaaagattgaaaaaagaaaaaataaacctctacttatactacacaacatccacaaaaaaataattcaagttggatcacaaatctagaagttaagactacaagtataaagctgctaaaagagaaaacataagacagtgtgtttgcaaactgagagtaggcagtaatttgctatacaggacacaaaaaaacatggatcataaaagaaaaacttggtaagttagatgtcaacaaattaaaaactatgcatccaaagtcaccattaagaaaaggaaaaaacaagccatagactgggagacaatattttgcaatacacatatctaacaaaggattgtactcacaaaatatgaagaactcctataaatgaataataaaaggacacatcaccaattcaaaaaatggacaaacgatttgaacagacatttcaagacaggagatataaaatgtccagcaagaatataaagtgtatgacattattaatcatgagggaaatgcaaattaaagttatagtgagatatcattcactcactagaattgctaaaattaaaaagactgacaataccaagtgctgatgagaatatggaacaattggacctcccatcccttgctggtaggaatgtaaaatgataacgaccactttgggaaagtgcctggcaatttcctataaagttaaatctaacctatgatcttggcagtttcactcctaggtatttacatgagagaaatgaaaatatgttcatgcaaagatttgtttaagaatgtttatggcagccttattcataataactaaaatctggaaccaacccaaatgctcatcaacggagggtagataaactatgactaatttatagagtataatactattcagcaataaaaagaatgaactgttatcacatagagcaacatggataaatctcaaaaacattatgttgagcaaaataagcaagttgtaagagtacatactgcatgatcctatttatataagtacaagtacagacaatacagacaagtacagtgccagaaaggaaggcgccattgctggtgataggaaccagaacagtggtgtcttaagcacaaagcaattttctgggatggtggaaatgttctgaatcttgactgggatgttggtttcacaatgatttacacttaagatatgtgcctctcaatgaaaaaaaggggaacaaggctctgttggacctcgggggtgggagatcctggggcttggacatcaagttcatcttgagcacactgaggtctctcctctggtcactgtctgagtttggtaattttcacattgttttcctcagtatgctatgaacactcacctctccaaatgaataatgtaaacgatttagaagatagacccagattactaccatatggtaaacaaggtaactatcatttagctgatcaatgcccttattaaagttttgcttccttgccttcatggaggcaaatcttgtatttcctctcctgtcttagccctctgttatctcccagtcctcctcccctcacacagccatgtacctgcccttatctgccaacagatgtgagagaaccaatgaaaaaggagatctgatctcttgaatagatggagtctccattggtggagaatataagaagagaaaatgggaaaggtagacagagaataatacaggacaaattacatgaatggattccatcttctaaaggaacataaaagtcctaccctccgaggttgagataaggggattatttttaattaatttcatagaactattaagagaaactcagaaataacctaagccatatcagattcaggtgagagatattccttacggagatgaccagttaggggtctctagtactgtggtcacagtccaagaggggagtttggatatggagagagaggggagcctgaaagatagaattgcgcagggagacaaaactgaaatagtgttggcagatagaagatcaaagtgaaatgggagaaacagaaatggaaagagaggaagtataagacacagcagagaaaaggtaaaccgaaacatctgccaaggatcagaggtaaaaatggagagagaagtatatggaaaaggaaagatgagaggaaaataaataccaagaaatggggaaagtagagaggtacagaggcaactatgtagataaagagttaagaaaaaaagggtgtaaaacacttgagagtgaaaagtggataaaagggagagagaaacagactgggacagtgtaggtttgaggtaagagcactggatatccataactttacaagggtttattccattaaccgtaagttttcagaatgaactgttcccacatcaaagtggcacttgcatgatactcagatttcaatagatctctcccagaatagtccaatgattcccaagcacaaatctccactctaaattatctttagagtacatttattcatggacctgaggacctttactcaagggtcagatagacatctacacttgatttttttcaagaaccttaaacttggtactttgagaactgaaagccacatcttcattgctcaagttagatcgaactcctctgcagcactctttctctcagagacggatcactattatcccatggtttttcaagttggaaacctagtcaagtcatcatggatgactcctcccttgccctcaaatacatgccagttatgcagccaatgtaatcatttcatcttcaggttgcccctggcctgtccatctttgcatccccaagaccaggtctctggtccagatctccatcaccctcatgattctcagggcaacatcctttgctcatctcctccctctaatcttgcttccatcaaatgtgttatttgcacttcaactagatgggatattttaaagtgcacatcagattgtatcattttcctacttacctccttaatacactaaggattaaataaatgggtttttaagtagcatccaaaggcatccacaatgagccacctgcttacttctccagcttaatccctgcctcctgaaatattacttcaaggtggaataaaatttcccccaataatttcaattgttaaatctctctttcaaactgagcctttccctatgttttctctatgctgccttatttagaattgttttcctgtcccactatcctccatttacccttctccaatccagctaaatcctacttagaatatatgatcaaagggaggtctttctttagagaaagctagaaaggcacaattgggagaccaaggatgggagagaaagagcagtatcagagaaagcaagagaaaaaatttgcaggagcagagaagagagaaatgcatctaggaaagagaggctccaagaaacatccgcagaaaaaaacagaggcagagattgaggaaatgtacagaaacaggtggaaagacatgagtgagaaaatgggaaagagaacaaggtataaggaaaggaagactcccccacagtggatgaattattctcagcctctggtgaaggttactgaaggactgaatcctcaggtcaggttgtttggggagaggggaccttccagattatcaggttttcttagttttctcattatttgttttcttgttttgatggctttttgaccataaatcaagacatctaagggatttcattcctttcggcagagaacagcaatgcctgtcatgaaatggatgatatagcagtgcctcaggaagccttgagctcctcgccaaggtgtgagccaggtaaggaaggagtgacttgctctccctgacctgcagggtgtcaggaggtggaattcagagctggtgtttcctaatgcattttactctgagtacatgccacaggcaaaagatccattttgtccttggatcctataattctgctaaattttcctaagtgtatgttatagtagaaatatgctagagaaggatgatgtctttcatgtctactaataataaaaacttgattatacctacccaccacttactttctctagagaataaaaacgattattgtttgttactattattattttgtcccttactatagaaagccttcaaaagaaacatgttccatcagaccaactactcgaaaaactaaatgataatttttgccaaatattttccattgtgttactatcttatctagttattgttcaaagaattttggcaaacaagatgtcattttatctccacagcttatgaattttgatggataaacttttgcttatttgtattttatagctaaataaagtagaagtagaagcatagcaatgtgtaaggtcttttaccaggtcaaattagtcaagcaagaacatgacccacatccctgctgactcactgcggtgatggttgtgtgaatttggcagagatcagggtagccagggtcatggattggagttcacacaggagacccaaggaggcctgcaggttcttaggggagtgggccagggcctggtgcaaggagactcttattcagcaaaagcatttccatggccagagcagggaaaagcagagagaaacggtaagattggaatctgccatgtgggatgcaagaaatccagaagaagagaaccagaaagaaaaatggagacacaagtaggaaaatgtgatggagggcattgaagagcaacagaaaagaaaaagagagggaatcccagggagtcaaggagatggacggtgcttcatggcgtagaagcaagagtgtgtggtaaccaaaaagtgagaaggagaaaggaggtagcagagagatgatcagaaggaaaacaggcagagcaaggctgtggcggggctcaggcgaggtccttggagcaatagtgtttttttgcaaggagaagctcacttgagtgctgaacaccaggattcagcaggagcatcctgaggtctgtgctctcatcactgtgccttgtttatttccaggtttctcttcagagtcttgtgagcagttagctctcccaaaggctggtggaggagatgctgaagatgcacccagcctactaccaggtgggggaggtaattatgatttaaatgaccaattatctcattaaattagttggcctatctctatgcaaccaacacttccttctctctccaccaccaaccctgtaacacacttttgttcagcctgtggttgttttccccaggtgtgtgggaggcaagaggtaaaggacggctaagtcctttagtggaggggctcctgggcagagagcttaagggtacagagtaataaaaattactctgattggaggcaccaaatggtgttgcctaagtgggcccaattttatctacatgaatattgaatctaaatcctaccaggatggggtttgagaaaagagagagaattttaaacttacttgccagggattatttaggaataatgaaatactgtatatagaagagacaaagtggaagtgacaaagttagaagaatgaatagggatataacggggcaaagaggtaacaaacatcacgaaggaagaaagagacagaaatgcaaagaaatggtagaagtcagggagaggaagtcaagtcaaagagatcctggagttggtttatggtgcagatgcagcaatgtgtaaagacagggttagagggagaaaaaagaaggagagagagggagagaggggaaaggggcctgacaaggtgctagaagaagtagagccacttttgtttggtgcaaagatacctttattcccagggagcagttctacacccgaatattagagctcagcatggatccaggtaggtgtccaggtcactgccaattgtctgtcatgttcctctttcactctgcagtgtcctgtaaacttgctatacaaatagatgaaggagaatcagaagaaatgcccaagttactgccttatgatacagaaggtaattaggatttaaattaaagctttatttttctgtcaacatacaaaaacacctactctttcatctcccttcccattcccccatctattcatgtattcatccatatatccatccatccatccattcatccatccatccatatatccatccatccatctgtatattcatctgtccatccatccatccagccatccatcaatccatgcatccctccccacatacagacagagacagtctatgtccagcttcttcctgctttccttaagaggcacaagtagcaaaagaaggatgagctcagactggttggggctttcctgcatataggacatagggaaagagagagagaaagaaaaatatagtttgaatcgttaaataaagagagatctgagtgattgccagttttacctcaatagttgtgggatccaaatattaccacgttgggtaacatttgggtaatattaccacattgggtaacatttgggtaatattaccacattgggttataaggaaggggagataattttcaacttattttctcgaggttatgccaacagcatggatataatgagtatattgcaatatagaaaactcagtgaaagactgttgaaatgaacttcacaaagggaagggtccctgcccctttgttaatggcaaaagatgaggcctttgatactatggcagaaaaataagacagaatatacagaaagactgaagtttaaatttttagatttaaattttggattgaaaaattaggaacagaaagctaattagagagaacagatagaggcatggaaatgagcaccatggaagaaaggagataagcttgattattaaatatggcacaggaattaaaaggtggagaaaatactgtgagaggaacagagagaagaaaaatgctcgaagacagagacagtggaggagaggcacaaaagttgtacacagagaaaaagagaaaggagaataagtgaagttagcagagagtgaaaactgcttgcaagagatggggaacaatatgggacattgtagggatggagggaagattcactagacagaaataacttctggcccaagaatgagacatgttagcagcgagttttcacattatggtgtccccagcctatcaaaatggcacctgtaatgtcctcagaggcagtcgacctccccctgaggctttcatgtctctcccatctataacttaatgatttcaaaacacatatgtccagatttatcttctaagttcattcatctgagtacctgaatacgttcatgaagatatctgaaagacctctccatttggatgtttttcaggaacctcaatacaagacacctccaagagtacataccatctttcctgacacagatctgactcctctcccagtgttccctatctcaggatgaaacactattactccattcttgaagcagaaacctaggagccactcatgactcaccccacctccctcaacttaaacaccccatcaaccatccagtagacttttagtgagttctacatatctcacctgtccatttccttccaccccaacacaaaaactctggtaagatctctctcttggactggagcaacagcctctagactcacatctttcctctgatcttgtacctctcacatccattctttccaactcaaacaactctttcaaaaattgaagttggcttatcttacatttctactttaaatcaataactacttggggtcataaggattaaatctattttttcccccagggctccagcttcatgtctgcctctcctgcaattacttcaaggtttatatacaaattttctagtcattgtcattttctgatgactctttctcatctgagctttcctaaaggcttagccctgtgcttgaaaaagtcaccttgtttcactacaatctccatcatgctcactaatctagtgaaattatatggaaattacatacactctcagagatgccttttttgatccctagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaaggtaggaacagaagaagcagagacatgtgtcaagggtgaaaatgagagtgccaacatggggtgggagaccaggtgggcaaggtttctgacagtctctatcagattactggattgcacaagagcttcttttaccctcacaaaatctttaacatcgatatgcaaacagctgtatgtctatcttacagactgagaaataaagcacagaaatgcaagcaggatattatcacaaaggcaaagtagaaaaggaagagtgggcaccagtgtcctggatgtgtcactgggtgatggttgtgcaaggccagctgggggttcagggccaggtcacagggtcagaatagaaagaagtccaaggagttctgcaggttcccggaggagtggaccagggatcaatgtaaggctttaaggaaaaaaaatgctaatgggagggaagggaaatcatggaaacacagcatggaaatagagcctgccctttggaataggagagggatctagaataagagctaaagaaataatagaaaagggatatggtatcactgaaaaagaaaaaagacatagaaacaggagacaagagaagccagttggagagaagatcagacaatccaagcgctgctcagctaggagggaattatgtggaggcagaacggtgaggaggacactgagaattacagagaaggagaaagaggagctgcaacaaggtggagaaaaggcggaacaagacaggggtggctctcagcatttgcccatcttggatggcatgaacacactgaggcctgtgtccaagtcaccctctgtggtctgtcaatttcttgtttatctgcagagacctttgatctaaaaactccccaagtcactaatgaaggagaaccagagaaggggctctgtctactaccaggtgaaggagaaggtaattatgatttaagtttttaaatatttgagtacatctttgttttctagttggcatggaaaaaaagtttccctttctcccatcctacccttcccttcttcacattcgcatacatacagatggaattatgtcaattttctgttgtgcctttttgaaaactgtgagagagacaaaggatcaaggtgagctgagcccctgagtggggaccatatttctgcatggggaatgtagggagaacgaatataccagaggtaggctggggcgccagagaagtgcgtgggtgatgttattaaacacacattaaacctaaataacagcagattatggcaactgacgcaggggagaatgttttcagcctacttccagaaggatctggagcacagacatgttttgtgaaagaccgaaggcttgcaactgaggaaagtcatgcaggagacccttgggatggtgctgacaagggaaggacctgtggtgctatagcccctgcgtgaacagaagatcttttccaacctggaagaagataactttgagaatgaggaaaatatataaaataagggacattttaccagcatctaggagcataagataaaacccaaagaaacagaaaaggagaaagtagaagacacatagaaaggtgataacctcaaggagaaaagttagagaaaattgtacaaatggtagcaaatacaataacaacagcaatatgggaaggaagcacagaagaaattatgcagagaaagaaacagatcaaaataattaaagaacccatgaagagtgaaaactgttgtccaaggaaaggggcaggtcgagggcctatggagctgaagtcagtcactagatagaagcagctcccagcaaagggcacctctatcaatagtgagttttccaatccaggcccccctaggtagacagtggcacagaagcatactcagagagtaagagtactctttccccagtctcatctgctcaggtagtggaatgattctcatgtacatgtctgcgatgcagacctgctttccaagctcttccatccatgtgcctgaagatatttatcccaggaccctgccccttgcaatgtctttcaggaactacacacatccaaaagggaaaccaacacctcctccgaacctagaaactcccctttctccagggtttactctgtcagtaaagggatgaatatcctgtttgctcttctactcatcagactctttttctctgctttagcacaattgttctctgctttagcacaattggcaattgcaagatgtcaatcagatcattttcttttccccttagacgcggtgatctttgctgcacaggattagatgaattatccttcctgtggatttctgtggcttccacccttcatgggtccccagcccatatcatctgtcccatctctactaatggcatcaattgtttcaggagctgcaatgatctgatctttcttttatatgtgggcccttgagccacatttcccctgtactctgtattgttgccttggcccactcttctcctgatccctttccttatctggttcatttccaccatcccaaggatgcctttcctgatgcccagtatgagaaagggggtgacaaggaaataaatgagatggggaaagccaataaaaagcagagtcaggggtgcaagagaaaaaggcaggagcagagaatggagcagaaacacatggaaacaaagagaagcacctggagccactggcagcaggaaagcagggcaaaggcagaagaaatgtgcctaggaaagggggagggggagaaggagagagaattaggagtccaggcagcaagtgagctgatggatggttctcagccttggtgacagcaactggagtgcatccacttacaggccaggtgaacccacctacagaacccacctacaggccaggagggcctgggtgatggacagccccacctaggagatacttcagcttcccacgtcttcactaagttttctcttcataatttcttgagggatttcttttctttctgcagagggcagtgatgactgttcagaaatgtgtgatggagaagagccccaggaagcctctagctccctagcaagatgtgggtcaggtaaagaaggggaggatttctggccctgggctgcagagtgtcaggaggttgaatttggagcttgtgtttcctgattgtctttcctccaagtatacttcacagtgaaagaatgcaattaaatctgagatttttcacattttctatacatggatatttgagaaatgcagggaggaatcttgatatagaagtctgtgtttaacggaatgggttttattgtttgaacatatgtgtttagataatcacgtggtagttggattatgtcaaggcaaggcaatgtgttctccccttcatattctcatgcctattaatactgaagcattaaaatattttactgaataagatctcctgataccctcacaaaaccttaagatggggccagacaaactgggtaatcctattttacagatgaagaaataaaggtcagaatatgctaggaggaaaaaatgctctttgcctttatttttcttcactatcaatagtattacttgaatttaaaattctattctcactcactttttctatgggaatgaaaaagcttatcatccctctgctggtagatactttttatcattttattacaaacttgacaaagccttcaaagaaatggtatcctaccctctaattgacagaattcagatgatctctttatgagactaaatgctatttttgaccaatactcttcattatgttattggatcatgcagtatgtttttagaggactctgataagtgttacatttttaccctcagaaacctcaagatttaggcagggaaagtgctgttattgttgttttgaggagccagaaacacagacgtacatgtgacaccggtgtttgttaagacccaagaaggagggaaatgcggagaccagtgtcctggatgactccttacaggctttcagttctgtgaggcgggcatgggttagggtggggtcccatagactgagtccaatgtggatgcccaaagggtttttaggaatctgagagactctacctgggtttaatggaaagagacttttattaacaagtaaagcaagcttaaggagaggagtggaaaaattattgagagttagaaagtatgtaaatataatccatgatacgagataggagatatccagaaaaatagagccaggaaagatacacagagatagaatgtgcatagcagatgtagcatatcactgaaggagaaagagacagatattcagggagagatgtttggaagagaaagtccacagagccaaagagaaggacagttgccttcatagagtagcattctatgaaggtgtatgaagatataagtgtataccttcatgtgccttaataggcatagagtggggcaaggacataaagcacaggaccagggatgcaagagggaaatgagggaggcaggagcagtcccagaaaaagaaaccaagacaaggagaagtaccaagagagtccagcggcaagagacagaggtagaaacagaagaagcagagacatgtgtcaagcatgaaaatgagagtgccaacatggggtgggagaccaggtgggcaaggtttctgacagtctctatcagattactgggttgcacaagagctccttttaccctcacaaactcttaaacatctgtatgcaaacagctaaacgtctattttagactgagaaataaagcacagaaatgcaagcaggatattatcgcaaaggcaaagtagaaaaggaagagtgggcaccagtgtcctggatgtgtcactgggtgatggttgtgcaaggccagctgggggttcagggccgggtcacagggtcagaatagaaagaagcccaaggagttctgcaggttccctgaggagtgaaccagggatcaatgtaaggctttaaggaaaagaaaaatgctaccgggagggaagggagatcgtggaaacacagcatggaaatagagcctgctctatgggataggatggatctagaataagagctaaagaaataatagaaaagagatacaatatcactaaaaaagaaaaaagacatagaaacaggaggcaggagaggccagttggagagaagatcagacaatccaagcgctgctcagctaggagggaactatgtggaggcagaacggtgaggaggacactgagaattagagagaaggagaaagaggagatgtaacaagatggagaaaaggcggaacaagacaggggtggctcttagcattttcccatcttggatggcgtgaatgcactgaggtctgtgtccaagtcaccctctgtggtctgtcagtttcttgtttatctgcagagacctttgatctaaagactccccaagtcactaatgaaggagaaccagagaaggagctcagtctactaccaggtgaaggagaaggtaattatgatgtacatttttaggtatttgagtacatctttgttttccagttggcatgggaaaaaagcttccctttctcccatcctacccttctcttcttcacattcgcatacatacagatggaattatgtcaattttctgttgggctttttttgtaaattgtgagagacaaaggatcaagctaaggtgagcccctgagtggagaccatatccctgcatggagcatgtagggagatacaatatgccagaggtaggctgggggcaccagagaagaagttcctgggtgatgttattaaaaacacatgaaaccgaaatatcagcaggttatggtaattgaggcagggagattgttttcagcctactttcagaagtatcaggaacacagacgtaagttttgtgaatgattgaatgcttgcaattgagaaaagtcatgtggaagacccttgggatggagctgacaagcaaagcgtatgcagttttacagcccctgcgtaaacggaagaacttttccaacctgggagaagagaactttgagagtgaggaaaatatataaaatcgtggacattttacaggcatctaagaggttaaggtaaaacccaaagaaacagagacagaaaaggagaaagtgaaagacaaagtagaaagaggataatctcgataagaaataagaggcagagagaaaagttaagagaaaattatacaaatggaggcaaatacaaatgacaacaatgttggaaggaagcacagattaaactatgcagagaaagagatcaaaataattaaagtacccatgaagagtgcaaactatgtcggaggaaaggagcgggttgagggcctgtagagctgaagtcagagttactagacagcagcaacatccagcaaacggcacctctatcaatagtgagttttctgattaaggtccttctaggtagagagtgacacagaagcatactcagagggtaagaattctttctctccccgcagcctcatctgctcaggtagtggaatcattgtcaagcatttaatatctgtctgttaggcaggcctcccttccaagctcttccatctgtgtgcctgaagacttttatcttgggaccttctttattgcaatgtctttcaggaactgaacacctcacagtggaaaccagcacctcccctgaacttagaaactcctctttctccagggtttgctgtctcagtaaagggatgaatgtcctgtttgctcttctactcatcagactcattttttctgctttagcacaattgttatttgcaagatatcaatcagatcatcttcctttccccttagatgtggtgatctttgttgcacaggattagaagagttatccttcctgtggatttctgtggcttccacccttcatggggccccagcccatatcatctgtctcatctctactaatggcatcaatcatttcaggagctgcaatgatctgatctttcttttatatgtgggcccttgagccacacttcccctgtactatgtgttgttgccttggcccactctgctcctgatccccttccttatctggttcatttccactatcccaggaatgcctttcctgatacccagtatgaaaaagggggtgacaaggaaataaacaagatggggaaagctagtaaagagcagagtcaggggtgcaagagaaaaggatagaaacagagaaggggggcagaaacgcatggaaacaaagagaagcacctggagccactggcagcaggaaagcagggcagaggcctgagtctaatgtggaaagggggagggggagaaggagagagaattaggagtccaggcagcaagtgagctgatggatggttctcagccttggtggcagcaactggagtgtgtccacctacaggccaggtgaacccacagggcagaccaggaggacctgggtgggggacagccctacctgagagatacttcagctttccacatcttcactaagttttctcttcatgattttttgttggttgtatactgagacctctgagggatttccttcctttctgcagagggcagtgatgactgttcggaaatgtgtgatggagaagagcgccaggaagcctctagctccctagcaagacgtgggtcaggtaaggacggggggggggatttctggccctgggctgcagagtgtcaggaggttgaatttggagctcgtgtttcctgattgactttcctctgcatatacctcacagtgaaaggatctaattaatcctgagatttttcacattttctgtacatgaatcttttgtgaaatgcagggaggaatctttatacagaagtccatgtttaacagaatgggatttattgtttgaacatatgtgttcaggcagtctagtggtagtcaaaatatgccaaggcaaggcaatgtgttccctcctttatattctcatgcctttcaatactacagtattaaaatattttaccaaataagatctctcgataccctcacaaaaccttaagatgggggcaggcaaactgagtaatcctattttataggtgaagaaataaaggtcagaaatacggtaggaagaagcaatgctcttttgcctttattttttctagctatcaatactattatttgaatttatataaaatttctattctcaggaacaattttacactgttggtgggactgtaaactagttcaaccattgtggaagtcagtgtggtgattcctcagggatctagaactagaaataccatttgactcagccatcccattactgggtatatacccaaaggattataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagtccatgtcctttgtagggacatggatgaagctggaaaccatcattctcagcaaactatcacaaggacaaaaaaccaaacactgcatgttctcactcataggtgggaattgaacaatgagaacacttggacacaagaagggggatatcacacaccagggcctattgtggggtgggggaggggggagggatagcattaggagatatacctaacgtaaatgatgagttaatgggtgcagcacaccaacacagcacatgtatacatatgtaacaaacctgcacgttgtgcacatgtaccctaaaacttaaagtataataaaaaaaatttctattctcactccctctatggaaataaaaaagggtatcattcctctgctggtagatacttttttatgattttttcacaaacttgacaaagccttcagtgtaatggtattctaccatctaattggcagaacttagatcaactatttgtgagactaaatggtatttttgaccagtactttccattatgtcattggatcatgcagtggtttttcagagtactctgataggtgttataattttactcacaaaaacctcaagacttagatagggaaggtgctgttattgctgttttaaggagccagaaacacagaaatgcatgtgacacgggtgtttgataagacccaagaaaaaagaaagagcagagaccagtgtcctggatgactccttacaggctttcagttctatgaggtgggcatgggttggggtggggtctcatagtctgagtccaatgtggatgcccaaagggtttttaggaatccaagagactctaccagggttcaatggaaagagacttttatctaacaaataaagaaagattagggagagataaggaaacattatcaagagttggaaaatacttgaatgtaatctacgatacgagataggagatatccagaaaaatagagccagaaaagagaaacagagaggcaatatgaaaagtatatgtagcacatcactgaaggaggaagagacagtaagggagaggagatgttaagaagagaaagtccagaaagccgaaaagaaccatagatgccgtcatagagtaataaaaagatatcactagtagaaggggctatcacttaggctgggtgcagtgggtcacccctgtaatcccagcaatttgggaggccaaggcaggtggatcacttgaggtcaggagttcaaggccagccgggccaacatggcaaaaccccatctctactaaaaatacaaaaattagctggttgtggtcgagcacacctgtagtcccagctactcgggaggctgaaacaagagagttgcttgaacccgggatgtggaggttgcagtcagctgagatcacatcactgcactccagcctggtgacagagcaagattccatctcagaagaaaaaaagaaaaaataaggggccaccacttaatatcaaacgaaaggctgaatttattgttcagttaagggatagttgtgcttgtgggtcagtttctctgaacagagaacgtttgtggaagtgtggatctcggtgactggcggccttcaaaagtgagatttgttagtggttagctgacctttagtgaaagcagggtcactggagtgtggctgttactgactgtctgactttcagaagcatggggaagtcaatggttggctggctttcagaggcctgtgtactggccagaagctattgttgattaattgggatgattctggttgttattgaccatatggccaaacaataatgagttttcctagaagtgtagcaactttcaattatcagtttcccctttaggaaatctctcatctaaagctgcaggaggcaccatcaagtattttccccatccaagatgtcttttctggaagaggaccctggaaacaaaatcctaggattccccttcactgagtaggagttatagagttgctagattgagagtgttatccttgcaaaggatgacataagaaaaagtaatgatgttttacaatacgttaatggaatggcagacaactgttgaaagtttttaattagcagcagaattgtgctgcttgcaatactatcctatttattcccttttgctccaagaatactcaccagccacccttgtggctgcagcgtttatcccaagtaaatttgccatgaaatatcttgcttttattattattttcacatcactctaatatattgactttggaaacaaaagacattcttctaattatagcattctggttttagtagtggtatttccatttacaaaatacagtaattgttgatcactgaaaatgtcaaatcctggaaaacgtggctttcccacatgtgctgttaacattgttactgaacaattgttggccgaagattcatttgatgaatcatatatttttaaaatagatgattctgatatggttctgtttagaaataactccaagaacagtttatatattttattttcacattgaaaatcaatcatgtttgcttcagcctcaaagaatgtgtttacgtaaaattaaatgagtgcagcaagctgcacttttttttttttctaaacgggaacagagttaaagttgatccaagtacaaaatctccagaaccatggactaatgcagtcacctgcaattgctttgaggcaactaggatgagatgtggctactagcaatggctctttgatgtctgtcacgttttgaagtgatacccctagagcatggcctgtttgtttatttatttatttatttatttttatttttccgtaagttattggggtacaggttgtatctggttacatgggtaagttctttagtggtgatttgtgagattttggtgcacccatcacctgagcagtatacgctgcaccatatttgtagtcttctatccctcgcacccctcccactcttccctccaagtccccaaagtccattgcatcattcttacacctttgcgtcctcatagcttagctcccacgtatcagtgagaacatacagtgtttggttttcctttcctgagttacttcacttaggatgatagtctccaagccgggcacggtggctcacgcctgtagtcccagcactttgggaggctgagatggatggatcacctgaggtcaggagtttgagaccaacctggccaacatggcaaaaccccgcctccgctaaaaaaaaaaaaatacaaaaattagtcaggcatggtagtgtgtgcctgtaatcccagctactagcaggggctgaggcaggagaattgcttgaacccgggaggtggaggtggtaatgagctgagatcacaccactgcactccagcctgggtgacagaacgagactccatctcaaaaaaaaaaatagtctccaatctcatccaggtcactgcaaatgctgttaattcattcctttttatggctgcgtagtattccatcatatatatatatatatatatatataccacatacatacatatataccacagtttctttatccacttgttaattggtgggcatttgggttggttccacaattttgcaattgtgaattgtactgctataaacatgcatgtgcaagtatctttttcgaataatgacttcttttcctctggatagatacccagtagtgggattgctggatcaaatggtagttctatttttagttctttaaggaatctctacactgttttccatagcagctgtactagtttacattcccatcagcagtgtagaagtgttccctattcactgcatccatgccagcatctactgtttttgattttttgattatggccattcttaaggagtgaggtggtatcgcattgtggttttgatttgcatttccctgatcattggtgatgttgagcaattttttcatatgttcattggccatttgtatatcttcttttacgaactgtctattcatgtccttagcccactttttgatgggattgtttgtttttttcttactgatttgtttaagttcattgtagattatggatattagtcttttgtcagatgtatagattgtgaagattttctcccactctgtgggttgtctgtttactctgctgactgttccttttgctgtgcaaaagctcttaggtttaattaagtcccagctatttatctttgtttttctttcatttgcttttgggttcttggtcatgaaggccttgcctaagccaatgtttagaagggtttttctgatgttatcttccagaatttttatagtttcaggccttagatttaagtccttgatccatcttgagttgatttttgtataaggtgagagatgaggatccagtttcattctcctacatgtggcttgccaattatcccagcaccatttgttgaatagggtgtcctttccccactttatggtttgtttgctttgtcaaagatcagttggctgtaagtatttgggtttacttctgggttctctgttctgtttcattggtctacgtctatttttgtaccagtaccactctgttttggtgactatggccttatagtatagtttgaaatcatgtcgtgtgatgcctccagatttgttctttttgcttagtcttgctttggctttgtgggctcctttttggttccatatgaattttagaggtgttttttctaattctgtgaagaagatggtggtattttgatggggattgcattgaatttgtgattgcttttggcggtatgatcattttcacaatattgattctacccatccatgaagcatgggatgtattttcatttgttcaggttgtctatgatttctttcagcaatgttttgtagttttccttgtagaggtctttcgactccctggttaggtatattcctaagtttttgttgttgttgttgttgttgttttgcagctattgtaaaaggggttgagttcttgatttgattctctgcttggtcactgttggtatatagaaaagctactgatttgtgtacattaatcgtgtatccagaaagtttgctgaattcttttatcagttctaggagctttctgggggagtccttagggttttcaaggtatacagtcatatcatcagcaaacagtgagaatttgacttcctatttaccaatttggatgctctttatttctttctcttgtctgattgctctggctaggacttccagtactatgttgaagaggagtggcgagagtgggcatccttgtcttgtttcagttctcagagggaaagctttcaacatttccccattcagtattatgttggctatgggtttgtcataggtggcttttattaccttaaggtatgtctcttgtatgctgattttgctgagagttttaatcataaggagatgctggattttgttgaatgctttttctgcatctattgaaatgatcatgtgatttttgtttttaattctgtttatgtggtgtatcatatttattgacttgcatatgttaagccatccctgcatccctggtatgaaacctacttcatcgtcgtggattatctttttgatatgttgttggattcagttggcaagtattttgttaaggattttagcatctatgttcatcaaggataccagtctgtagttttcttttttggctatgtcctttcctggtgttggtattagggtgatgctggcttcacagaatgaattagggagggttccttctttctctatcttgtggaatagtgtcaaaaggattggtaccaattctttgactgtctggtagcattctgctgtgaatccgtctgatcctgaacttttttttgttggtaatgtttaaattaccatttcagtcttgctgcttgttactggtctgttcaaggtatctaattcttcctgatttacactaggagggttgtatttttgcaggaatttatccatctcttctatgttttctagtttatgtacataaaggtattcatagtaaccttgaatgatcttttgtatttcactggtgtcagttgtagtatttcctgtttcatttctcagtgacgttattcgggttttctctcctcttggttaatcttgccaatggtctatccattttatttaccttttcgaagaaccagcttttgtttcatttatcgtttgtattttttttatttcaatttcatttagttctgctctgatctttgttatttcctttcttctgctgggtttgggtttggttttggtttgttcttgtttctctagttccttcagatgtgaccttagattgtcagtttgtgctctttcagtctttctgatgtaggtgttcagggccatgaactttcctcttagcaccgcctttgctctatcccagaggttttgattgtcattcagtttgaagaattactgtcattcagcttgaataattttttaatttccatcttgatttcgtttttgacccaatgctcattcaggagcaggttatttaattttcatgtatttgcatggttttggaggtgccttttggagttgatttccagtcttattctactgtggtctgagagagtgcttgatataattccaattttcttaaatttattgaggctcgttttatggcctatcatatggtctatcttggagaaagttccatgcactgttaaatagaatgtatattctgtggttgttggatgaaatgttctatatatatctgttaaatccatttgttccaaggtatagtttaaacccattgtttcattgttgactttctttcttgatgacctgtctagtgctgtcagtggagtattgaagttctccactattattgtgttgctgtctatctcatttcttaggtctattagtaattattttataaatttgggagccccaatgttaggtgcatatatgtttagaattgtcgtattttcctgttggacaaggctttttaccgttgtataatgtccctctgtgtctcttttaactgctgttgccttaaagtttgttttgtctaatataagaatagctacccctgcttgcttttggtgtccttttgcaagaaatgcctgtttccacccctttactttaagtttatgcgagtccttatgtgctaggtgagtctcctgaaggcagcagatggttggtgagttcttatcggttctgtggttctgtatcttttaagtggagcatttaggccatttacattcaatgttagtattaaaatgtgaggtaccattgcattcattgtgctttttgttgcctgtgtactttttgtttttattttttaacttgtattttatttttgttttataggtcctgtgtgatttatgctttaaagaggttccgttttgatgtgtttctaggatttgtttcaatattgagagctccttttagcagttcttgtagtggtggcttggtaatggcgaattctctcagcatttgtttgtctgaaaaagactgtatctttccttcgtatatgatgcttagttttgctggatacagaagtcttgtctgataattgttttgtttgaagaggctgaagatagggccccagtccctcctgtcttatatggtttctgccaagaaatctgctgttaatctgataggttctcctttggaggttacctggtgcttctgtctcacagctctaaagattctttccttcgtcttaaatttggttaacctgatgacaatgtgcctaggcgaagatctttttatgatgaatttccctggtgttctttgtgcttcttgtatttggatgtctaggtctctagcaaggccagggaagttttctttgattattcccccaaatatgttttccaagcttttagaattctcttcttcctcaggaacaccgattattcttaggtttggtcatttaacataatcccagacttcttggaggctttgttcatattttcttattctttttactttatctttgttggattgggttaattcaaagaccttgtctttgagctctgaatttctttcttctactttttcaattctattgctgaggttttccagagcatttcacatttctaaaagtgtgtccaaagtttcctgaattttttattgattttctttaagctatctatttgcttgaatatttctcccttcacttcttgtatcatattttggatttccttgcattgggctttgcctttctctggtccctccctgattagcttaataactaccctcctgaattcttttttgggtaaatcagggatttcttcttggttcggatccattgctggtgaactagtgtgatttttggggtgtgttaaagagccttgttttgtcatattaccagggttggttttctggttccttctcatttgggtaggctctgtcagagggagggtctagggctgaaggttgttgttcagattcttttgtcccataggatgttcccttgatgtactattctcctcctttttctatggatgtggcttcctgtgagccaaactgcagtaattgttgtctcttttctgggtctagtgacccagtgagtctaccaggctccaggctggtactcggggttgtctgcacagagtcctgtgatgtgaaccatctatgggtctctcagctgtggataccagtgcctgttctgctggaggtgaagggggtgcaatggactccatgggggtcctttggtggtttaatgttctatttttgtgctggttggcctcttgccaggaggtggcactttccagagagcatcagctgtggtattatggggaggaaccggtgatgggccagccctagaattcctaaggttatatgccctttgtcttcagctgccagggtggataaggaagagccgtcaggtgggggaggggctaggcatgtctgagctaagactctcgttggacatgtcttgctgcagctgctgtgggggatgggggtgagattcccatgtcactggagttgtgtacctgggaggattatggctgcctctgctgagtcatgcaggttgtcagggaaatgggggaaagctggcagtcacaggtctcacccagctcccatgcaaaccaaagggccagactcactcccaccatgccccgccccaacagcccccagaccatttccaggcttgaaaacctgccccaggctatctgcctcccagctgcagaagaaaaaggcttggttcttccccacctgtggagtctgcacaccggatttgcgccctcacaagagttctgtccaggaggcgtctcaccctgttcaaattgttacaaagttcagctagagattggcttctccctgtgtagttttaccccctgctcctctcccattgggtccctgtggtgccaggcaggaatggccttctaggggacccagccacctcccaggccctttccgctgcttccccctacacctgtatttccctcatctcttcagattgactcagctccaggtaaagtcggaaacttctcccacaaacagaccttcagcttctccagtgggggtgtgtgttcgggagaggagggtctccttttcccacttctgcagttggggcactctcagttttacgggggggggcggtctcctgggtcctgcaggtgcaatctgcttccttcagagggtcatgttgcctaggctggtcacgaaccatggcctattttttatgtacgtataaaagaaaaggattatgataaaggagaaagggagacaggagacctgtctcctgataatgtgataatagaagattcagtgtgggtgactgatgaaggagtattttaaaatcgtgaagatctgttccatttctgtgttccatgagaatggccccaagatatttgggtcaaatgtagggaggcctggtatttcagaaaagattgacccccattgtcttcaagactcagttaatcctagaaatcctcttatctttccttcagtcattggtcttgggaaactctgaagacattgtaacatttctttatataatattatttcctcagccaatagattatgtctgagaaaatagcctagtttttgttttgtttcattttgtttgttttacaaacttggagtttttccttagaagttttatgtccatttttgcccaactcaatgaatagattaagaaatgtctagatctatagagtataatagaggtgacctatgcatcagatcagagaagatgcaggtatgagctttgtatcccttaggccgtatttaaaacttggaagaagatggttgtgttcgtttttcattgctgcatgacaaataaccacaaatgtaatggcttactacaatacccacttgttatctcacagtcctgccagcagaagtgtgggtgggctcaacttagttctctgcttagagtctccttaggctgaaattaagatgtcagcccagctgaagtcttggctgaaggctctgagaatcttgcaatcgagctcacccaggttgttgacataatccagttcctcgtggttgttgaaccgaggtcacagctttgttgctggttgttggtcacggaccactctcagctcctggaagccaatcatattccttaatacattgcccctccatcttgaagccagcaatcttgtgtggaatccttctcacactttgaatctctgacttcctcttctgctgctggctagagaaaactccctgctcttaaaaggctcataaggttaaaccagatccactctattagtctctcttaaggacagctctgccatatcacataaggtaattatggaagtaatatctcattatgttcacagtcctcaggattagggaaagaaatatttgggggccatcttagaattctgcctatcgtcaaggaaattcctagaaaataactgtccagataagccactgattttcccaagcaaataatatttatctttatcaagtgagacattaaacaaagctgaacataaatatattaaaaattttggctttaggtgagactgaagagattgtagtaatctggttaggaggtacagggaagtgaggtatacctattttgtttattgcttgcagacctcaaatcatccgtagtgtaggtatactaatggtcaggtcaactatacatagatcatgtgtcagagaattttccaggacttctaaaattagtccttcttctgaacctttaatctggtagttctatttgcagaatagatccctacctattacatttatagaggttttgttgaaaacagtgttcctcagataatggtctgaaagtaatagattactggttgagatgtggaaacattcagtgatttttttctcttcttttatagacctacttgtcaaatgtgttacttactttggacatgacaaaacctccccattgcaagccagagtcattttagggaaaattttgccagttattaagaaaagtacaagagttagaatcatgatgaaagtatacagaggaagtgaacattttgtcggggagattatggctttggcaaagacaatcccgtgacaaacagcaaagaggccactatatttcagtataagtgtgaatggtgtgttccacatgaatgaagcagaaactgaaaaggggacatatgattaattacatgattgtagttgactccagattacatactaaacaaaatgattttctttcacaaattgacaagacactaggtgccctcatgaaggttttgatgagggacccaagaaaaaatgtgaccgaacatctttgcacagtttggctactgtctaatggacccacatccattagttttaggggctggcttgaattgaggacttatcagaccttgaccaccagctgtttgctttggatcactgtcttctaacattcagaaagcacaggaaaatcaggaacaagcacacatgaaataagactttttgtttttttggtggggttttgctatgttgcccaggatagtctagaattcctgagctcaagccatctgcctgtaatatgacctattaacaggcataagccaccatgcctggcagagataagactttttaaaaatagacagaagaggccgggtgtggtggctcatgcctataatcccagcactttgggaggccgagatgagtggatcacctgaggtcaggagttcgagaccagcctggccaacatggagaaatcccctctctactaaaattacaaaaattagccaggcgtggtggcaggcacctgtaatcccagctactttgggaggctgagacaggagaatctcttgaacccaggaggcggaggttgcagtgagccgagattacgcggttgcactccagcctgggcgacaagagtgaaactctgtctaaaaaaaaaaaaaaagacaaaagaaaggtaacagtagatgaagtagtgaaacaagtaaataagtaaataagcacattaattgagaaaatgtttgctaagtggtgtacttccaactgaaaatatctaattgtatctaattgtatacccatgtttaaataagataaattcagaactaggagctcagtgaaacaagtcagagttcgagttgttgttgagaaagattcacttggcagtaggtcagaaaaatgacctgagctggacacagtggcctgagattcatgcctgtggttccaagggtcccacaggacactccccagcaagaatcttcaagataatctcggcaggaactccaatttttgaagggctaggctactactcataatctgaaactaaaagctgatttattcctagctaagcaaggcacctagtgggaggaggccctgtgcttgtaagacacagtctctatagaaaaggaaactgcagttttatagagagttttaggaagcatattgtgtagggactccagaccttcagaaacaggagtgtttatgagtaatttagcatttggccatcaatgcaggctttgtggagggggtgttgctgactggctgggcttcagatatgtagaactgccagtaatgggctcgctttcagaaatgtgactggggatataagtagtcagtggccaattgggatgagtttaaatagttgcttttcactattgtcaaagaacagtagtattttctggaatgataagagtttccttgctttattctcaggactacaagtacaaaaataaaagtagagaaaaggaggatgaggtgcataacatggggagagcgtggctctgttatgtgtcaaatgtgattattggagcaggtatatttttttccagagaacagttcatcttagctcagaatatcagtgtgcagtatagcagcactggaaactcttctgtggtcattgtctcaggatccttggacaataattttcttgtttctcattagtgtctagtgaactagaaaatcacccaatgaatgaagaaggagaatcagaagagcttgcttctagcctgctatatgataatgtaccaggtaattatgacttaaaaatagtgaaaacagaaacagagttctgataaagagaaaaaggaggagaaaaaatagacttaaaggaagagtcaaatataaggaggagcagtgaaaggagaagatttcagaggaaaaagtaaagaagggggagcaacaagggtgcagaaaatagagtcactgggtcaaactgaaagtcttcatgaatcacaattttggcccaggagcggagcaatcagcatatgaaaatgagaagtgttcctgtgtcatgtgtttctcagaagaggtgccaggaagcccagaagcaaggacggaaagtgatcaagcgtgtggcacaatgggtaaggctgtctgagggccgtgggatgggggtggctcagtgggccccacagacccccagtagggtggaggtaggtgctccagtctgtccagaattctattctccgcatttgcttgacctgagcctttggggagctgcagggaggcaagagatcgttataaagtactatttaagaggatggactctgttgattagacatagatgatgtcatagaagtatactctttgcaatggcacttatcttgtgtattgcattagtatattaagttacacccaatcttccatgaagcccaggataccccagtgaacttctgctggtagataatagtgtcactttgctacaacttagaaaggccacactcaaaagacaactaatcccggtacttaattgtcaggaggaaagactgcaggtctactcttcttagcccaacacgtatttttgatagaagacccagggcccatcctagactcctagttctcagttcggtgggtttttggttcccctagaagaaagagaggaatgattatccaagcatctgtataaactcaagccttctgtagtatacattgtcctaaaatctataacttttatttattaatttctgtttcctcaccaccacttgttattttccagatactgtggatattgcaaacaactccactttgggaaaacccaagaggaaaagaagtaagaataaataagaatttatttgcttttggtattacaaatacgtttttaatgccagagttttaattttgtcattgttactatttctgttattatttgtaatactgtggtagacagaaggatgacctccctaagatgtctacctcctaatccctggacctgtaatctgctatcttacatgacaaaagggactttacagatacaattaagctagagaccttgaaatggggagatgatcctgggttatggggtgggcacaatctaatcttgtaggccttaaagagtggaaaacttttcctggctgtggagaaaggaagatgtgactatggaagaatcatcagaaatatgtcatgttgcaggctttgaagatggaagaagggaccaaggaatatgggtgacctctaggagctgaaaagacaaggaaatagcttgtcctttccagctcccagaaaggaattactttagccagtgagacccatgtcacacttctcactgacataactggaagaaaatacatttgtgttgttttaaaccactaaattggtggtaatttgttatggcagcaattaagagtaatacagattttggtacttagaagtagggtgtggctattaacatattcctgaaagtgttggcatgcctttgggattgggcaatggacagaggctggaagaattttagattatgatcggaaaagcctatattgccttgagtagtccttagtagaaacatggatgctaaagactgtgctagtgaggactgagaaggaagtgaagaacatgggagagaaagcctatattgcgttagagaaaacctggatcatcatgagcagactgttagtaaaaatatggaggttaactgtgttactggtgagcactcagaaggacataagaaagatgtggaaagggcctccttattatatagtggtctgtcctgtactcatgtgaaaagcagaactttctggatctatagctaaggagatttccaaacacagtgatcatggtgtgttgtggtgtcttttgctaattatagtaaaatgcaagagggaagaggtatattgaaggaagagctgctaaacgaaaaagaatcaagtcttgatgatttagaaaattcccagcctatccaggtcaaaaaacatgataaaatgaggagattcactgtcagggacgtgtgcttggtagaaacaacaaagactttttgccagttccctgggaagtagtgaaaggtcagattatacattcacaaaaaaagttatttgaagagacgtagcatgtgactcataagtccctcagccatctcagcagaagtcaaaaatagatgtgcgttgctacaaaaagaataaaatacctaggaatacagctaattagggaggtgaaagatctctacaaggagaactaaaaaccactgttcaaagaaatgacagatgacacaaacaaatggaaaaacattccatgttcatggataggaagaatcaatatcattttaaaatggtcatactgcccaaagcaatttataaattcaatgctattgccattaagctaccattgacattcctcacataactagaaaatacgattttagaattcacatggaaccaaaaaagagcctgaatagcaaaggcaatcctaagcaaaaagaacaaagctggagatatcatgctacccaatttcaagccatactacagggctacattaactgatatggtttggctgtgtccccactcaaatctcatcttgaattgtatctcccacaattcccaagtattgtgggagggacccagtggcaggtaattgaatcataggggccggtttttcctgtgctattctcataatagtgaatatgtcttcatgagatctaatagttttataagggggagtttccctgcacaagctctctctctttgcctgccatcatccatgtaagacgtgacttgctcctccttgtcttccaccatgattgtgaggcttccccagccacatggaactgtaagtccattaaactctttttcctgtataaattacccagtcttgggtgtgtctttatcaacagtatgaaaacagactaatacagtaaccaaatcaagatggtactggtacaagaacagacacatagcccagtggaacagaaaagagaacccagaaataagaccaaacacctacaactaactgatctttgacaaacctgacaaaaacaagcaatgggaaaaggattccttattcagtaaatggtactgggataatcagctagccatatacagaaaattgaaactggaccccttccttacaccatatacaaaaattatctcaagacagattaaagaattaaatgtaaaacccaaaactataaaaaccctggaagatgacctaggcaataccattcaggacataggcatgggcaaagagttcatgacaaagatgccaaaagcaattgcaataaaagcaaaaattgaaaaatgggatctaattaaactaaagagtttctgcacagcaaaagaagctatcatcagagtaaacagacaacttacagaatgggagaaaatttttgcaaactatgcatctgacaaagatctaacatccagcatctgtaaggtacttaaacaaatttacaagaaaaacaaacagccccattaaaaagtgggcaaaggatatcaacagataacttttcaagagaagacatacatgcagccagcaatcatatgaaacaaagctcaacatcactgatgattagagaaatgcaaatcaaaaccaaaatgagataccatctcacaccagtcagaatgactattattaaaaggtctaaaaacaacagatactgacgaggttgtggagaaaaaggaatgcttatacacactgttgctgggagtgtaaactagttcaactattgtggaagacagtgtggcaattcctcaaagacctaaagacagaaataccatttgacccagcaatcctattactgagtatatacccaaaggaatataaatcattctattataaagacatatgcacatgtatgcttatctcagcactgttcacagtagcaaagacatggaatcaacctaaatgtccagcaatgatagactggataaagaaaatgtggttcatgtacaccatggagtactgtgcagccataaaaaaagaataagatcatgtgctttgcagggacatggatggagctggagagtattatccttagcaaactaatgcaggaacagaaaactgaacaccacatgttctcacttataagtggtaacgaaatgatgagaacacatgaacacctagaggagaacaacacacactgaagcctatcagaaggttcagaaggtgaagggttggaggagggagaggatcaggaaaaataactaataagtatgaggcttaatacctggatgatgaaataatctgtataacaaacacccatgacacatgtttagctttgtaacaaacctgcacatatatccttgaacttaaagtataaaaaaaaaaaaaaatagatgtgtgaattcctaggaaagatctgtagggaagcttcatgtctaatggaggaaatcagaaatccccatgatatatgcaggagatccataagactcttgagggttttgtaccaagagaaacaaagatttccatgtcctatctcctagaacctataatctgttactttacatggcagaagggactttgaagatgtaattaagttaaggatcttgagataagatcacatgggccactaaagtcagagaacatatccttctgtcgagagagggatgtgtgactatggaagaatggtcagagagaatagagctggatgtggagatggatgcaggggtccatcaactaaagaatgtgggcagccttccgaagctggaaaaggctcctctgtggcctccagaaaggagcaaagccctgcagacaccttgattgattttagccctgttaggtgcatgtcagatttccaaccctcagaattatgagaccacaaatctgtgatttttttgtcactaaatttatggtaatttattacagcagcaataccttttgtaagacaaaaaaaaaatttcaccctatacggttatattcaatcttctaaactaacaatttatattttttcaaattacttacacctttatgctttttttttctgattttaaaatacttgttccctgtaaactttgctgtacatatttctatatttttttctatgctttgttagcacatttagaattatgtgatatatctaaatgaatacatttaaactgttacatttctttttaaatcaatataacatgcactggatattataaacatttaatatcttgccaacttaactgtaaaaaaaagttttatttcattcctgttttaacttacattgctttcatttttggtgcagttgagcattcttcatttgttattggccatttttgtttcttctcctacgagtgcctggaacttatattttgccagtgtgttgtctttttttccccatgctttaggacaacaggaatacttatatatgatatatactaagggttgactacgtgtgttgtcatatttgatgttattcttttacgtttctttgtggtataggcacatctcgtttgattgcacttcactttattgtactttgaggatattgtgagttttacaaattaaatgtttgtgacaaccctgtgtcaaaaaaagtctgttggtgccctttttccaacagcatgtgctcactttgtgtctctgtcacattttggtaattctcgcaatatttcaaattttattattattcttcttcctgttatggtagtatgaacagtggtaacaatgatctttgatgttactattctaactgtctatggcaccacacactgtgttcgtataagatggcaaacctaataaatgttgtgtgtgtttcaactgcttcactgaccagctgttcccctgtctctctccctctctttgactttcctctttcctgagacaaaaaaatatggaaattaagtcaattaataatcctacaatggcctctaagggctcaagttaaaggaagcgtcacatgtgtctcactttaaataaaaagctagaaatggtgaggcttagttaggaagccatgtcaaaagctgagaggctgaaaactaggcctgttgcagcaaacaatcagccaagttatgaagtgctactccagtgaacatacgaataataagaaagtagaacagtcttatcgctgatatggagaaagtatgagtggtctggatagaagatccaaccagccacaacattcccttaagccaagccttaatccagagtgaggcctaaactctcctcaattctatgaaggctgaaagatgtgagaagctgcataagaaaagtttgtggctagctgatgttggttcctgaggttgaaggaaagaagctgtctcataacattaaagtgcaaggcgaagctgcaaatgctgatgtaaaagctgcagaaggttgtccagaagatctagccaagatcctagatgaagatggctacactaaacaacagttttacagtgtagactaaacggccttttattggaagaagatgccatctagaactgtcatagctagagaggagaagtcaatgcctggtttcaaagctccacagaacaggctgagtctcttgttagaagctaaggcagcaggtgactttcccttgaagccaatactcattcaccattctgaaaatcctagggcccttaagaattattctaagtctactctgcctatgctgtataagtaaaataaagcccagatcatagaacatctgtttacaacatggtttactgagtattttaaacccactgttgagacatactcctcagaaaaaaagattcctttcaaaatattactgttcattgacagtgcacctagtcatccaggagctctgatggagatgtacaaggtgattagcattatttccatgcctgctaacacaacgtccattctgcagcccatggatcaaaaagtaatttcaacttgcaagtcttaatatttaagaaacacatgttgtaatgctatagctgtctctatacataatgattcttctgatgaatcttggcaaagtcaattggaaaccttctggaaaggattcaccattttacatgccataataacattcatgatatatgagaggaggtcaaaatatcaacattaacaggaatttagaagaagttgattacaatcctcgtggatgactttgaagtgttcaacacatcagtgaagaagtaattgcaagtgtggcagaaatagccaagagaaccagaattagaagtggagcctgaagatgtgattgaattgctgcaatctcatgataaaccttgagtggacaaggagttgcttcttaagaatgagcaaagaaagcagtttcttgagatggaatttatacctggtgaaaatgctgtgaacattgttgaaatgacaacaaaggatttagaatatattagttgataaagcagcagcaagatttgagaggatctaccgtgataaaatgctactcaatagcattgcatgctacagagaaatctttcaggaagagccaatcaatttagcaaacttcattactgtcttattttaagaaatttccacagacacctcagccttcatcagtcaccaccctagtcagtcagtagccaccaacatccaggcaggactttccaccagcaaagagattatgacttactgaaggctcaagtgatcatgagcattacatttagcaataaagtatgtttaagatatgttcattttattttagacacaatgctattgcacacttaatataccacagtatagtgtaaacataactttcatatgcactgggaaaccaaaacatttgtgtgatttaccttattgcaatattcactttattgcagtggtctgaaaccaagtatttctaagatatgcctgtatctttatcccaaagaagcttgaaatttttatctgatcaaatctgtcagccttttcatttatggtttccaggttttatgtaaaatttgcaaatatattgtccacctcataatttagaaacatgtttacttacttctagaatatttggaatactttttaatgtttaaatctataacacacatggaattcatttattggtatatgatgtgagatggtaattaagagatataacactggtagtttttttcttcatgattcaaaatactattttatgtatgttttccagtatatacagaactgtgtcttatcacatttctttatccattcatctgttgatagagacttaggttgtttctatgtcttaactactgtgaattatgctgcaatgaacatgtggatgcagatacctctttaagatattggtctcatttcctataaattcataccccaaagtgagatttctggattgtatgtatttctgtttttaactttttgaggaacctccatactgttttccataatggctgtaccaatttacattcccacttagagcatacaagagttccttttccccacaacctcaccaacacttgttatctcctgcctttttgctaatagctatcctaataggtgtgaggtgatgtttcattatggttttgagttacaattctctcatgattagtaatgttgattgctttttttataatccattggccattatatgtcttctttgggaaaacatttattaagatcctttgcccatttttaaatcagattatgacatgcttttgttttgttttgtttttttgctattgagttatgtgagttccttatatatatttaggtagtaacccttatcaaatacatggtttgcaaatgttttctcctattccgtaggttgccttttcatttttacaattatttcatttgctgtacaaaagctttttagagtgatgtaggtccacttgtttatttttgcttttgttcctgtgcttctggtgtcatatctaaagaataattgcccagactaacctcaaggagcttttcctctgttttcttctaggaattttatggttttatatttgacatttaagcctttaatctattttgagttaatttttgtatatggtgtaagccaagcgtctaatttcattcttttgcttgtggatattcagttttcttaggaccatttattgaagagactgtcttttctccattatttattcttggcacccttgtcaagattaaatgccccttcttgacatctgtattcagcatagtgatgtaagtcctagtcagagcaagtaagaaagaaagaaaaggcatccaaattggaaagaagttaaattgtctctgtttgcaggtgacatgatcttctatgtagaaaaccctatagactccatcaaaaaactgttggaactaacaaatgaattagtaaggttgcagaattcaaagatcagttgtgtttctatgcactaacaatgaactatccaaaaaataaattaagaaaacaatcccatttacaatagcaacaaaaagaataaaataggaaccaagttaacaagaggtgaaatatttgcacactgaaaactatgacattgatgaaagaaattgaaaaatatacaaataaatggaaagatatctcatgttcatgaactggaagaatagtgttaaaatgtccatattacccaaagtgatctgaagagtcaatgaaatctctatcaaaatttaaatgacatttttcacagaaataggtaaaaggaatcctaaaatttgtattgaatcataaaagactccaaatagtcaaagtaattttgaaaaaaaaggaaacaaactggaggcatcatactgtctgattttaaactatgttacaaagcaagagtaatcaaaaccatatggtactgtcataaaaacagacataaaccaatgcaattgaatagggaacccagaaataaacactcatgcatgtatgttcaagtaatctttgataaggacaacaattacagaattttctttatgtagatgttccacgcatccacttttcttatctgctttattgagctgtaatttgcataaaacaaattcatcaccttaaggtataacctaatttgttttaacaaatgtgtgcagttatataaatacctccacaatcatgacatgtatcattttcatcaccccaaagtccacttgcattcttctctccattctctggttctcgacaacagctgatctgttttttgctagtttgttttttaaaagatggggcctcactgtgtgttccaggatgaccttaaactcctgggctcaagtaatcctcctgcctcagactcccaaataagtgggaatacaggcatataccacccctaaaccaaggtgtttttttttttaatttgcaacctaatgtgtggtcaatatttgtaaatgttttctgccccttgagaataatgtacatttgaactatttgttaggctctggcttcactccatatatatcttttttatcaagcacaactttcttgtttaaatttgtgtccatagtaatttaaattttatttgctccatcagatttgcatacaaatgtgttaaattcttgcacatggttgtatatttgccaattcctctttatcttgttgctttactttaaatattttgaggctatttatgatttgtaactttttaatggatgtttttcttttatcattatacagcattctgctttatccctgttaatgcttttgccgtaaaatctcttttgccaagtactaacattgttacacaaacttttatgattttttaaaaatattttccactcactttatgtgatgcccttttgttcagttttcttttatgtctcttgtaactgcacttaacttttgtagttttgtctgatattcctagcttcttaataggtaaatttcaatttgtttacatttattgagtttccagatgtatacggacctatatcttctgtggtattgttgaccattctctatttgtatctttcgtgtctccttcctgctttttaatggattggtataaaactatatattctcccctttctccctgctggtttggaaattaaagataaaatttctgtaagcttttaaattatgccccaatcccaaaagatgacaaggatcttatcatggtttcactacaaactgaacaccccatctctaccattttggctattgtttaatattttatttttaactataaattttgaaactattatcatttttacagttgatatttacttaatttaaaaaaatattttgtatactcaccattgttctttttctttggtttcactttttgtctagctgaagtaaattctttgttttttctagtgagtgatctctaagtggtaaactctgtaagtgttgggtgtacaactttttctttactttgatagaactttttagctacattaaaaattccaggtcgataatttatttcttctcagtatagtaaggtgattactatattatttcctggaatctatggtgtggctaataacaattattctcttattgtaactaactgtaacttcttggtaaatattctgtcctttctctctaaaagcttttattccccaaaatttaatcacgaaaattttaagcatacagaagacttgggagaattgtacactaaacatcaatatactttcacatagattcacaattaacattgtatcattcctgctttatcacttttctattcatctatgcatttctctatccactcactaaccggtggtcaagtttgaaacatttcaaggctgcagacgttagcactattccccctcaactacgtcagaatgtatatcattaagtagagttcaatgtatgtttagagttcttttgttaagataaaatttacaatgaaatgcacaagtattaagtgtaccatttgatgagttcttataactgcatttttctgcaccatcaaaattcttatcaagatacagaacatgatcatcaccctggaaaggttccttacgccctttctggtgtatctccacccactatccatcagggcaatcactactcttctttttaactatgataatttggcttttaaaaaactttatataaataaggttttatagcatattctctttagagtgggatttatttcacacagcatgtttttgagattcatccatattgttggatgtctcagtagtttgttctttttcattgctaagtagtgtacattatctggatataccaaattttgtttataattctcctattgatggacacctcgagttttttaagtttttgctattatgaaaactctgctgagtacattcttgtaggagtcttcctgttttttcgtatctcctgcataaatacctagaaacaaaattgccgggatatagagtagatgcatcagttctttcccccaggacccatgaaaaggatggtgcagagcaagcccaggtggatgctgcactcataggtgtgtgcagcagcagaagaatgcttcactgaggaaacctatgggattataaggggaccaatagcaaacctgcccaaaccttacctctgagggagacattatctttttagctggaatttaagcaattctcctctggggatattaagcaaatctcctctggggatcttaagcaaatctcttctggaggcatctcctctggaaaatttctaaggagggagatgttctctactttatactggtcagggatacatttgccctataatctggaggctacatgatctctagcttccaaggccgctttggtattcaaatatccttgaagtgatactctgaggcacgtagaaatgccatggagaatggcctcccagcaaattcaccccacatttttgcttctggcaaatttccccatgaagacaccaccccatcagccactctgattattcggacccatgggtccacatccattcaatttttttcctgcaacatttaacaaatcttgacccagtgcagcggctcactcatgttatcccagtactttgggaggccaatacaggaggatcacttgaggtcaggagttcaaaaaccagcctggacaacatagtgagaccccgtatctacacacacacacgtacccacacacatttcataaactgtaaacgatctaggtcccttatgagcacctctaaggtacaagtccttatgtgagggaggcaagttagtgcctggctttcatacaagaagcacaatcccaagggcacacgtggtgctcccagaagggaagtgtatacaattgttgggcttccctgagtgggatgtacattagtaagggagaaggtgaacagtgtctcttacgtggctcctggctggctgtaagccttggggttcccagttctgtttatccttgatttgtttgtgtgtggctggggagagggtgggcatatgggggactgcttgaggacagtctgtccaatctgtcctatttgtccatgtcaccaaccaggtggcagtcccccctaacaaatgactgagaatagtggtggagactatgtctagagggttctgtgtgggacctcagaagctgggcccagcccctgccatctcatggctggtgcagagaggctgactcagcattctcagaggcgggagcgctggagtagtgtgttttccttctggacaaagcatccttgggttcttctgaaagacagatatcaccaatgctcctgttttctcccatacctctttagatgtctggatttttgctcttgcttcactgctgcaaaatctgctataccattccagtggctgtaccttcatcttttgccctaattatctccttttctcacttagactttccatctacaaaattagatagaagtagaggaaaagcattttataaaatgtgcctggagttaaatctgaatccctaggcactttgaaggccatagccaccaggctggtaggggaaagaatgaggcatcatccctaggaatgaccagggtcacaacagaatcctgaattttcaagataggtctacagaacactcgcaatccccaccacttttgtcctggtcactatccaggaaggagatgatccctttctggagattgctcccttcaatgagcctactgccctcccatagtgtgcggacaggaggagatgagggacagtcagaaaatcagtgcactgtggagtcacttttctgataaagggcacgtcagactgcaaatggcccagatggccagtttgaggacactgatgagtttctggggtcaccatagcgttcctggagtcagctgctctgcagcctgaaggagggctgacagtgtggaggcagtgctgagattatttaaggaaactatatagaaattctataatgattatgtaattacataatgaaaactctccatatcagagttcagaatatctcccaatttccaacacagaatattatccataacaccatcaacctcaaggaggatgtcctctcattgcacatttgaatttacacaacaaacacttgaaaaagcaacatgaaacagcagttatcattcactttaaggtgccagcaagagttaattttccattaaaaattttgttcaaaggaacgtcatctcctgtagtctctcccaagcccatggcccaaggctcatgcagaggtaaaatataactctgtactcaacctccacgctgctacactgatcataaagtattttgccccattcctgcggaccaaagtatgaaaaaaaatctttaatactattggcatataaaactcagagaattatatttatacctctgcataattaactttattctctttggtttgaaggaaaaaagagggggcatggctggagcagaatgagaatgagaaggcaggaaaacagccaacaaaatggtaagcaggcaaagtgaagtagttacagcttttgagtttattagggcactgtccattgtattctggaaggcctgcagttccccagagccagagttctatacctcctgtatccattaggatgtagactaacaggctgtgacaaagaggcctgagaatgcaatggcttcaacaaaatggtttctaatgcatgtaatagtccagaggcccacagttaatagggaggtgttatcatcctcagtatgactttctttcctagctcaaagtatttttattaatttggaaagacattcctaagagggctaaatgaagaaatcagggtgtatgtgtatgtgtgcacaatagtaaacatacatatatgtataaccatattttatgtgaaattcatacttgtgaagtatatttttatgtatcctgatatacacatatgtaattatttatctgtacatataaaaagacataaatatagaaaaatagatggcagttcattcataaaaatatatgcagtggttacatttggtcagtgtaatagaggtgatgtttatatatttttatctgtggtttttaaatgtatgtgtatatattaaaatattataaatcttcaacatttttaatgaaaaagtgttattcaaaaagtaacatatgcaaaaagaaaagactaggagaatatttttgcacaaatcatcatctggagatagccatcctcatctgtggctatctccaatggtgatgtttcatatcattttattttctgaatttcctgtaaatatatttattctttataatcaggcccctgaaattttcaaaatttattttagccatggtctgaggacttccattcttctagacgatgaaggctaagtctcattttctaaatgattgtcaattttgaatcagtggatctaaatagtaagattttagagtcctattgaaagttattaatttttaccaatcttgccagttgatgtggcttcctggttggtggatgtgacagctttgtttggaaagaaaaaaaagtggctgcgtgcattttaagaatggctgttttcaaattgaaaatttgtttggactcaatcattataacattttcatttaagtctgaatcattataacattctcatttaagtctgtgtgtatgtagacaaattctaagagacttcaatgtgcaattaaatcctgtgtgtaacttaaaagtcgacactcccaaaagcaaaaaatgctctggacacctgctcgaggggatccagaatgagacccaggactccctcacttgcgtttgttcctgcctgacagctgttgttctgcccagttctattaatacattttcccctgcctatccccagataatagcaaagccgacggccaggtggtctccagtgaaaagaaggcgaacgtgaatctgaaagacctttccaagattaggggtaagataaagtttgtccgctttccctttgccctacaggtcaatacaaattttactgaggtattgacgagcctagatccaccttaattgtttactcatcaagcttagtcaattggagagcagtgaaatctaaaagagcaaactcattataagcaggggttgtaagttgattgtattcatatcatagatcttatctgcccagtttctaaaatagttttcctctgtgttttatctcattttcctggaaattcctttgcctcaaatcattgttttattaaaatggctggacctggtaaattgtaagccgaatacaggtttattctctcactgccctttcaagtcctcctcctagatgagttctttcctgtcttgagcaagctctgtcgctttcttgttcccttttaaaaacagtaagagtctcatttcagtagttgggacctttctgacctagtattaaactacaatgtcttccccagtttaaagcaccttcgcttcttcagcctaggcaagccttagtctggaacacatatagttgggggtgacatggtcagtgtcttctcttattctgtcttggccctacccccactccatagctgttggcttggtcccatccaggattggggaggtgagagagatgggtgagatcagagtgtggaagtgtcttgcctgacaggtgcagccgtgaaatgacattgcaagtggttgatgcacaatcactagctctttcttccatgagatgctttcatcaagtccactgcaagggaaggggaggggtcaggcatcacagcttgacttattttgaaagaaatagagctttacttctacaacctggatgtgagtgaagggctgaacctggcataatcagttccaccaactctttctaaggttacatatgtggcctggtgcattgtcctaggatgcgggtgctcaactcaacctacttgcttgggactttctcaattttcccaatgaaactctcatttccaagccataggtccactttgggtctgattggtcctttttactttggtggcctaatatgctcatgatatgcttagaacttatagtacttaggaatgcataggctggaaaatatttcctcatgggcctacatgaccctgatcagcacccccagatggtggtcattggatggtggacatccagcacaagaaggaaggaacattttgctttcctgccttggaaaataaaacacatttggacaatagtaaacattgagatgcccattcacagccaattaacatgcacttgggagaatatcatcggctgcagtgtctgccatgtcaatccttaattactatttggaatgaaggctgcggaaatctcaattctacccattcctcatggttaaccttcttctgattagtttcttagatcctaatatttattttgtccaaagccatgtggacaaagccctggtcacatttactattactttcagcacgagggtacaaatatcttcccccaatgtgacatgtgcagcatacatctcacctatgggacacctaatagggtttcccttaagtcacagaactgtcatttatttgtgtctctgctgagagaaactgaaacgccttcacttaattttgtagttttgtctcaattttctctgaatattttagtttctgtaatgacggtaatcatcattttgatcttgcaaagattaaataaattaatggatatgtaagtgtttaatgtgtattatatgtcatatatatttcaaatatatatgtttggaatgaaatatgaaatgaaccttcaaaatatggaatgaagcatttatacttttgcttgagatatacgtgaaatactgatttcaattagtttttttcctaacataagaataggaaaatgaaatataaagtgaacctaacattagctatctaattcttcataccttaaaggctagggtttaaatctttttatttatacattaaacaggcttttggaaagttacatttaaatggaatttttgaaaagctgtaatatgtgtaatacagctgctcataaatgactgtgattatattattctactttctcagggagaaagagaggcaaacctggaacccgcttcactcagagtgacagagctgcacagaaaagagtccgatcaagaggtaaaaaagaaaacaggaatgaactttcaataactaaacatctaatttcctgtgcggtacactgtactttcagtaataaacccatttccttaattgttttatgaagctgtactaactagtgagaaatgtatcctatttagtcattttccaaaatgtgtcaaggaaagaaggaagtaagttggtgatggatctacaaccagatcccaggggcccaggggccactaaagtgctactttcactgaaatgataaatttcaaggctggagatagttcattgccgtataaagggtataacccataagtgatttaactgaccttcctctgactactcagaaagccacaggttgcacactaagggtgaaaaagagttgtggttagagatctgtgtcctaagactttctttttctttgtgtgggcttaggctgatcatttgactttctttgtctcagttttctcatctggaaagcaagagcatgaattaggccaactatctttctttctttctttctttctttctttctttctttctttctttctttctttctttctttctttctttttttattctttaagttctgagatacacgtgtagaatgtgcaggttctacaacccatcatctacattaggtatttctcctaatgctatccttcccctaacccccaaatcccgacaggccccggtgtgtgatgttctgtccctgtgtccatgtgtccttattgttcgacttccacttatgagtgagagcatgtgatgtttggttttctgttcctgtgttagtttgcccagaatgatggtttccagcttcatccatgtccctgtaaaggacaggaactcattctttttcatggctgcatagtatttcatggtgtatatgtgccacattttctttatccagtctatcattgatggacatttgggctggttcctagtctttgctattgtgaacactgctgcaataaacacacgtgtgtgtgtctttatagtagactgatttataatcctttgggtatatatccagtaatgggactgctgggtcaaatggtatttctggttctagatccttgaggaatcgccacactgtcttccataacggttgaactaatttacactgcaaccaacagtgttaaagcttacctatttctccacatcctcttcagcatctgttgtttcctgactttttaatgattgccattctaactggcgtgagatggtatctcattgtggttttgatttgcatttctctaatgaccagtgatgatgagcttttattcatgtttgttggccagataagtgtcttcttttaagaagtgtctgttcatatcctttgcccactttttgatggggttgtttttttcttgtaaatttgttttaagtttcttgtagattctggatattagccctttgtcagatagatagactgcaaaaattttctttcattctgtaggtaggccaaccatctttcttattagtccatcctggtcctaatagtctgcctttctaaaaatttgtctcaggaccaaggacagctcccccgtttatcatgacttctgttgcccaggctggagtgcagtggtgtgatctcactgcagactccacctcccaggatccagcaattctcctgacttagcctcccaagtagctgggattacaggtgggcaccaccatacctggctaatttttgtatttttggtagagatggagtttcgccatgttggccaggctggtctcgaactcctgacgtcaagtgatccacctgccttgccctcccaaagtgctgagattacaggtgtgagccaccacgcctggccctacacctttggttggaagggaaggattcactgctcaccctcctggagttcctttgaagacctttcacccccttctctgtgaaatcaggtctccagtcccccacctgcaaccccatataattttcagattattctagagctccctgagctcttctcttagctacggggaaagcagacaggacagagaaatgaactaaaggagagaacaaaaatagaaggcagacatcatctccattaggttatcccatcattaccctctccctgcttgccccgtcagtgctcaaatggggagactgaatatgatctctggagtcatctaaggctacccacctgcagcaaaacagcatagctggagagcttctgtcagaacagtgacagcaactgtgtttcattgtcatataagaatcagtggagcttacgagattaggagttaaaccagttttactgaagtctaatttctctgctaaagcattctattttgtatgaaatttgaaaggtgaaattggggtagacattctgtaattatgtatcaaaaatgccacttggaagaaagactttgaaactctagagggttttggaatagaatttcctaagtatccctcgtgtctttataggaattacctcagtagggaggggggacgtgcctttgcaaagtgagacagaatgaagaaatcctctctttcagcttcaagaaagcacaaagatgaaactgtggattttaaggctcctttgcttccagtgacctgtggtggggtgaagggaattttacataagaagaaattgcagcaaggtaggttttatggtcttctttaatttgcagctcctatctgaaggcatcacaagtagtggggaattatcatgtgaattacacatcattcaaggagtttggtcccagtttggcttgagggaaggaggaagggatttctaagatgacgtttacagactttaagaaatcgcaaccaccagatgctcacttgcacatggaatgtccagagggtgcccaaagaaccaaagagaaggcaggaacatcaattcacagatgaaaaatgtcacgtattttactttgaatcagacagaaaaatgaagaggccctcaacctcgaccttcatattctctctcccttctggagtgccatcaccagggcagggtgcttggtatagggagatgatcacagaatttgggatcagaaagcctgagttccagcctttgctgtttcaggagtgactgttccattctgagtagagaagggaacctttctgaacctgaaatgtctcatccaagagagggaacaataatgaaaaacctgcctcatgatgtagctgtgagaattaatttgcatattgatgtaaaatatgtaaatttacatgtttttactgtaaattataaaactttgccaaaaaatgtctattagaatggccatcatctcagaccaatcttaatatgactctttggatgtcaattaacagaaatgtttgcattgtgactatttctaaacagctttactgagatatagttcacatatcatacaactcaccacttagagtgtacaaatcaacttttttttgtatagtcacagaattgtacagccatcattatcctctaattttggaacaatttgttccccactgaaagaaaagcccatgtcaattagcagtcagtgcctattcccacctaagcagccactaatctattttctgctctataagtttgcctactgtaggctttctagaagtggaatcctataatacatgccctttcctgactgccttcattcactaattgtgatattttcaaagttcatccacaatgaatgtattagtatttcatttcttttattgacaaataatatatgtcattgtatagatataccacactttgtttataaactcatcatttggaactatttccactctttggctattataaataatgctgttctgaacatttgtgtaacaagttttgtgtgaacatatttcagttcttttgggtatatagtcaagagaggaatgactacatcgtatggtaattctatgtttaatttattgaggaatcaccaaagtgtttccacagtggctgcactattctgtattcctaccagcaatgtatgaaggctccaatttctctacatgctcaccaactttgttatcgtctgtctgtctttttttattacagtcatactgtcatcctagtgggtatgacatggtatctcattttggttttggtttgtgtttccttaatggctaatggtgttgagcatgtgactatcttttacatataaattaaattttttatcagataacatttcacaattagttttttaatatcagctacctgtgattgcagggatatgaaaatttctgtttaataatgccactagactgcataaaacatgttataattgagagtgcagatgttgcgggagtgaccccctgagccacagggcacccatctgagaccgtagccccaagttgaggattctgcctccaacattgccctcacagccatctggagactcaggcctggcctctacttccaaatttgaatagcaagttggagtcctctcatctttcagaatcacttgcttttccttctgtaagtgcttttgaaatgcttaaaaggttgctcttgatgataaccatcactctcctcatggatgaaggtcaaagaaatgtgcacccccaccaggaaatatccttagaggggattttcaggctggatttggggcctctgtagtctgagagggaaggccagactctcctgctattgatctgcatcacaaattgggtggctctagatccagtgtggtgagtggccatagtctgtgcgctgggaaaaaagagggctcaggatcaagttaccctggtcttacaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggaggtattccaatgacaaggggccaggcctgtgttccttcttgttccctaataatgaggagactgtttattcaccaaatatttgttaggttatagctaaagccttgatgccagtgggtttatcctctcactcaggagagagggaccccacattcataaccacactacagtgcaacacattgacgttgtaccaggggctccgtcaggatagactcagcagcttggaggaggaaagggtcattctgactagggtgcatgcagacagctttgtgcactgaaagaaagaagggagttgacagtcaagcagtggaagaagacacttcagagaaagaatggcataaaagccagaatgccatgaaaaccagaaccatggcaaaagtagctctgtggatttaggtagcacaggttgtgtgcaattaggtataatttaacaattggggcaggttgtgcagggctttaatgccaggctaaggagtttaaacctgtaattgagataacaaggattcagtgaaatcttctaggattggaaatgacatttaaaacaatattttattttatttatttatttttaggagacagtctcactctgttgcccaagcaggagtgcagtggctcaatctcggctcactgcaacctccacctcccagattcaagtgattcttgtgcctcagcctctcgagtagctggaactacggttgtgcaccaccatgccaggctaatttttgtatttttagtagaaatggggttttgtcacgttggccaggctgatctcgaattcctggcgtcaagcgggaggcctcctcggcctcccaaaatgctggggttacaggcgacagccaccccgccccgccataaaacagtattttagacagccacggggctttccccctagcaaacctatactcaatctagaatgctcagttcaagtgttaccccttcctgaatgttcattgattgacctgtcatgggccattgaccaggccttcccagggctcctgagccctctactaaggcctttcattcactgttttatatttattattttgtgagtgctttttgtccgtagactcctttaggttgtcccatcttcatgtgcccaagattgatcagaattactgatacccagtagcaggcaatgtgtgtgctgcttggatagctctggtgtaaggactccagctggagtggcactggtgggactggaagagaggtgataggtggtatgagattgtgaaggaaaacctcttaggacttaggaaagaagcacaagagaagggaaaatggtcctgaagatgcttttctggcttctattgattgaagtctagaagaagcacaggtgaagacagggagatggtttctcattagacaccttggatttgagctggcagtggaacactcaggtagaaatatttgggaggaggttggaaatgccagactcacaaaacggaaacacaggctgaccatatacctgaatctttttgtctttcagaatggatttctgcctgatcctccaagaatacgttacaggaaaaaaaaggtgattattacatagctttatacagcttcttgtcacataactgatttagcatgcacaaaatcttattttatggggtctgaaattgggtaggaataattaagctttcaccttcttcactactcaccttaaaatactttttgcatgtattccttcagagtcgctaatttgaacactaaatgtatataaagctaggtcctgtttggattcaaccatttcatatgaagatgataaggagccatcagaatatacgtcctgggagtgttttagcaatagatgcagatgtcttaagagtgtccaagttggaaagtcaagcatggtcatgggatacataaaaatatttcatagtaaggtgagaggatcaccttcaactcaaaattcagatttttttcattgaagttactattttctaactttagtgaaataggatggagcagatatttgctcacatccatttgagacatgcatgaaaccatatatcatttaatgaaatcggcaacaaaaagaatatttcttttctgatccttcacattctctttcaccttccaaaaaaatgtacacacagacacacagaatgtcttctcaaggtgaaattatttcctgttaccacaatggtgccactgaggaggaagatctccagaggcaaatgtattttataggaggggctgaccaggaaaatcttttatgttgatgccacctctttggctctaccagagggactgtgcagacctgctttttatctgtgaaagtgatttttccctctcttgaagaatgcaacaaacaaataggttaagtgcagtgtatattcaggacaaggtgatggtttttccaagactgggtatgaatgagaacctgaggagggggaagagaaaaatgtcatccttatgcacttcaggtagaaatacgcattcaagacattcacagacttctaaaacagctcacacatagctagccactaagcttcatattccactgggaacctgagatgcaggcctttacattatctgatatactggctgatttgaattttcagccactgagacatttcatccactgggtttcccgaagggaaactatgatgtcacctattcagtgactacactaaagaccagcatctctacctttcaccgggtgccaagagtaactgagtctggatgacccaaatgagctggcaatttccgactaaccgactctccctctattctggggtgcaaaacttagcagcgacaaggtgcagttgcctctatatgttgtgtctcctcatgggggagaacagaaggtcccttaagtggcagatccaggatccattatgaactccatgggtcctctgtgcctctcagagcttctcttacttgcagagccatttggctttaggaaatttcagtgtcactatgagtgccacatgatagcatctctgctcatgacaagggccacatagaccttttggtggcacctgagatattgtaaagcaatctgatatactcacccagaataattgttgtatgctaatgtttgcttaagagcctccagtgatttctaagtgaatcaacattcatttattcacccactcaacatataattatcaagcacacactaaatgccaatggacattacagaagattgacctcaaaaattatttcaggccaaacatggtcacttgagcctataatgccagcattttgagaggctgagatgggagaatcattggagcccaggaatttgagaccaacctgagcaacatagtgagataccatctctaccaaaaaaaaaaaaaaattacccagacattgtggtgtacacctgtagtcccacctactcaggagactgaggtgggaagatcacttgagcctgaaaggtcaaagctgtactgggctgtgatttcatcatagcactccagcctaggtgactgagtgagactctgtctcaaaaaataaaaaaagttttaaatttattgtcaacatggatgaattacaaatggggtggggtgggagattctagaccagttggagaggcattcagtgacaaggtcatctctcaggtgcttgtcctttgaatcacacttgtttatggcctctgtgccctgggctacagacaaaagctgaggctgcttgtatcccagaagggaaggatgccaagtcatgccatggatatccaaaagcaatctaaataaatgtagtgggttacctcttaaaagtcagtcaacctggcatcttcttgtgatttggatagaagggagagggagagagtttcaggaaaaagagctgcagcacagaggaccttggaggcattttatcaccagggctgtgtccctaggggagctgcagaaagcagtgctcttcttgtctgggacacttgcatggcctctaggactctgagtcctgtggtcccaggaggctgtgggagataagtcctcagcctgattattattgaggctcctctgggtgggatgacacaaaggccaagtttaggaaatatgcctgagggccccttgaagtaagaggacaagtagagcttctctgacttggcctgtgcaaactaggtccagactccctgcagggaatgggacttgcattgggattaacggtagtacttgcacactttttattctttcagtagatatataggtccaaaaaatcagatatgaggtaaagggaagactgtttacaaaaataaaactttagacaaaataaaatttatagcatttatttgagcaaagagcaattcatgaattgggcagcactcagaacaaggagaggttcagagaactctgctgtagcagcccagacagtgaggccaacacaggagtaagacagagaaactatatttaatgggttatcatagaaagatgataattagaggttagatggcagattctagttggtaaaatctctagtttcattttactgtttacatcaggtttcagtttgcttacttagaaacttaaaccactggagccaccccagcctactggccttctctcttcccaattattttttaacaactggttcctgaatcccttcaaagaatactatttaaatttaaataagtgatagatggaaacaatgcattcaatatcataaatcaatctttctgttttttcaacagagaatactgaagtctcaaaacaatagctcagttgacccttgtgtaagtacaaattctgaactacgacccccagaatattccactcctttctccaggcatatgttctgtgtcatgactgctgttgcctgaatcatgttcagtctcagctggagtatgtggctgtgtgaattcagttgcatcacccaagccaggtagatgtgcctgggccttggatgtctcattatgaaagcaccctttccatctgtttcagtagaaaccttccaatgtccttatttcccctggaaagtgagtatgggaggctgagctccagaccactgaggtctcttgagacagagcctgaagtggtaatgggtagggctggcctggtgattagggggaaggaacaaatgtgagaggataacagcattttcaagtaagtggtgtggatgaaagggaaagtcctaaaaatgcactccaaggtgcaggtagagttgaagatggtcataagcatcagccagaaggaacagaccaggccaagctattatgttccaggtgttgatcctgtcattagccctgtaaaggagtacatacaaggcaaggggtcctttacagagctcatttggatggtttcagggaagccattagggtgctgagctggttaggactgaaaccatcacgacctagcaaatcctgaggcattttaactcaactgcttatctggtgctcagtactatgcaaactttctgatgccacaggccccatccattctctgcttgctatatgactgcctgctttggattctgccaaaatcatggatgagtcccttctctaaatgaaatcgtgatttgattcttttcattgcagtgagatgtctgttttaggccgggtcaccttcttgcacaactctgggggacagcactcacatagaatatcatgcaatagcactgacacatgatacttaacagaggagggatgctcaaatagttttatacacaccttacctccaaagcagtcctccaatcagatttaggtcttttccacactgattttgatgtctggccaactgagggacttttcaataattaaaacagccctggaagtcagtgtttgtgtggctgattttggatggactaggcatggaggtttaggtttcacagctcacagccagatatgtgtggggagaagagggaaacagttccagcaaaggtatggtcacccctgttaataatttttccaaggccagtaacaacattgacttataatatccccatgcgtccataaccagactttgcttaggttgaatctcatattgtcctgcagcctggaatcacttgaagagctttaaaaaaatattgtttcctggatcccacttctggggaaattataatttaatcattctggactatgtatgactggaacattaggatttgtttaagatccccagatgtactaattctgatacatagaattgcctattctgtcacctaaagaagaataccagtgcctgtgcctcaaccctgacccagtgattcagaatctctggtgttgggttcaggacattagcattttatatactctcctgagaggagtctaatgtacagccaggccaacaaccaaagaaccagagaaatcaaatctcttcttgaaaagatgggtttggagaacaaaatggcagataggaggcaggactaacttgctcctcctactcagatggacagaacagcgtgttgagactcacactgtgaacttttgctccaagaaccactgcaggaatataccagcaaaactgaaggaagtcacacaccctttaaaagaagtggcttgccaccgcaaactctgggagatagccaaaaaaccgtgagtcctcaaagtgtgagagggaaaaagtccacctctgaacacatatcctcactggggaacctggaaatccagatcacaggagaaggatttcacctaacctagagctgaaatgaatttagaaagctgggtgaaatataaaagtagaataagcagcaggaagaggtgccttccccaaggatccctataagcatttcagtccccagggaagccatttctgactttatctcacagtccttggggagggcagccagtacaatttgcagagagccatggggagaaggaggcttccagctgaactttgtaataattttaaccaagcacaaattttcctggtcagaatctgggggtgtgaacctgaagtacagatataagtgcagaagccatggcaggcagggaggggtgagatctgaaagccctgcttgctttctcaatgggggtgcttcttcctggggcaagatcttagctccaggcaaaggatgcctggatataaatttggctctgttggctgttgggcaccacagcgggagtgagactggccttgctggctgcctgggtgctgggtgaagcctgtcactgccggcttcccttacttatctggtgaactgtatgaagcagcagaggcaggcataatcccctctggaacataaatccattggcctgcaagccacccctcatcccccacagtggccacagcaagccctgtctgagaatctgagctcagacacacctaaccctgcccccagctgatggtctttctctacctgcccctgtagctgaagacaaaagacaggggctcatgggagctctatgacctcacccatcacctgagaaaaccgaatacttatccagtgaacttaggtcaagcttgtatccccctcatattacttgcagctgatggtctcttgaaagtgccacctcctcgccgaaggtcagccaactcaagtcattacagacactcatacgagaaccaccttgctccaggaaggagaaaacaacaactaattatactgcctgtaacatcctggctaaccaaagatcctgagtctgtccctgtaacaacctcactgctagcataaccaacatttgagaaaaccagtgtactaaacaaaactacaatcaaggactctcacagaatccacttcactcccctgctacctccactggagcacgtgctggtacccatgactgggagaactgaagacagatcacatcacaggaccctttgcagatactccccagtaccagcccagaacccagtagctcttctgggtggctagacccagaagagcaataacaatcacagcagtttggctctcgggaagcccatccctaggggaagggggagaacaccacattaagggatcaccctgtggaacaagagaatctgaacagcagctcttgagtttcagatctttcctctaacgtagtctacccaagtgagaaggaaccagaaaaacaattctgataatgacaaaacaaagttctataacacccccaaaagatcacgttagctcaccagcaatggatccaaaccaagaagaaatctctgaattgccagaaaaagaattcagaaggtcaattattcagctactcaaggagacaccagataaaggtgtaaaccaacttaaaggaattaaaataataatacaggatatggatgaaaaagtctccagagaaatagatatcataaataaaaatcaatcacaacttctggaagtgaaagacatacttagagaaatacaaaatacactggcaagtttcaacaatagactagaacaagtagaagaatgaactacagaactcgaagacaaggctctggaattaacccaatccaacaagaaaaaagaactttttaaaaatgaacaaagcctccacgaagtttaggattatgataaatgaccaaacctaagaataatttgtgttcctcagcaagaaatctaaaagtttggaaaacatattcgcgggaataatcaaagaaaatgttgctggcctttctagagatttagacatccaaatacaagaagctcaaagaacatctggaaaattcatcacaaaaagataatcactcaggcagagtcatcaggttatctaaagttaagatgaaggaaagaatctatgaagcaaaaacatcagctaaactacaaaggaaaacttatctaatgattaacagcagacttctcagcagaaaccctacaagctagaaggctttgggatcctatctttagcctccttaaacaaaataattatcagccaagaattttgtatccaagaaactaagcttcataaatgaaggaaagataaagtctttttcagacaaacaaatgctgagagaattcaccactaccaagccagtgctacaagaactgctaaaaggagttctaaatcttaaaacaatatatcaaaatataccaaaatagaaccccctaaagcataaatatcacaggcctattaaaaaataacacaatgaaaaaaataaggtattcaggcaacagctagcatgatgaatagaatagtacctcacatctcaatactaatgttgaatgtaaatgacctaaattcttcacttaaaagatacagaatggcagaatggataggaatttaccaggcacctgctgtcttcaagagactcacctaacacataaggactcacataaacttaaggtaaaggggtagaaaaagatatgccatgcaaatggacaccaaaagcgagcaggagtaggtattcttacatcatacaaaacagactttaaagcaacaacagttaaaaaagacaaagagcgaccttatataatgataaaaggactagtccaacaggaaactagcacaatcctaaatatgcacctaactgtggagttcccaaatttacaaaacaattactcactttgggaggccgaggtgggtggatcacaaggtcaggagatcaagaccatcctggctaatgcagtgaaaccccatctctactaaaaatacaaaaaaaaaaaaaaattagctgggcgtggtggcaggcacctgtactcccagctactcaggaagctgaggcaggagaatggcatgaacccaggaggcagagcttgcactgagccaagattgcaccactgtactccagcctgggcaacagagtgagactccatctcagaaacaaaaacaaaaacaatttctactagacctaagaaatgagatagatggcaacagaatgatactgggggacttcagtactctgctgacagcactagacaggtcatcaagacagaaagtcaaccaagaaacaatggacttaaactgtacactagaacaaatggacttaacagatattacagaacattctacccaacaactgcagaacatacattcttttcatcagtacctggaacattctccaagatagaccatatcataggccacataacaagtctcaacaaatttaagaaaattgaaattatagcaagtactctctcagaccacagtggaataaaattggaaatcagctccaaaaggaaccctcaaaaccaggcacgtacatggaaattaaataatcttctcctgaatgatcattgggtccacaatgaaatcaagatggaaatgaaaaaatcctttgaactgaacgacaataatgacacaagctatcaaaacctctgggatacaggaaaagcaatgctaagaggaaaattcatagcattgaatgcctacatcaaaaagtctgaaagagcacaaatagacaatctaagttcacacctgaaggaactagagaaagaagaacaaaccaaacccaaacccagcagaagaaaagaaataacaaagatcagagaagaactaaatgaaattgaaacaaaaaaaatacaaaagatatatgaaacaaaaagctggttatttgaaaagataaacaaaattgatacactattagcaagattaaccaagaaaagactagagaagatccaaataagcccaattagaaacaaaatgggagatattacaaccaacaccacagaaatacagaagatcacttaagtctactatgaacacctttatgcacacaaactagaaaacctagaggggatggataaattcctggaaatatacaaccctcctagattaaagcaggcagaaatagaaattctgaagagaccagtaacaagcagtgagattgaaatggtaattaaaaaattgccaatactagaaaggccaagaccagatggattgattcacagctgaattctatcagacattcaaagaagaattggtatcaatcctactgaaaccattccaaaacatagagaaagagggcatcctccctaaatcattctatgaagccagtatcaccctaataccaaaaccaggaaagggcatagctcatgtcaacaaatgtgatataccacataatcagaattaaaaacaaaaattgtatgatcatctcaataaagacagcaaaagcatttgacaaaatccagcaccttttataattaaaaccctccacaaaattggcatagaggggacataccttaaggtaataaaagccatctatgacaaacccatagccaacataatactgaaatggcaaaagttgaaagcattccctctgagacctggaacaagacaaggatgcccactttcaccacttctattctacatgatactagaagtcctaggcagagcaatcagacaagagaaggaaataaagggcatccaaatcagtaaagaggaagtcaaactgttgctggtcgccaatatgatcgtatacctagaaaaccctaaggactcatccaaaaacctcctagatatgataaatgaattcagtaaagcttcaggatacaaaatcaatatatacaaatcaatagcactgttatatactaacagagacaaagctgagaatcaaatcaagaactcaaccccttttacactagctgcaaaaaaataaaatacttaggaatgtacctaaccacagagatgaaatacctctacaaggaaaactacaaaacactgctgaaagaaatcacagatgacacaaacaaatggaaacatgtcctatgctcgtggatgggtagaatcaatattgtgaaaatgatcatatggccaatagcaatctggaaagtcaatgcaattcccatcaaaataccatgatcatttttcacagaactagaaaaaacaattctaaaattcatacagaaccaaaaaagagctcatgtagccaaagcaagactaagcacaaagaaaaaacttggaggcatcacattacctgacttcaaactatactacaaggctatagtcacccaaacaacatagtccaggtatgagaatataccagtacacatagaccaatggaacagaagaaaggacccagaaataaagccaaatatttgcagccagctaacctttgacaaagcaaacaaaagcataaagggggaaaggacaccccattcaaccaatagcactggcataattggcaagccacatttagaagaatgaaattgaatcctcatctctcaccttatacaaaaatcaactaaagatggatcaaagacttaaatctaagacctgaaaccatataaattctagaaaataacattggaaaaactcttctaggcattggcttaggcaaagagttcaggaccaaaaacgcaaaagcaaatgcaagaaaaacaaagataaatagatgggatttaattaaactaaaaggcttctatacagcaaaagaaataacagaataaacagacaacccacagagtaggagaaaatatttgcaaactatgcatccgacggaggactaatatccagaatctacaaggaactcaaagcaatcagcaagaaaaaatcaaataatcccatcaaaaagtgggctaaggacatgaatagacaattctcaaaagaagatatacaaatggccaacgaacatgaaaaaatgctcagcatcactaattatcagggaaatgcaaatcaaaaccgcaatgcgataccaccttactcctgcaagaatggccataacttaaagatcaaaaaataataggtgttggcatggatgtggtgaaaatggaacacttttacacttctggtgggaatgtaaactagtacagccactacagaaaacagtacagaggttccttaaagaagtataagtagatctaccatttcatccagcaatcccactactgacggcagcggcaggcagtctgaagtggctgctgccatgaagctggctgcagtgaggtgcaggcgctggccgtgggtcttagggggcagacacagaggcaggagatccccagagccagttgccctgggagccttcctctgggagccgctgcaatggggctaggcccagctgcccgtagggcgtggtcaggcagggaggggtgagcagagagaggtcccaagatggagctgggccagtggtggttcggcacttgcacacgtagcgtgggggtcgggcccgaacgcggagcagtggccacacttcaggggccggggtgggaagtgggagtggcgcccacttccaggacccagccagcaatgcggcccctgcacccaccctgcccacagcgccaggttcccgcccctcacaggaggctgaacaaagggccgccagaggccgtgtccctaggatctgccccgagttagagtgactgctgtgcctggtgctttcagcagctgagactggggaggcaatccggtcctggaggtttcccccaggcagggtcacaagccaggagagggggtgccccaagccatccctgagccttggggccacaggaggaacttgagccaacatcacccctgcaccagatgctggcctgggcctggcaagggctggagccaccaacccaggctgcaaggaggcagacagggcagcaggaacggccagaggagcagcagtggcagcagtgggtccctgtgccctgtgtccctgaggcagggaccctcaccctcacacagccggcaggacctgctctcaggcccagagcctctatcacagcctggacctctttccccactgcatcctgggaacctgcaagcacctggccaaaggtgcagccgagactcacagaactggcccctgagtgtcaggttcctttgtgtgaggttggctggggcactgtgccacctgcacctcatccacaactgctgcaggagacacagagagggggcatggctgaggccgccccactctgcagagccaaggacaagcaggagccctgcctctcccaaattggcagggcaggagctcgccatgcgcaactgcaggtgcccaggttgcagctgtaggcctgggcctcccagtgctcttgggggcccaggaggctaccctccacctgccagaacagaagcttctgctgcctggccattccctgctcccagcacctgctgcaatcttggagcagggttggggctgagcccaggtgcagttgcagccctgttgggtgtgcacatgcttggggcagagctgacacaccaggcccctgctgcctgcacccctctggattttgggtgctgacgatcataggagagaggccaagaatgggctggggccagctcagcactggcctgcaggtgcccctttgggcaaggggcctgggcaccatgggtggtggggaaaggcagacaggctcctgggtgggaaggggcaggtccctggtgaggcaccaccttcaggcaagagagggcctgaaggctgggaactgggctgccaatcctatggaccagagtgggaacttgtaatgcctttcaaaggcctgctcatggtaacccatggaccaatcagcatacacttcctcccctctgaagcccataaaagctctggactcagtcagacttggagagaacatcctggacaaccagcagcagagaagagcttcacactccagggactacctgccagcagagagaagccacccaccctaggacctcctcctctttgctgagggctgaacactcgtcaggacacattggctgcagaaaggagctacccacagtgggtctctgagctgttctactgctcggtaaagctcctcttcgtcttgctcaccctccatttgtcagcgtccctcattcttcctggttgcaggacaaaagaacttgggatctgctgaatggtgaggctaaaagagctgtaacacaaacagggctgaaacatgccccttgatcaccgcattgtgggtgaagagaaggagagaagagctgcagccctttggggagcccagacctggaagctccctgagccagggctgtgactcccttttggaggctctgaggttcctggcatcttcaagcttctaggtgccagcacatcccctgttgccagccatggaagctgtttgcagtgtgcctggtccagacacagccttgcagagagccagtgctcatgccagcacctggagttgcctgcccttatgcaatagcaggcatgtctgactgtatgcagtggctggaccccatgcttgctcacacgcctctcccactccatgcctgacctgccccatggcaggcccttggtaggtatgcgatccaggccagtagcctgagccaagtgcagcctgccaggccaagtgggtggaaggagcccagtgggcctgagcaaaactcaggcaaaggcacaactgcttacagaggtttctggcaagaaaaagcaataccccaaggattccgtaacactactgggtgtctacctagtggaaaaaaagttatatgaaaaagacacttggacatgcatgtatatatatatatatatatatatatatatatatatacacacacacacacacacacacacacagagacacacacacacacacaccatggaatactactcaggtataaaaaggaatgaaataatgacattcacagcaacctggatggagttggagaccattattctaagtgaagtaactcaggaatggaaaaccaaacaacgtgtgttctcacttataagttggagctaagctatgaggatgcaaaggcataagaatgatacaatgggccttggggactgagagggaagggtggaggagggtgagggataaaagactacacattgggtacagcgtacactgctcttgtgatgagtgcaccaaaatctcaaaagccaccactaaaaaaattatccatgtaaccaaaaaccacctgttcccccaaaactattgaaataataattttttaaaaagattaaggattcgacatacttaaacatttggtacttcattccctccctagggttttggagatggtggaacacacagcatctgacactggacagatgagattgacagcagtgtattagtcacatttactcggtagcccggtgggggtgggcaggcatcccacgccacgcagggccacatgggggctgcgctcaggaacagaggaaacagccagtggctgtggagggcgggctgtcccctgcttccagagggagagtgtgattggcttgtttgaataattccatggctggcagggaaatgaaatcagctattcaaaaatacgcagaaggtgcaagcggtcctcttgatcagaagtgttggtaggaaaccttacctgcagcagcagagccggcggaggacttgtagatagaccattctaggccctcccagtgttaccagatgtccaggctgcacataatattgaactctaattttagtccttacagcacttttcacttgaacggcaaagggctcagtcacagactggttctttgttgtaaatacacatgtatttgtctacaatacagcatgtatgtattggtctctatatttgctctataaattctgttggtttttaatgaccgggatttgctccacaacacgtggatgcaaataccatcatattttaatttccccaaatgaaattaaatctggctaaaggtgtcacatattgagacttgtaagaaatggagaattcgttgatttaccattccttttatagaacaaagcaccagctcttttatgggcccaggaaatgaggtgagggcctctgtcttcaacactgtatggtgctgttaccattgtccttggtcatcagagatggcaccttcgcaccttacaatccaagttagctaagtcaagggggatgtatgccaggctcccagagctgaagagctctgtgcttcctggggcccacctggtcatctccacccacggtccttccccctcagaggtcggcgtagagccctccaggcacaaaacgtacagtctaggaatccctaactaggccctctcttcaactcatggggaacttatggccaagaatatgggatgtggtgatatctcagaagcttattccatcatatgtaattagctaggtctccttttcactagttgatttgtggtataggcaaattgatttaacacttcatttcaaaacctggttttatctgcagaataaggaaattattcagattcctataaaatcatcatcttgctttgttgctagtctttcttcattacaatctctggtttcataaggaagacttttcaattctgacccataccccttcctcctgaacttcactgcagaccaggatttgttctgaaatctccatgccatgtttttccttcatatcccagggagaagcatttgcctgtccatgcaggttcacacaaaggcagtgtgttctagttgcccagagggttggccttcctgaatcttgcggttcccagtgacgtggacactgttttatcttctagatgagaaacctggatgagtgtgaggtgtgccgggacggaggggagctgttctgttgcgacacttgttcaagagtcttccatgaggactgtcacatcccgcctgtggaagctgagaggtaagtgacatgcaggcgtctctctttttgtcctttaagggatcttccacctgccatgcgcactctccagcagagtgccggcttgtgtctagatggggaaagagcaggttcatcgggtactgggacccagcagtgtgatccagagagcagtgggagacgctggcagcaggaggttaatgtcctctgtgctctcagggacacctcctctgatatgctgagggcagtgttggggacctttgcctacataccggcattgtcctttccttgaagttttgcagctgggtgggttggagacaagaaacaccagttgtttatattttgtgcttattcatacaagacaggaagcacgatctcattgggctgttggaggcccgaggtccctggggctgaaaacccagtttctgaaactcaggcctgacagacagggttccctgtgctcccagcagctcagacagagaaaggagagtccacactcacggtgacaccaccttcctcagacttcctgcctgctgctaccactgatgcgagggaaaggccaatggctggagaccccatgtgtgaatcttgcatactttgggaggtgttcccctccctcccatgactgagcccatcagccattcctgaaggaagacagtggtagccacaggaacggtggccatttccaagctccctgccctctgctcacccatgtccaatctctcaggaccccgtggaattgcatcttctgcaggatgaaggagtctccgggaagccaacagtgttgtcaggaatctgaggtcctggagaggcagatgtgtcctgaggaacagttggtaaatcagatgcaaaccccaagccttctcctttcccctcacacgtgagaaccatgaacaagcgcaagggcaggggaatgtactgaaaggagcctgctcttccgcgccacacttcaatggcactgatagaacaccacaccttgtttgcacaaaaaataactcagccatgacatgtctgtttccaagagccacacatgttagagaaacttgaggaagaagggtgtgagttctgtgctgtgtctcatgcatgtgggctcattctctccaagctgcttttcatttacggcctctttcttttgcagaaatgtgagttcctcctcttgaaagtctattgctgttctgagagctccttttttgccaagattccatactattattatgtaagtaacaacagcaacccatgattacaggctgccatgacattacctgaccctgaaatgggccctcgtgagatttgtgatcttaatcccacggggcaagagcacacgctgtcgttagttgccttcaccttgttgtatttctgctggattttatgggaatccacagaaggtagacactgaactatgctggtagcttttccattggtatatttgtcaccagattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaaggtaggtggctcttcctgcttccatttcatttctttccatccttcccctcattttctggtgccaagaaaaatttagtttccctcatcctgtaataagcttgcacgagcaagggttctggaagtgattgattggtttcagttcagaacttaagctcttcttagcaaagaaacagtgaatcaaaaggtgtccctgcaaccagaaccccaggtccctgagagctcctcccccacctgccccagaggagacaggagctcagagagagcaattgaatcctgcctgctgcagcatataaagaggagagaatttcatcttaaagtggtattgtgcttcttatctgctcccaatcccagaaatcccaaactccagattctttgcatgtgaatagaccatatcccaacaaggattgccagcaaggagtagaagtgacagagaaaggaacagatcagtgatcttaccttatacccttccactatctgaattgttgaaagaacctagattgcttttctaacccactgaaataagcaaccaaaggcaaagaagtaataatcccagctgtggaaatgatttcacttttctgccctgttaataagaaaggatcatgctggtaagaaacggaagttactcttagctgcatgagttttcaagtttaacctggttaatgtaacttagggtgtttaagataagtgttctacttaataatagtgtatttcacacttcaacattgttaagaaagtaaatttcaaatgtactcaccacaaaaaaatgataactatttgaggtgatgaatatgttaattagttcaatttaattattccacatagcagtcataaatcacaacattactttgtactccaaaatatatgccattataaattgtagacttacagtacttttttttttaaagacaagagtcctgatcattctcagttgaaaggtgtctcatgacgctaatgatgaggagcattgtttttgtctttattattttttcagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgtt

SEQ ID NO: 2038 - DNA, 73391 bp, Homo sapiens
  source 1..73391: mol_type = genomic DNA
ccgagttcagtcatactgcaccagctgagcaatgcatggagtggacctgtaggcgacttgcatcgtcttcaacatgaagatagccacagtgtcagtgcttctgcccttggctctttgcctcatacaaggtgagcaatttgtgtgtaatctaagcctcttgccacacatctcaaagccctggggaagggacttttctccccctactcctgccaaaaaatgtttacgtatgcatgtataatcctgaaatgtcttgccagacacagagttctgaagatttatatatgtggctttataattatgttgttatctttagaaatggcaagtagtttgagataatctgaattttctaaccatgagaaattcttccattaattctttattaattcagaaaactgaatagattcttcttcatcttcctcttgctaaatgtatcaattcataatgcatattcttatatatgtaatagacatttaaaacttaattgtaaataatatatgtattttaatgttataggtataaatgaaatattttttaaaattcaatcatctgttcttattttaaagcagtggtatcttctagcttattttagtcttgtgttttcaaatgctaaatgggttgaaagcatttctcccaaagagtgagggacttttgtgggagctggaaggtagatttttatatttgctatttaaccctaagagaacacaaattgcctagacttacgttgctctgaaacattaaaatttttaaaaagagaaactcatagatagtctgaaatcatatacaaataatgcccattttcctaaaataggtgtgtaggtacaaaagagcctatgttaatgagagagtataatagcctgtgaccttaatcttaccttctgtcagatctctaacttttgcagctgtaataaggaggtagagctgccagaattcagaaaattaaattttatgtatatatcctataaatgtaatgctatattatagtttcaactataatatagtttcaaaattataattggtatagtattttgtgtgtatgttatattgtaattttaaaagggaggctggcatttattactccgaaaggaccttttgaagataagctattttgatggggttagaattcacatgagtattattttccaaagtaattgtaactttctgagtgattagacctttgtgagtatatatactaatctcctggtccagtgcccttcttttatttgccatgataaatcttaatgtgttcaaaaaccatttgcggttttacaacatattgtcattaaagcaatcaagatgctgcattaaatggattatttgttttgtttattaaatattttacatttccttaactttggtttctatattttcatcccagatgctgccagtaagaatgaagatcaggttagtcctgctttttctgttcattgaattcattccaagattcccaaagaaaagtggtttgtggccaacaccttcatgttaataatacaaacatattatactggtaggtactaatagcttttgttaaaaacacagaaacagatttttatgaatcaggacatgagcctctctctcacacacacacacacacacacacacactcaacatattaatgatgatggatgtctgcaagaggcaatttatcatgttaaaggagcattttaaaatttcataaacaaaaaataaatcaactggaaaactactattgttccatttaacatctcaacaagccatgatacaccacataggaagctgaaataaattttctagtaatcattatgcaaaagagggtggtctgtatcttgtatatagtcggtgtatatagttcatgtaatgaatatttattgagcatctcttagatgtcagaccctgtttgagatgctggggttatttttaagtaaacaaaatagatgaaattcctgccctgaaaattacgttttagtgtaggaaaacagacaaattaataagtagcttagcaaaacatatggtacgttaaataatgataaatgctaggagaaaaataaatcaggaggcataataggatccctgagaatggaggtggtatccattctcataaggataatcagggaagttctctctggacagacagtattagaataggaatctgaaggtcataagggaatgaaccacgaaggtatttgcagtttacagcaggccagacagaagcacctgtgagcgcagaggccctgacgcaagaaggtgctttaccaactcttaaacctcttttgtttgataaattaaaaaatcattttctactagaagttaaattttttaatctatttgaaagataggatgaccaattactcacacacacacattttatatatttatatacacacacactgctatgcatgctattaattcagcacttaaagcacaatcttaaatgttttgctgaatatgtggcaaaatttgttttatctctggccacgaacattaaaggaataaaaatgtgaaacagctattctttacgttgaaactctgagaaccatggttaaaatactctcttgccgtattttgttgcaatgattttttttaaagaaacttcttacatgagtgttctagagaattttatcatgttctctactatttcatctaagtttactgatagggagaggtccagaaagttcagtagagtagaaaataagctagacatttgggaatcagagagcatgctcacttggaagttttatactgggaaaaaagaaggatattatataaatatcattgtgtataaaaccatcattttctttttcagagtccgtgatgatggttggtgatttatggcagatactgtgaattttacactgctatttttcatagcattaacctctatttcactgaaaaatattttaaaaacaaatttagtgacttcttatatttggtattaaaggcaagaacacaaagaagtaattatttatttggaagcctttctaatcagagtttttggatactgtgtcagaaatgaaaactattgatgtagtcttttttacgatgctgtgattttggttattttccaagtttagtagcttgggttcctttcagcatgataaaagcatgttaaatgtcataaacatgaacctaaacagcagggaaaagcactgcagcaatctgcaaggatcttaagcatgcttaaatttgtcatcacctaagagtcattcttcaggcaaaagcaagctggtcagtgctctaacactgagatagggcaatggcagctcctggagggttttattataatatctggagatggacaatagaagacaacaaattaggcctcagccagtgagggaaacaggaagaacttggccctagagggctccagttttcctgggacatgctgagaaaaagagaataacagcaacagtaacaaaacaaaacaaaaacaggccagggactggaagttaccctgcaagtaaacaggtgctgaaaagtcatctactcaactcaggatgacttttggtctaaatatgcttctgtttcaaccctctctattatggtcattgaaagggtattccattttgctcagagaaaaactcaactgctgctttccatttttatggtcttttcctgtttcccaagagaatacattggataatttcataactcagaaaaatagcattgaatctcatcttaactaattaatcactgtgaacaaatttcttaacctattatttgggcctctgatgctcagtttgtaagaaagggagtctttctaggaattaagttctcatctaacagtgatattggagaagtccaatttagggattattcttattgatgcaactctttaatttttcttataagtagagacaaggtctcattatatttcccaggaggatcttgaacttctggcttcaagcaatcctcctccctttgcatccaaaattgctgagttacagccatgagccactgcacctggcctgatgctactcttttatgataagctttcaaaattatttagagctttattccaggattatcatgagtcgtctatatactttctataagacttacttaataagggatatattttcattacaaagaccccaggctcttctctgattctactatatggattttaggatcaattatattcatcaaggtaagcataacttgcaaagttggcatttgatactgtagaatcagagatcagacaggtctcaagatgcccagttattaatctgtgtccagaaattactactctgctactctgatggagtcactgtgtagctataataatcttagagatatttaagcatgccatccttagctaaatttcccagggctggtctgtgatatcgtttagttattctccttcaccattaatcattttgcaagtgctaccaactgcctaccatttttaagaggctagattaagtacatcattattcatccaggcaagtatacttctgttctacctaatgctgtatctatgtcacctagcaaagtatagtaatccaataataagtgattgctggctcattcaatgatgatcataaagatataggagactactggagttcaagaccagcctgggcgatgtagtgagaccctgcctctccaaaaaaaaaaaaaaaaaaaaaaaaaaagaaagaaagaaagaaagaaaaaacaagcacaaaacaccagatatagatataggagcctaaatagaaacctttaataaattttttggaacaggttgtgtttgtcagagttgaagcaaaagctttgtttatttgtttcctgatacaagcaacttgaagcagattaaaaaaaatcaaaacaaaaaacaacaaaaatccccttagattccaaaggcctattctaaagacctagtgaattttcactgggtacagtggctcatgcttgtaattccagcactttgggaggctgaggcaggtgtatcatttgaggtcaggagttcgagatcagcctgcccaacatggtgaaatcccatctctgctaaaaatacaaaaattacctagatgtggtagcatgcacctgtaatcccagctactcagggggctcaggcaggacaacctcttgaacctgggaggtagaggttgcagtgagccaagatcatgccactgcactccagcctgggcgatagagcaagactccatctaaagataaataaatacctagtgaattttctaaattaaaagggaatataacattttaaaatcatactttactaggtagcagaaatgcaccatattttaagctcctaaaaaagaatgagtgatgtatagcaggactttaataataatatttaatattatttattaatatttaatattgaatgaatcaaagaattaccacttttgaagatcattctactttccttttccccaccaattctattatttaaaatgtttcccctgtcctccttaaactttgtataacggagttattggtatttacaaaaccaaaagcccaaaacaaacatagtaggattttagttccaagggatgtgccaaaaaaaaaattaccagagagagagagaaagagagagaaagagagagaaagccttatgcaattattgagaaatttcctcagtacttccatagattcacaaggtttgattctgatggtagtgatagtagtgctgatgacatttgtggggatggtggtgggggtggaagtatgggtactttctaaaaaatataatacaaatttgaaaatgcaaaatggttaggcctctcccagaacctcggaagggggatgtgacagtgaagggccctgaatcttaagctttattagctttaaggtaagtctgcctgtgctcataagtcaaatgatttatcaagggacatgaagttcttttcagaaaataaaccagtctagaaacttgttttccagataaatataaccaagaaatccttttttcatttaacactgttaaaatttctaggaactgatatgttgcagtacagccatggggaaatgtaggcagacattttataatgttcaatgctcaaacaccttgcctcagtccttcagcaacattttcatattcctttcacagcaattactattggcctactgtgtactaggtattttatatgtgtcatcttagcatattccagtaataatactgacaatcaccagcaacatcaaaacaataataataaaaaaggaggaagaaggaaggaggataatttattaattgaatatctactatgtatcaggcattctttgagggctttacatacttaatcttcaaaaaaccttggaattgtgtgtgtatatatatgcagacatatacatatatctacatatatatatcaaaataaagcttgttttgatgtacttttagctaacacaacttttttggcattatcttaggaaatgtgccatgaatttcaggcatttatgaaaaatggaaaactgttctgtccccaggataagaaattttttcaaagtcttgatggaataatgttcatcaataaatgtgccacgtgcaaaatgatactgtgagtaaaggtttctttctttctttccaatgtttgagttaacagctagtctctgaactggtaaatgtattctttttctttcaagtgcatttttctaaaccgaaatggttaaataaaagtgctgagcagatcactctgacatttcccatcagataaagttggataattaccacccacctggaaagattttaataatcactcaaacaagattctgaaagcattccagagggcccagtgtcaataccttctgtagcactctatagtcttttgaggatgtagttccactttgaacttcctggttttggaaaaaaatgaatttgacaaagaaagtcagattccttgggcctgttaagacctgattctgttgcagcctagggactgagaagattggcttaagcataatgccagactctcccgtgacagccaaccagcagaaggacttaagcaaggtataccctgattctgtgagctgccagtgtctttagacacctagcattattctaggatgagatgaactaaagggtagattatagtttccaactccttgcagctcagaaagaattagtatcctggaagtttaccaatctctattcaatgcttcttaacttggtttccttctctccattgtcaccccaaaggtaaaagaaggcttgggttatcaattgcaaatcctcaaaccagaatgtcctaatttgtttttgaaaaggaaggttagcctcaatttctgaccactgtcaaaacttcaacagtggtagcaagccaatactgagcttacccacttaggataattatattacaattggctttttaaatgtcaggttggtgtgtgtcacaggatttaatttggggattgacgtagtcaatcatattgggataatgaagctcagatcgtttgatcatgcactgcttctagtgaagagactgtgagactataaagaagccaggacaagatttaatagaggatgggaggcctagggcaggttgaataattctttctttttttgaaagctgaatgtaaaccagcaggtatattatttattataaaattttcttcttgtttcataagatgttttaatatgagactgaaagtatgaatataataaatttactgaaaaataatgtaaaacaaaaatgaaatgccttaagagtctaaagacagtttatcattttgaagttattcaattattatttttatgacttacgtaaattatgttagaataaaatttttttttttacctggaaagaaggaggctgtgcaaagcataaaagctgtcatcagattcctaaagaactggcttatggaaaagaaaattgatttgctctgtgggtccctagatgttggaattagaaccaatataagcaggttcaatgtgaatattctctttcaaaaactgcattcaaaaaatggtgcagatagctttgagagttggtgaccacctggctgttggaagtattccaggaaggtagtctgttatgcagttaaagttagagattcttcctataataccatgttcgagatatttttcaatgttgaagggagatctggggttctgtgtccacttctgaacatgctaccaattttgacatgccaggctaggctgaggagagcagttaaaattaagtttaccatgttagctgttattgttaaaagttgagcaaacaatgtttaaactatgctatttcttgtccttttccagggaaaaagaagcaaaatcacagaagagggccaggcatttagcaagagctcccaaggctactgccccaacagaggtgagactatttggagccaacctgtttacttttgagaggatgtttgactctatttagagctatctgtttattccttaattactaggtcatacctgttttgaagccaacaacttaggagggagggaacatgggttagtccaggggtgggctaaatatctggtacatcttgtccataggcccaacccatgatccgactctaaaaacattttaggcactgacggaaactaagaggtggagtgagccagtgtgatgtctgccttccaaggccatcatttctcattcctcttgtcctgtcttagcccaaagaagagctttcctgggactgtagaactaagttcaaatcttagaattcttattgcttgtgtaacttagaaaatttatgtatctctggatctcaatgttttcatctgtaaaatgagttttagaccgaatagaaactaagttttaaaagccggtctcagggtttaacatgttctagcaggcatttgactcattctgtttcctttttcttttactcttttgctttttactgtatatgttccagtacctggagggtcctcctaattcaactatagttgcttgtttatatctattttgcagacagggactcaggctaatattttgtttaagaaaagtgttctctggtaaaaaaaaaaaaaggtcataaaacattaagaagtaagatagaaggaaggaaagaaactgcaaatttatcctactatataaaccatttcacttgataatttttttcacttagaaacatttttaaaatctttacaaaattataaaaataaaatttaaaaaataaaaatttggggtccagattggtggaaatatatatctagcctacaatatctcacaaatgggttactgacaaagctgggactaccaccagctattctaaccactactcacatcaccccaggtctcctatgcagtttcttcactaatttccactttcttttccttctctgctggccccaacacgtaattaaaataatcagtcaaggttagtacaccttaattacttataacatccatggtctaacaacgctgacatcttccttggcagtgttagccaagaacatctgagaacctcagcctccacagtaaacatagtctactaaattatttgcctgggctcaaccagtctcacttttaaaacaataacagacaccacaaaattgatccataattgaaaactctttatctgtagcaaaagagagctacttttatattctacaaaatctgtgggggccagaaaggtttagtggcaactttatatgtgtcttatttgtcacattcaaagagtggctcactttctaacatccattctcctcttcctcctctgtcttcatcataaaaaaatgatatatctatagtgtttaaaaatataaaatatgaggaaatgacaaaaaagcaaaatacacacaaacataccaattttaacaaacctatctaaaaaatatagctagttagatgtttccatatgtagacacaaatttattgaagtttaataaagtaggagttttaaaaaataaaattacagtcttaagaaataaaattactttttgttaatatattatgcctgagtcacacacacacacacacacacacacacacacacacacacacacacacaaaactgtaaaaaaaaaaaaaaccctctagataaaactcttaatagcgatgtggttcactacttaggaaactacttacataaccaagtagtaacttacattaagttaaggcagttaacatttggctgtgtgcctttcaaataagttctgtctaaatttttccttgtctctgtatttaaaaggattcatccaattataccatgtgttttttgttgttgttgtttttctctccactataaaacagaacaatgtgctgattttttctgcttagactccgcccatcagaaatcaaccctgctactccctctcagaataaggtgctctgcatttcaaggagtttcctcctacagacatcctctcactctctctttcatcactaattttcttttcactagtatgtcatcctttcatttcccgactctagtattccctccattaacaagtcttgttggtactgcctccaaagtctaactccttttctccatttccatccctaccatctcaatccagtcatccataatttctgatctctggtgttttggtacatgtaaagacttgtttttttaattgatgaattcattcattcaatgtttatcatgatttaggttgccaactttatagaatattaagttcacacgagtctgtgtgtttctgaggtccctcttttttcagattcatttattgctttaataactagtatggtaagtcccccttcttagttcatgttgttaaaggttgatgggacctatgcatagatatatggtttccatatacatgttagagataaaaataactgagtttataaaaacttcatcttgaatttggtaacccagtgtgtttatggatacaaagaatttgtaaattaattggggtaaaattgactttttacagtattaattttctaaactcatgagcatagaatagtttatgaataagtcatataattttgatctactttataaaatttacaaaatattcagatttttataatttttgttaatatttttaaaatgtgtaaatttattactattttgaatatattttgttttttattgtgttttatctgtttattgttgatatagacaaattctattgatttcttcaggttaatcttatgtcagacaacttttgtttttgttcttggtagttgatcatattacctacatataacaagagttttataatattcctttcaatcttagcacatctttctttcttttcttatataattggtaaaggatccagacttcaatagttaaacactagtgatggtaatgaacatcaaataatccccttgtctcttcatattaaagggaatacctctaaagtttctccattgaatgtaatatttatcatagcggtttttacctctacacttcagcaagtttggaaaattcctttctatttttagtttgctgaatatgtgttgcttattattaaaagtcttctttgcaactattaaaataatttgattttttagtctattaatataaataaatttctggatatatttcttaatattaaactattattattttcttagagtaaatcatactttataatatattttaaataaatttatgaatttggatactaatatcttaattagaaaatttgcaattatgttcttaagtaaggtgaatctccacttttatcttttaaataattcttatctggcttgggaatttacataaaattatcctaaggtgtgacactttagactctgactaaatcaggtggtcagcagatcctctcctcagaaagcaactataaagctagacaaaattgaccaaaaaccattttagcaatctgaaaattgatcagcagtctataccaatctgagaagcatttatcttgaaaaactgctgactttaggaataaaacgagaggtctgtgatgttcttgctcagggatattcccatttcatcccctggcttggttggcatggaggttctatacagggtacaaaggtcagcaaaggcattgccattgttgaagaaggctaacctaatttggagtaacgagcaaaagtcatacccagaggtgttttcagtgtaagtgataatcttcaccaagggtaaggaaaatggtctgaggttgcagtcataattgaagcaagtgtattcctggctgagccttcacacgtagttgaaagagcccaaagagggtcaagagattcgcaaactcctaactgactataaagctgcgcatatccgcttaataaacacaaaatgtcccagtgagaagcaaatgctggagtagatgcaaaagtggcctgaactttgcatgccctcccctgtacacaaaggtctatctgagagggtgaaagcattgttagcttgaagtatttgaacacaaactgtgttaaatccttagctgaccattaaactacaaaaacataggggaaaaacataggaagccaggcttaaaaaataaccatgatagaaactatcattttcttagctgcacatcagcagctgcaattatgagagaggaagatttcaaagatttaatccagccacagaagcaaaaaaagaataaaaaagcagtgaaaataatctttaaagaaaaaattgtaaacctgagtacctatattatctaaaatgttgtttttataatcaaaatgttcagtttttataatccacgttagtgaggttaaaaaaatgtcagttttcaccaaaagttataaaattttcaaagtaacaagaatatacaacccatactcaagaaaaataattaatggagtttgtctttaactgtgtacagatgttagatgtggcagacaaagacttgaagcaactattaaaaatgtattcaggatactaaaaaaaatcatgtttgagggttcacaagaaagtataataacaatgaataagccgataaaaactttcaatgaaaagacagaataatttttaaaaagacccaatgaaaattctggagttgaagggcacaataactgaaatgaaaagttcagtagagaggctcagaagcagatttgtgaatccttaaaaaagggaattaccaaacttgaggaaagcttaataaaaactaacaatggaaatacagagacagacaatagagaagaaaaatgaacaaaattatacactttttgagacagcagcaagaaagccaacatatgcataatgggaataccacaaatagaggtgagagaaaaaggaatacaaaaattatttgaagaaacaatggcctaagatgccttaaatttgatggaaaaaaattaattttaacatttaagaaactcaatacaccccaaataggataaatatgaagagatccacatatggctcatcatgattaaaatgttgaaataaaaaaaaaaaacaaagagaaaatttagaaagtggcaagagaaaaatgacacatcctatatacaggctgtatacaattaaaagctggcccctcatctaaaataatgaaggccggaaggcagtaaaatgacatgttcagaatgctgaaagaaaaaaaagattaagcaatattctatattctcaaaagctatcctacaaaaattaaaacaaaataaagatattactgtactaaagaaatctgagagactttgttgttaacacaactaccttaaaaataataatgaaggaggtcatttagctgaaaggaaataactaccagatggtagcttggacctacagacagaaatgaaaagcaccagaaatagtgaaaattgagttaatctcttagcctttttaaaagaaataatcttaatatataaggcaacaattataatgctgttttatcaggtatatatatatatatatatatatgacaacaatagcataaagggtgatagagaaaataaagctttattaaggcaaagtttctctattttaccaggattaagtattattctgaagtggtttgtaataaattaaggtgcatattgtaattactagagtagctactaagaaaatagcatatataataaatatataacatcaacaaaggaattataaaggtgtactagaaatatttaacccaaaacaagatggtagtagaacagagaagcaaaaaaagacaaaagcatattgaaaacaaatagaaaagtagaaatgtaaatacaaccataaaagtgattatattaaacataaatggtttaaacatcccaatcaaaatgcagaaattgtcaaatgataacaaaggaactataagctatctccagtaggtgctccttagattcaaagacacaaatagttgaaatgataacagatcggtaccatgctaagtttaaccgtaagagagcaggattggctatattaatatgtgataaaatagacattaagacattattagagacaaatagggatattttgtaactttaaaagtgtcaatacgttaagcaatataacaatgataaatgtatacacacctaatagaggctccaaatttatataacaaaaaatgctataattaaaagaaatgaaaagaaatgaagaattcaaaaataatcgttaggaatttcaatactccacttaaaatactgatagaacagctagactaaatatgaccaaatagaatacttgaagaatactatcaactaattcaacctaaactgaaatatagacagtgcttctccgttgattgtagaatatgtattattttaaagcaacagaggaacattttcaggatacactatatactaaggtacaaacataataaattttaatatattaaaatcatatatagtatttttttttaaccacaacagagttgaattcaaacccagcaaggaaaatgaatcgtgaaaatccccaaatctttagaaattaggcaacacacttctggataattggtgggttaaagaaacaatcttgagagaaattggaaaataatttgaattgaatgaaaacaaaaagacaacaatttaagacttactggacttgtctaaagcactttctagagatttaaatggcttaatcagaaataagagataggattcaataatttaatcctctaccttgagaatattagaaaacaaagtttagcaaactaaacccaaagcaagcagaagaagaaacatataaggattggagcagaaattagtaaaacacaaaacatacaaataatagaaaaaattaataaaaccaatgttggttctttgaaaagatcaacaaacctgacaaacccttagttttattttcccttcaagaaaagaacagaagacaaacattaccaaaatcaagagtgaaataggagacatcagtatgtgccctggagaaactacaaggcttatgatgaatattatgaaaaatattatgccaccacattaaataacttagatgaaatagaaaaattcctagaaataaccaaattattgaaaattgacccaagaagaaatggaaaatcataatagacttacagcataagtaaagacattgaatcagtaattaaatttaaaaaaatgcccaagagcagatgactttattggcaatttccattatatactgaaaggagaaataatatgaattctttacagattcattcaggaagaagagacactttacagctcattatatcagtccagcattattctgatacaaaatgtagaagacatcacaaaagcagaaaactactgacaaatattcctcataaacatagacagaaaaatccttaacaagacactggctggcaaatgaatctgcaatatgaaaaaaataaatcattaccaaataagaattatcccaagaaagcaatgttggtttgggaacagaaaatctattagtctaatacacaatattaacagaataaagggcaaaaccacatgattatcttaatagatgttgaaaaatcacttattaaaatccagcactcattcaagatgaaaactcacacaaaatattatcaatagaagtaagctttttcagtctgataaagaacgtctgtgaaaaacctacagctaacattataattaatggttagagaatgaatgctttgcccttaggattgagaagaaagcaaagggtggtttactgtcaccactcctattcaacattgtactggaggttcttagccagtataaggcaaaattaattaattaattaattaaagacactttttattggaaatgaagcaactgtctttaattccaaaacatgataccatatatgaaaagttctagggatccacaaaaagaaaaattactagaactaataaatgagtttagtaagatttcggtgtgcaagattaataatacaaaattgtatttctatatactagcaatgaacaatttgaaaattaaaatatttcattcacgatagcataaaaaatgtggaaatgaatttaacaaaatgagtacaagacttatacactaaaaactataaaatggtactgagaaaaatgaaagatccaaataactagtgagataaatagtccatgttcatagatgagaaaactcaatattgttgagatggcaattttcccaatattaatcaataaattaaacatattcccaatcaaaatcttgtcagtctttctttttggtagaaatagagcagttgatcctactagttatataaaaaatattgagacatttaacagtaactgaatttaaattttgttataatgcaatagtgatcataacagcgtgccgttatttcaagataggcataaagatcaggggaatagaatagggattacttacttttatggtcagttaatgtttaaccaacatgtcaaggtaatgctgagaaaattgaatataattaattttaaaaaacagttttatcttataccatacacaaaagttaacttaaattttattttggcactaaatgtaaaagctaaatatatgaaacttctcatgtaaaatataggaggaaaaaaattcatgaacttgggtaggtagagtgactttagacataaaactaaaagcgtaatccatgaatacaaaattaataaactgaaatttataaaaattgcaaatttgtgtgcttcaaatgacaacaagaagtcaatgaaaaagcaagttatagactgggagaaaaatagtcacaacctatatagcaggtaaggacttaaatccacaaaacataaaaacctcttacaaccttattataaggagacaattcaattaagtatagatattacaccaaagatatatgaatggctaataagcacacaacaagatgcgcaacaccgttattatttaggcaaatgctaattaaaaccacaatggtgtatcactacacgtacccactagaatgattataatcacaaagacagaaaatgcaaaatgttaagggtgtggagaaactggaacacatatagtcagatcggggtaatatacaaggttacagccatattggaacacagtttgagaacttcttaaaattttaaacagattgaccatgtgatccagaaaattcagtcctaggaattcagtgaagtgaaaatacaggtccatagaaagtcaggcatgtgaatatttatagcaacaatgtttttaatagttctaaactaaaaacaatccaaatgtccaaatgtccactggtgaattgataaacaaaaggaatatatttatacagtgaaatattattcaacaattagaagggatgtgctactgacaattttgcaatatggatgaacttcaaaaacactatgcaaagtgaaagaagctagaattaaacaattacatatttataattccatttatatgaaatgtccaaaaagggcaaatttacagagtcagaaaaatgtttaatgattgcttgaagctggaggtgggggctggatatactgtacacaagcacaggggaatctcgtagggtgatgaaaatattttaagaccagattctggcgatggctgtacaactctttccatttactaaaaatcactgaatcactttcaatgggtgaattttatagtatataactaatacctcaataaagctgtttagaattttatttttcagttcatatgattgtaactgctttggaatgatttgtacattactattatttaatacaaaatttcctagaccttcagaaaaatagattataaagctattgggactgagttattttggggtgggaatatctcagaccaatatatcaattggattaatgtttattgacctgtgtaacaaatgtagttatcttatactttttcatagtcatatatgcaatttggtttttgtaatgtattagcatactgatactgatgaaatgctttcatcgtattaatgtctcaatatttatatggtagtttttaattatcattccatatatttttacttttcatattacttgtctctttggtcagtcctactagaaatcttttatatcaggttgtttgataatatactctgttgtttctgttttctatggtgttaattcctgtttctttatgtttgttcctgttcattttacaatggggttgaggaatactttattctttaaatttaatttttaaaaaatttatgacaaatatttttgaagatattaataattatacatctcaggatttatactttaagtatttctatttatcattattttccaaacacttcttaatttctctacccctaatgttatttagtaatagattatctaattttcaaatatgtggaacttttaaatattttatattagcttttaattttattaaattttggtcagagaatataaatgatgtagtattgattatttgttatttcttaagactttgtgacctcacaaatattctgcttttatgaatgttttatatattctttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctatatattcttaaaaaatgtttattttctgtttcttggttgtagttgtctataaaaatctaatggcttaatattcttttttttttacttaatatataaatttctgagaagtgtttgcttaaatctctaactccagttattgatttatttaagtctattacattctgtttgttattgtttgacatatttaaagtctatattattaggtgaatatatgctcatgattgttatactttcttgttcttgttcttgtcattttttacttcatatattgtccttctttgtcacttatgatacatttttggactcaattctaatttttaagtgttaatattgctgcatatgctctcttcctcttcatttttgtcttgtatatttttattatcttactggtttgatatttgcatgccttttcattttaatttttctcaatacatgggttcttttttaaacatcaaattaccaattgtctcttaatttgtaggtttagcacatttatatttattgttatttctgttatagtgagacttggttctttcatttttaaaatattttcggttactatatttagtagtttcttctttctagctttttttgggtggtgatttatttttgttcttattatgactatccctaaacaaatagccatacttttgattatttattctattgctaatatctgtgtctattgtcaatttctttgtcttctctccaaatgtatgttaatccactctccatatattttctgtaaatataattttgttattaacttgattttagcttaaaattcttattgcttttctcttttattctttttttgttaattatagaaattgttcctttcttcagatatttctttctatatttatttccttcttttggagacttctaattctattttaaatgttctttagcttttccttttttagaaaaattgtttcttatttccattgccttctaggagaattccttgatctgatcatctggttcacaagttcattatttatttgtacctatcccatctttattctttatattgctagatttattatcatttgaatattttccatatacaaaatttccactttgttcttcctttataacttctttcttgttattgttttacatttgtttatgcagatatcttctcttatctctccataacataattagacttgataaaatatttttctacccattccaatatttctacttcaattaatacatgttgtttagtatattctattttttacttgtcagatatacagatattcttattgtaatattccataatggctgtatttattttttctgctaaattcagttaggtagtgttcaatgtcaagcttcagtctgtagcccttctggtgagtataaggatagaaaaagagataagacccagtgctggaggttctgaatcccctcttttccactccagcttgctgccacttcaccaggtcaggaatctatctgtaaggtctcaggcattgtcaacattaggaagaggtgttttctgtaggttgtgatccaccacctaggggtttggaggggaaggagatggagtcatatatccttgcgcctgttttcatcatcccccagctggccttttgacttgctctgtcattcccctctctacacctgtgacctagttagtacgttgctgttgattttctggggaagggggatagtagtgattgttttgagttaattactttgatctgtaatttccctatgcttctgtagtatcttcaggaatgatttttgagagaaaaccaagagccatcctgctttttctttatgcttcggtcacatttcccttctttctgtccattccttaaaaaggacagtctagtttccaccacaaatcctttgcaattgccgttctctatgcccagaatgttcttccctcaaatgtttttgccactatatctaaaatagtccccattctggtcactattgtatttttctgtttatttgtgagagcacttactataatttatagttgttgtgcatatctgtctctttctatcagaatgtaagctccttagaatatgtattccatttttttctctctctctcttttttattttatattttctgtggcagcttcacagtccagaagagtgctaaaatgtagttaatatgtaataaattttgtggaataaatgaacaaatgaatgaatgaaataacttatatggccactgcttatcttattttcaatgtatttttaacttctttctaaacatatgaatagtggagtatgttctttagcttttcttttctattttcagttcttttccttctagataagagtttctcaacctgatcttctgtatcctacttttattctttatattatgtgacatactgatacatcataggtctacattctaagtgtttcatatttatcattaaaatgtctttattttgacaatgataacatgaagttgtattttgcaatgtgatattctaaagaaaaattatccagttttattatttggttttaggtaaaagttaaagtcaagttaactctatatcttttttagctaggttatgtcacaataataagttgccaaataatgtttcataagaattcacttgatccttattgcaaatctggaatgtaggtagggtgtgaatttccatttttctgatgaggaaagtgaggtgcaaagaggtgaagtgagtgggtggcaggtctgagacttgaacactagtcttcagttattactttgtacatttgtttttctttaccatcaggtttgttcctaagtgtatgtcacattattagaatagagatttgggctttctcctgccgtacctaaaagatgtttagtttacttggcttgtcagtagagaaaacattgaaaataacaacaacaacaacaataaatggttctgtgtcaggcactgttccaagtgctatacatgaattaacatatgtaaatccctatatagtcctgagagtttgacaaaattataaccattttgcacatgaggacactaaagcatagaggtgttaaataacttgtccaagtcccatagcttaagtggcagacttagaaatatgaaacaagcaatcctgctcttaattactattctaatctataataatagaaactttgctgtagtttatagtttacttagagctttcatatccgtaatctactgggcctcactactactctgtggagaaggcaggcaggattggacagacgaacaacatgccaagtttcagagtggtgacgtggcctacttcacccagacagcaagtggctgaagtaatactgaaattctttcttttgaaatctaattttatctgttcttggatcatgttttattgcccataaatttattagctcaatgtagccttcatgatatgtttttcttctccagcaatttacattattgtgggcttaaaatgttaatctatttatacatctaaggactattttgtttcttacattttgacgttccttgatcatgtcttttgcagctgaattgtgatgattttaaaaaaggagaaagagatggggattttatctgtcctgattattatgaagctgtttgtggcacagatgggaaaacatatgacaacagatgtgcactgtgtgctgagaatgcgtgagtattctctgaagtaggctttctccctaaaacgtgttctctctataattacatgacacaattttccctacagtctttaagctaacgattcattatgtgggagttagccattcctaaattattagtaccacttcttttactactcttaagacaaataaaggtgtatagcataacactttatattttacaaagcacttttatgtatgatttatcagatggttatcactttatgaagtagacagaatagggagattatagattatatgttcataatctataaaatgttatagattttatatttaaaatgtataataaaatatagctttaatataataaaacagatttaatattttaataaaatatagacttatgattttataatctataagttatagattatatgattatcatatataacagattatataatatatttacacacatacatacatatatacatatatatacatacacacatctatcttctatctatccatcatctattatctatttgtttatctatgtgtataccctttttcacagagaattatttcatcatcaaattatgtttattaagtgcttaataatttgtaatattagagtagataattgagactttcaatattaaatttcttcccatctctcaacatttaccaaatagctaaggcatcttactgtcctatatcttgtccctgttttgttctttctctaccttcaatgctagatttggttatcaattgtcttcaccaacaagatgacatacctgcttggcgggttctggcttgtgatctcaatcttgaattgtctggtcttaaggttttgcaaatatgaaaaccaaggtgtgtacaggctaatgaggggtattataattattcactttttgagatcctgcaagctttagctctccttgcaataaatattttcagcaaaataaaactgcattaaaacactctcatcttttgcaggatggtattttcagaaattcactttaaaattatgtcctcaactctcaccaagggtcaacatagagaaaccgaaaacaaacgtagatatatgaagaacacacagatttttatcagatatatattgtgtagcacaagtatgagcatgctatatatttaattcttactgtgtcttatgtggggaatcccattataaatctttaaatctctggtccaggtgaaagtttctctcccctaatttctggtatatttctttgtactatgtactttgtactatgcgatgagaatcatacttctccttgtgttgtttcccttgcagctctagctgctaggaggctctacaataaaattgaaaattttatttttatagtgcccctcagctgatatcctttgaaataacttttttcttatcacttttaaatatttagtttttttctttatattgtttttactaaatttttattgttttacagatgttatcattgtaatctgctttaactttttacaaattaggaaatatgtcttacatttgcggttctgtgttttcagatatactttaaaggtctacgagactgaacaaaattaattatcaagactttatgtactttctatgaaaaataaaatactagtcttcataacccaaataaagagtagtatagtgggatgttagataatacaaatttgactttgtttatttaaaacaacaaagttccttgggtgctgagtgttatctattatccagttacaagctttacttttccccatcttctgatgtggatccctcctctaaacaaaggttaaaaaaagatttctataaataacatttacaagtctgaatctttaccatctcttccatgttaactacatttctttgacttgaagttataaacagtgacttttattagaaaaagtaataaaataatactatgtggcagctgttttcgggagtaaaggagaatgacaatgcaatgtagagcagttaggtttgaatggtgggaagttctgtgatattaaactgctgtgtctactaacttttgattctaggaaaaccgggtcccaaattggtgtaaaaagtgaaggggaatgtaagagcagtaatccagagcaggtgaggtcaattgtcagcctgatgggaaatactgggaggctaacttcaaatagtaagtaggtgctctcctcttccttcttaggtgggagccttggaaggaattaattcttgctttatgtgaaatggaatacccagtactgcccactaatatgaaaaagctaattatagtctctgaaactggatcagattactttggtggttagatctttcaatctattgctgctttgtataaaaaaaaaaagaagaagaagaaataaaaaggaaactacatgtgtagtagaaagggcacaacacttcagtcacttagcctgcgttaaaaccccagcagtgtcacttgctgtttggagaccttggacaaattacttaacctaaaatgagatttgaactaaatagattttttttctatgatacagttttgtgagcctgtgatggtaggggaaggggaaggaagaaaggatctcatacatgtcacacttgtctttttccaggtgaatgattttcctaattttcaaggtctgatgccctttttataagcttccagagcacctgaggtgacttgcaccaagtcatttagcatcatgcaattttaaatgtctctttttatcacctaggagattgggagcaagttgatggcaaggactgtgctctgtctgagttctggcacatagtaggttatctgtttactaaataaatgaataaacaagtaaaaaagttttatatttaaccacatgaattatagagtacttactgagctacatctacacagctggtactgctctaagtggcccatagcaatgtcagagggactgagttcaataaaatttctgaaaacagtgttgtcagcattacaatcttggtaagtttcaagttcttttccctgttcttcaggatgtatgcagtgcttttcggccctttgttagagatggaagacttggatgcacaagggaaaatgatcctgttcttggtcctgatgggaagacgcatggcaataagtgtgcaatgtgtgctgagctgttgtaagtagcatcatccccaggtggacttgatgatgatgcacttggttgctgtcccgagaatcactcagcagagagataaaatccttttcatgaagcatgcaattctttgtctttacactgtgaaatagcctttctcacagaaaggcttcttttctttttcttcttatcattgattgaagtttcttaaaagaagagaataaggtggtcatgttagttattaaattcaagactctcatttcttttaaattacagtaatttgaaaatgtatagtgttttataaggcacaatattttaaaatttagaaagcactttcatatggaatgatctaggtcagtcgtctgacatccattgcttcatttgggcatatgtagagacccttcctgagtaatgtgaggctaattaaaataataatagtaataatgccatgtgtctgaatctatttattagcttaaaaagtggaacgcggatcattacaaaaggaagggctattgggttaatctttatctgagtgcctggcagtgcttgggcattaaagacgcagatgtggataagatctaattagtctttcatattctggctgttaaacaaggtttagactctctaattcacgtgccagcaaaccttaaattgctatatttacatcactggaactttaaaatcaggacagagatttaactgattagcaaacaaacgtcacacctgcctttgaaaattacagttagtccttgtagaattcaaggacatgtccaatcaggtttacaaaacagtgatgataactggtttccagacaggaaatcagcctgatttccactttcttatctaggagacatgttctctcaatgttcaaatctgccctaattctgtagggtttttttttctttttatgcattatgtgaaaaggggaatttgacctctctaactcctggtttcttactctgtggaactgagatagccacacctatctccggaatgagacgctaatcaaatgatagatgtgaaagggcttaaagctcaattcaaatgtagctttcattaacaacttagtacttttacatgaaagcaaacaaatactttacaaggtatacaaagttatacttaagggtgtggatggcaatgtctcaaatgctcagtttggtttcacccttgtcacagcattattttaaagctcttggttctgcctgttaaagggaattttcctgacaatcttctgtttgtcaatcaaggtgtcacacccattcagttttacagaacaaagcttctaattgactgtcagtgagtcagtttcacaccctttcttactataggcaagaaagctaatttacagaaagcaagtttcccagataagctattgccgtctttctttctttccttatctttggcaatttctctggctcaggcattgaagacggaaatgcttgtctcttgtaagaggatcattttcagcaattcgtagcagaggatatgaaagtgtttagcacaggactgaggatactgaaaatatgattgagtcataaactgaccaactgtttacttttcttaacagtttaaaagaagctgaaaatgccaagcgagagggtgaaactagaattcgacgaaatgctgaaaaggtaaaatgactcaccaacgcaattttgttcttgtggccatatttattaacaaatgtatgcctaaacctttgagtaatgaaataaagtcattgtcttttattattatatagatatttttcttaatatcaaaattccccaaattgactattcctagaatattaatcattagattcagatttaaaacagcatttcctacctaaggcccaaaatgtgcagtttccacctgtgtttctccagtcctctagcccccaaaagaagatataagatagaaagtttgtataaaccaaattctgcttaatttctagcagccttctttttggtttagtgtaaacccattttactctgtataaattgtttaaaattggcaatgaaatataaattaaacaggaataattttaaaatagtgagagtgttttaaacactatatccactagtgcattttatgtgcaattaaattgacacaagttgaagttattcactttgccattgtgattattctgttcagaaaaacctgcatttataaaggtcttgattctgctttaaaaaaaaaaaaagacaaatttttagaatgtgttttaaaaaaatccttaaaattatttttttgaaattacttgataatttaattattcaatctagtataaaaagttttgaataagcactttaggtaatgcagcctggatttcttaaatcacctactttcaatgagagggatagcagtttctttgctaaatggctaaccttttgttgagaagtcagaacgcctgagttttagccttggttttgccatgctctgggtgtgggagactaagtaaataatcatcctgggccttaattttcttgtcagcaaagtaaagaggttggataatgacctgaattttaccttcctgttggactgtgattctacatcctgcacacttttgtactaatacaagtgcactcctttttgcagatcgtagggcttatgttttcctaaaggaagaaacaagcccaccttttggtagtcaagagctagcccttcagttcgtaatgcttatttaatgaagcaaagctctcaacctaaatagggtattgaaggtttacatttaggaaaactaagtattcagaaccatctacagtttatgcaacacttgccaaggattgaaaaggaattcttttgtggtggttgttaaatttcagtctaaaactttgggtcatcctgtgatagttaacattttattacttcataaacacagagagttattttcctttgtttttcattaggtctctgtacttccctcttcctctctgtggctagggtcattgttttggtggggtcaccgggcatgatggtgtgaataggactgctttattgtgatggctcaatatgttccctataattaacttgtcactaggttgcaaacacagtgtttcttcagaatctccttggctgaatcacaacttataaactgaaattatcattgtttcttttacgagaatcattgagcattaattttttataccatgctatgattatcaggtgactgtcttctgcttctctatttctaggttgttacaaccatgaggtttggagcacatccattgctcctccaaaaataaatatcttcttaataggaagcagttaggattctctgttaaagcatcccaatggaatttgaattattttttaaaaaaccaaagaatgctagatctagaaaaggtcctacagagcatctgttccaaaaacctcattgtagaagtagtaactgtggttccaaaggagaagggactttgctgtggtctcccatttgggtgagagggacaatctagtggcccaggtcatttgactcctagccatgctctttatgcccatgttttcttgcctgaaattgaatgacgaaggtcacacagttgaaaagaaagttatagaccaggattttttgtaggtcatattatagtactatatctcaccacaaaatgtttaatgacatagagatccccaagcctagagtagcttagagtatcatttttttggtaaagtttagccctcctcacatagtagagttttcaaaacacagaaagtagcctgaaagtattgaaccaaagcatcaggaaatctgaaaacaaatctttcttggattttttttggtggggggaagtcactcctttttagcttttctaaatgagtatcagtcttgatgatctatctgtctaaggtgagggtgaaaggaaattagatctactctctctctacaatgtcagaaattattatggataaagaaggcagaatacacaaaaattatccacagatccatagagaaaatcaactaaagtaagcataacactgttggataacatcttgtttctttatacttacaaacttagctggattattcttgacttgatccatattaagtcacttttagacatctcatcttctcacaacttttttttctttttttttttgtgatttggctgctgcattttgttgtgtttgtgctggaacctcatgaaagatatcccctgacccctattgatctgaaagttaaaaagaaatacctagttttaatccaagaaaactcttggtcagccttattttttccgaggctgttttttatcttttaataaacctaccacataacagatacaagtgccaagtagttgacaatataattactgtttcttagtaatcctcattaatatgttgtatgtatttgccaacttctagacctgatgttttgtggtaataaatctattataaagtttccagattaaaacgtagaaaaatggtaaataaaattacttgttggctggatgtgttggttcatgcctataatttcaacactttgggaggccaaggcaggaagattacttgagccaaggaattcaagaccagcccgggcaacatgatgagatccagtctctaccaaaaaggaaaaaatttagccgggtgtggtggtgcatgtctgtagtcccatttagttaggaagctgaggtggaaggatctctgagcctagaggttagaggcttcactgagctatgatcattcccctgcaatccaccctgcgcaatgcagcaaaatcctgtctcaaaaaataaaatatcctgaaatgaaatgaagtaaaataaatataattgtcttttcaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttgtgagtatagaagtggttttttcagagtgattcaaagggtgggagtggagattgattggattgatgagtaaaaataactttgaaaggaagctttgttgttgagaaccatctgagcagttttatgccctccacaaatcataatgccacctagtgagcaggcactactgatgtttgtctatttctgaagagaaatggattccattttccagttgaaatattgacttacagcatagcacacttcttaacattcccctgtgactgtgacctatgtgaaactgtttgtgaactaattctagtatagaatgggggtaaaagcaggtaccacgacttcgattgtttttcttcagtaattatcccatggtaacagtgttgatgcaacactctcagatacttcaggtttatacattaattggattactcttatctttttatctgggacatatgaccttgggagaagggcaaatctcacaacatacaaattatcacatttatgaaaatgtcttagatgacatctcatgacactttcggcttctctagctctacaagccctttcctgtgtcctgtcctatgccagttcctcccggtcttggccagatgatgtcccctcctcttgtagattacatttcagattatctttccttggacaagaactcctaaagtccttccctaattgaaattaaattctcataatccttagtaattgtcttttctaaccaccatcacagttggcaattatacaattatttctccaagtttttgttgactttcagtcttttctaccagcctcaagaactacaagagggcagggtatgtgtttgtattatatactcctgcatgcccagggcccagccaacacttgcccaaaaaaccataattactcactaaatgaatgaatgaagatatgaatgaagatctcccactctcaagaagcttaagttcagtagcagaaataagccatggacatgtgcacatatttatatattgcaaaatagaataaaaactgctgtataagagaagactattcgatacaaaaacacagcaatagacatagcgctcatttgtatttgggaactggaatgtcttcttcaaaaaggtagaatttaagctgcagagttttaaatttcttttaagaaagggagatgagaaaaaagatcattttagtggaagtaaatggtataaaggtgaaattaaagggtctttttggggatttgaggtgtttttaaagtgtttgtactaaaactcaggacaacttagatatttttccatctatacctaatgactgttttgtaacatgaagatcggaagcatctctactcatttattttactttttccagcaagcagcgtttttcagaggaaaacagtaaaacagatcaaaatttgggaaaagctgaagaaaaaactaaagttaaaagagaaattgtggtgagaatcagtttgatcaatctagttacaacttgtgtgtgtgtgggggggtgcgtgtgtgagagagtgcatattacatagtatgcactttcaatattgtttaatattttccacactactagtaggtttgctggaaactaatttctagttattattttgtgaaacttagattaaaaaattatggcattacaatttctagctgtatatggaggcaattaatcaagtcacattaataatgtagttttgcactcctaaatgaaggtgaaatatcaaaacattgtctgaattcaaagtgtgatatgtagtcttcgatgtgtggtagctattgtgaaggtatttacttcaaaaacaatatcaatgttgaattttaatgtgcttccttttaaattatactgttctctgctttctaagtatcttttaactagtcacctgtctgtttttctactgctaccctcttagctcagacacttaatagttttcttttgcattgacgtattggcattgtacctggtttgtacactgttggtctccatctttctcaatcttcaagatttaattcatcctccatgttgttttcatatgtcatagaatatgagaacaaaaactatggttccacgagtcagcgatgctataaaattccaatgtttgaagatattctagagtatattcagaccatttcacttcttatagaaaccctaacttatttcttacagacagttttccagacttctatgatgtgcagtcaacagttctcctaagtaagccactccatcaggccaccctctgccagtataactccattttctttctttctttctttttttctttttctttttcttttcttttctttttttttttaagacaatttctttctttcttttttttctctgtcacccaggctggagtgtagtggtgggatcatggctcactgcagccttgacttcccactctcaagctatcctcacacctcagctttccaaagtgctaagattacaggcatgagccactacacatagcttaagcctcattttgaactgctttcttcccctcagtcctaggttaccaagtccttttaattttgatattcaaatatctgtcaactactattttatcatttatttccaatttttctccttccttccctttcttcctttcctttctcctttttctttttcttctctctattcttttttctcttttcctccctctctttctctcttttttaataatataattactgttctaacttcagtccctagttaatcaaatcctccacacatctggttgataacctttgtaaaacaaagatttgattttgccattttctgctataaacatttataattttcccattgcctaaaagtaatatccaaattcctttcaaagtttagtggtctttgattttcaaggtctccttttgaccatttcccaaatattattctctttatccaactaattatttagccactatattcataaatatgttagattacctcaaaatagcatgttctttcacacccctgtgtgtttgtccatttaattcctcttggatggcctttttccacattatgttcctgaatatattctcaagatagaacttagacataagttccctgaacttccatgaattattcttttcattgtacttgtacacacttaattcagactagtgttatatttcttagctttttatattgcaattacttatcttttccatttgactgataaagaacataaatataaataaatcatatttctatttatatattcctaacttaagcattcgttgaaaatgtaaatggatattacaaggagagaaatatcacaatttttggatggtcctaaatcttaaaagttttatttttcatccttaatttctcttttttctttgtaaaataacatttaacattcatacatagaaaacagaactatatctcaactttttcttattcattattcagaaactctgcagtcaatatcaaaatcaggcaaagaatggaatacttttctgtaccagagaaaatgaccctattcgtggtccagatgggaaaatgcatggcaacttgtgttccatgtgtcaagcctacttgtgagtatagagttttagaatgtcaaagaaagaagggatcttgcaggtaatttaatagaaacagcttctttcatagatggggagactgtggctcaagacagggaagtgagttgaaaacattacatggaaaatatcagtgatagagctgggagtaagtacctagagttatttgttttaagacgccttgttcctctgacactccctcttttagcactggaatgtcctgacaaacatgaacttgtacaaatagtagatgcccccttactcctgaaacttcacacgttagcctgttttagcaatttataggtatctcatcttccatgggagttaagagtccaaaggtgatgcttaatgtagaaatggaataaagtcaaaattcccatgaaacaacactaaactcctataaaattacaatgggtattattttatgtaatgcaatatttctcaataagttagaatggacagttttctttcaagatttacgatagctctttatttggctgagctcaaattaagtatttaacttatatttagaatctatggctttctttgttttgattgacaactacatatggttgaaatatcatcagttaactgtacatactgtgcaattccattgtacaaagcaaatttaggcttatttgttttatcagtatatggaaattattgtggttttttttttcacatcttgtcctttagatgaaacagctatgagtaagcaaaatatttaagtttaaagcaaagctagggtacacatggtgtgatagatagaccatggtcttgagggaggagaccttggttgtagtcatatcctgagatgtagcaaagaccccctctacctctcatcttctctgattaacaaggggatgagtagatgtgctttgttaaggccactttcagccttcaggttatgccaccatgattttagttttggtgcctctgttatgaacattgatcatgctccttttcttactatgggcaagaaaactaatttacagaaagcaagtatcccagatccactattgccgtctttctttcaacattaaacagacattatgaagaaatcatagcaccatactatcctggaggatattttgttgcttctcattgatatgcagtgataaagggacaaaattgttccactctaaggagggagaacagttaacagtgcaaggatgtggagaaatcatggcatgtgtttgttcctaatggatctgcttctttttccctcttattcagccaagcagaaaatgaagaaaagaaaaaggctgaagcacgagctagaaacaaaagagaatctggaaaagcaacctcatatgcagtgagtggaatccatccaataaatcctatttggtgctataatttgaacaaattttaagagcctaaagggtgagattttgccctgcagaaatccccagaatatcttaactcttcaatctggggatggtattgagatgaattatatgggaagattgatccattcttgctgattaaaaactaactctgcaaaaaaaaaaaaaaaaaattgtttaaaagctgaaaaactgagttctacttctagttttatcacttatagactgttagcttttgctaactactttccagagaaattctacatgtatgctttctacatatgagtttctgatatttcacatctaatttgagataaaaaataccttgattcccccaccaacgcatgatttttatccctgaaatattacaatattagtttccaaagccttagctcagttatcatcaccaatggttttgatgataaaagtctcctaattttcactctggattttatcctttcccttgcccaaccagtctccctaacatagttggagtaatgtttcaaaatgtaaataagatcataatattgctcttaaaacccacaagcagctcatcatcatatacaggatatgctttaatcctgttatctctcctcttatttgtatccttatctccattcagaaaatcatgctctgctatgtgccatgtcttttcctacctgtgtttttcagctagttttattttcataaacctgtgtgcgtatttcccaattcacttttttttgcccagtcaaatcctatttacacttccacagtctcacctaaattgttcttgctccctgacaccttccctggtttcctttgagttctcagattttattgtaccctgtatgttcgtacctattttattctgtttagattatagtggaatttgcttatatattgcttgtattatatggggacattgtgctatgttttattttttcctatctcttggcatatgatgtttttcttgttgtcaaattgaattttacatttgagaaaaacacaattaaaatcctcagctcaaagagatgtaacattagtttctgccaatgtagatgtttgaaccttctgctttaagtagaaatgaaatatatggccaacttacttcttctatctcggcaggagctttgcagtgaatatcgaaagcttgtgaggaacggaaaacttgcttgcaccagagagaacgatcctatccagggcccagatgggaaagtgcatggcaacacctgctccatgtgtgaggtcttcttgtgagtagccctgcagctgggaacatggaggaatgattttgttctttctatttcatttccatgttcaattatgggagggccacttcaacataaaaatgaaagaattaaggcatatttagagaaactgtctgattggagacatgtatttgaaaatccatgtcctttgaagattgtcaagacttcacacttaagcaaggagaaagtcataatcttgaaatattcaagtagttttgtcttttaagtgtggaaacaggacaagttctagcttatctccgtgaataaaagtgaggccagtgggccaaagaatgaaaggtctggaagacaggttccaagtggatgccaggaagaacttcctaacagtttgcggatttcaaagatggatgatttaccatggaattccaaggatgatatcagtacagactttacaggcagattaaagcaaaggcttgggagtcattagagatacagtaatgagcattggaaatttagaaaaccacctctggactagggtttaaatcccaagtctgtacttattatttctatatcttcaggtgagttatgcattccgtctgtcagtttatttgtatgttggggttataataatagttttgtaatgcaattgtgaggatttcacagtgtaagcacagggttaggcacatcacattcaaagaatttaatcgttgttaagtgtaaaattaaattatatttgagatcacttctaatgtggcgattctatgatttttacttatctcttcttaaccatccttttttagccaagcagaagaagaagaaaagaaaaagaaggaaggtaaatcaagaaacaaaagacaatctaagagtacagcttcctttgaggtgagtttatatcctccagcaactcagagggatatggccctgaggatccacagatcatgttcagggaacacgtgcattccttaaaactgtatgaaacaattgtacagtttgtgttttcatatgtgttttcatgtgtgcagttatacatgtgcatatgtgactatttcttggttgttgggttcattgtttttatcacttaaaaaatccatgccttcaaagttaatcattctaaaataagccaattgctaatcctcgtttaagaaaaaaagtacaagctttagctatttttgcaatctgattcagcctatgttcaacactttcaacttcctgcctcaatttcacaggagttgtgtagtgaataccgcaaatccaggaaaaacggacggcttttttgcaccagagagaatgaccccatccagggcccagatggaaaaatgcatggcaacacctgctccatgtgtgaggccttcttgtgagtagagcagtagccccatagcgtctgaggattgagcagtgggaatttccatgggaagttttcaaaccattgtgaataatgcattttcttcttcagtgtagcattcagtcttgggtgtcatatttaaatggactaaaaacaaacaacagcaacaataaaacaagtggagggctttctattatgatataaagagatgcagaataagccagacacagaaaaacatataatgtgtgatgtctcttatatgtgggatctaaaaaaagctaactcatagtagagagtaggatggtgcttacaagagaatgggagtagggaagggtgagggttgggaatgaggaaatgttaatcaaagggtgcaaagttttagttaagcaggaggaataagtttatgggatgtattggacagcatggtgactacagttaataataatgtatcatatatttcaaaaacattaaaaaagtaaatcgtaaatgtccttacaccttcccaaaaaagataagtatcatgagacaactatgtaaattgcttgatttaatcatcacaatgtatacatataccaaacatcacactgaattcaattaatatgtacaattattatatgtcaagtaagaacacaatttaaaaaagtgaggtgcagaataatttcttctatgacatttaaaaagtaacctagaatcattcacccagagaagagaatacttcatgataattatactaattgcttttagttttatgaaaacattatcagatgaaataggaaatacatatgattacacataaaatattacaatgcatggaaaatttatgggatttttttgttcactatctttcttcctacttattctatgtgattttaaggaatataattaaaatggaaaagagctataggaagaaagatttgggctcatgatgaagattaactttgtaataaagcagaaaaagacaagaatggagattttattatgtaggagttgggagcctattgatagggtgcctaaaataggtctttaggatgaatgtcatggtatggccggcccttcaaaaacgtgactaggcttttcttaaactcttgatttttgactaaaaaaacccccattttatttcccatgtgccaagaatcttagaaaggacttaatttatttagtcttcccatatagaaagcaatataatccagcatattttcccatagcatttgaggcttggagcactaaaaatctattagaaggaaagttgagatcatgaccatataattatcacaacaaacgtttgttgaacgcatataattatgtgacacttgctcagagatttgttgcctaatctcatttcatcttcacaacaaccatatgaaatagatgaaaccagataaaaagcaagaacaaaaaacaaaactaaggcccagaacagttgagaatgacggaaaagtcaggacaggatatgggacttacagatgaaggaaaagttaatgtatttcttgttgtggggtataatcacttagtgaagtctttcagcctgttttttgttctcccttacattaatttttcagtagcaagaaactaattctgccacttagtggtcatctttgctgcctcctctgacaattttccattggggaaagaaaatgctgcttaaatgttttagtcaacttagactcgtgataaaggttagatcggttttcatataaagatgtatgaacaatcccataattttagatctattttagtcagtttatttcataagtatataaattctttattgaaaagaaataacctttatcacctcatgttttatagatatgttaacaaaggtgattgattttttttgagaattattctaccctccatagttagtttttgcacactttcataccatgtgaaaacagtcttttcaatttttaaaaaagttttagtttgatctatgtgcaagtattttgttgattgggacacattaaaacattttcacaaattatgtaatttttttctacattttgaactatttgtgttatatatccaattatgctgtagatccaatccaccaagctcaatttgcaacactgttagttatccaaaatgtaacagctatcactttcacttcatttccatcatatgcctagttttggaaggaaagtttcctttcaataatgacaataatgattatgtcaatctcttataacaattatatcaattattttattttgtaccaggtactgttctaattgctttacatgtagcaactcatttaatgctcttaacattccaataagaaaggtacttttattacctcttctattcctcctaaacacacacttaaagatgaggaaggcacagagaggttaaggtacttcttgtcttccttgcagaatttggctccagagtctttcctcttaaccaccatgctatactgcctctcagaagataaatattacctctccataaagagtaatcacacatgcaaaagaatcagcaaataagaaagtactattgcagtacatatactgggaagttaaacaggtttactccctaattcaggggctttctcttgcacaccattctcttgaggtagagtgaatcataattgtttattgtctaataaaagtataaactactatgggtggatatttggcagtgtttgagaatagtcaaaacaataaatgatcaagctatgaaagttaaggatctagtctactatattaagatccatttctggccaggcacggtggctcacacctgtaatcccagcacttttggaggctgaagcgggtggatcatgaggtcaggagttcgagaccagcctggccagcatggtgaaaccccgtctctactaaaaatacagaaaacttagccgagtgtggtggcatgtgcctgtaatcctagctacttgggaggctgaggcaggagaattgcttgaacccgggaggtggaggttgcagtgagccgagatcgcgccactgcactccagcctgggtgacagagagagactccgtctcaaaaaagaaaaaaaaaaatccatttcttctctctttttcttttcggtttcttaaagtcaacaagaagaaagagcaagagcaaaggctaaaagagaagctgcaaaggtaatattctcaggaatgctgatgctgtgccctgacatttttcatttctttataattctttacttatcctattagaataaatgttttctgtttaattttcatgcctgaaataaatgaagaacatttttaacctgaacaaaaagggtcctgataagaagtgtccagagtaccaattttatttcacaattattcaaattttgaggtttatttcataaaaagtggaatgttaactttttgtaaggaattttccccatatttggcttttattagatttctgttgttagagtattaacttatgccatttactaatttcaatttacattattcatatctctgttatttcaaatagagagtataagatctcaatcattccaatttacaaaacgaaagcacatatattatcatatttgagctttgtcaccacccagctatggagcaagtggtggttttcttgcacccaattaagattattaagttgggcctctgactttccagttatttttattccactctccatgcttttataattttatacatagcagagtcaaatttatctgtgtggagatgttgaattattctcatataatagctacatacaagatttatctttctttctttttttctgttttttttgagatggagtctcgctctgttgcccaggctagagtgcagtggcgcagatctgggctcactgtaacctctgccgcccgggttcaagtgattctcctgcctcagcctctctaatagctgggattacaggcacgtgccacaatgcccagctaattttttttttttttttttttagtagaaatggggtttcaccatgttgaccaggctggtctcaaactcctgacctcaagtgattcactcaccttggcctcccaaagtcctgggattacaggtgtgagccactgcacccggcctgtttattctatttcttaacaatagccacaacagtacaaacctcatcattacttggggaaaagttgacacagtttaaaatttgccttcttactgactcttttttttttaaataagtgtttctactaggtgaaactatcttttcattgatcatttagaattgaaaatgtgttttcatccattatgtttgatcagctgccaaatcctcttagatatttccagtggtattaacatattcctccttctctccactcctattcttaccctcttgcttcaaatccacatctcccattcctggtttttaatttttttaaatcaatttactcccagaaatatgttagtttctccagggatcagacttattctcttctctatgtataaagatatgtctttttaaatttatttatttatttatttttgagtcaggtcttactttgttgcccaggctgtagtgtagtggtgcgatcaaagctcactacaacttcgaactcctgggctcaagtgatcctcccacctaagcctcccaagtagctgggactacaggcacacaccaccatgcctggcaatttattttatttttttattttgaatttttctgtagacacagagttttgctattgtgtccaggcttgtcttgaactcctgggctcaagcactcttgcagtggcctcctaaagtgttggaattacaggtgtgagccaccatacttggacaaaatatatatttatttcttaggttaagcatgttttttctcttctttctcagacccctaaagacaaatcacaggtaagcaatattctcatttcctccaggaaggcttctcatctaagcctgcctatggaatcttcccacctctgatctttcctagcttttacagaccatgctatgcaacacaacacacacgtatgtttttgatgataaatattttcagatctgctataatgatgggacaattctgattgatgacggaagctttgtaaatacttactgatttactactatgtgttatcacttttgtttttactttttactctacgttacatattcctcataataggaaaagatgcaggaaggatagaaaactactctgagaaaatattttcttcatttcccaggaaatctgcagtgaatttcgggaccaagtgaggaatggaacacttatatgcaccagggagcataatcctgtccgtggcccagatggcaaaatgcatggaaacaagtgtgccatgtgtgccagtgtgttgtgagtgtccaccccatctctcccactgaatttcttcatccatgatcgcccctgagtctcagatccttcatgcatgtgtagagtatagaccgtgagttatatattagaaaggtttacaagcagatggataagacattaagtaatattgaatcatatagtgacaatactattatttattcaattatccttctattttccaattaagtcaagggaaaaagctcaatttaatggtttttttttaacacttgataatcttcatttgtgaaaaagagagagcagaaatttcatgatttggattggatgatctttttgatgtctttcccactcctgacattttatgatttgttagtctattcagataggagctaaggagaagccagctggatggaggtctgtggggtcagtacataaagactattaaaatagcctgaacaataaatggaataggaaggattgttatttatcctttcaaggacattactatataatgcaaacattcataagtggtttagtgtggagtaaaacctttaggaaacaggctcataccctaaatgtttactaaaatgtctccttgttaagccaggttcatggccttctaaggtctttgttttgctgagtggtgtaggtaagcctgtgactacagctccatcgtgtgggacaatatagaggttaattattatcacttctaattctcctttttaggctcttaatctgctcctgaacttaaccctaaaataaatgccgagaaaaacgcttatttaaataatacctgctgaggtgcaaagttaatgtctcctaactttcacatgtcttgatccaaccttaagtggatgcatacaattccctaaaaggagaggttgacagagtagagcactagaagaaaagtggcctgaaattcaagaagccagggtttttctctcacccgttcaatttgctggtgttgtggtaatgactaaatgtagtaaatgctaaggattttccagcattaacatgctatatgtcagtagaaaatggcaagaataccagaatattaggcttgtgttcaacccccaaagattagcagttgaatctaactggacttaaatcactactgcaatctaaaccttgaatttcaacttcaatattagctccattgaaataatatttaaaatttttagtttaaagtaaaacatggtttattatgattttgagcccatcatctgacttagcatcaccctttgcctttatcacggatatggtagttacttggagaggaaaggtttaagcagtgaaataaaatcaagacaattgtagctttattcggaatgttaattaaaattagcgacgtacaaaaaataagatcacctgagggccacagactgataaagatgcatgcttgttttgtaattattcttctttagagggggaatgtaaacagctaagtttatctgtactattggttaaagcaaaagcacctctcagactagataaatttgtattgaagactgaatctgactgttggtttggaagatcctcattccttttaaaaatgtactaccaaaaagagtagggaatcatattcagcctatatcttctttttctattacagcaaacttgaagaagaagagaagaaaaatgataaagaagaaaaagggaaagtcgaggctgaaaaagttaagagagaagcagttcaggtagttgtttgagatcatcagagccacataaatattcaacgatcactctccctagggagggctcctattccctcctcctcattccagtattcttagtttctttgcaaactgggaaaatgtgtttggatccccatatacaagagtactcccctttccttattcaatttattcacattaaatctattaattgctcgtgcaggagagagatcaatcaccattttctcccctgattgtgtcaattatattacctaagaaagaagtatatatagattgttatcttactgtctgaatgcagactaatagagacagatgttcagatttttctcaagtacatttttgaatatgaatatttaccttaaaaacagcaacaactagggatcccacttaattatctgtgagattttgaggagataaaagcatctctgagtcttgagtttgcattctttaacatctcacatgatggtgataacaatgataattgtacattcgttgctactgtatgcatcatggcataaagttttatgactgatatttgtagtagccattgaagggacatattattatctgtgttttatagaagaggacttggaagctgacataagaagttaagaaatatatttaattagttacatataatacaattatatactgatatattatttactatatattaacataaatattatatgatacaaataatatcatatataattataattatatgtagttagtaacttgagaaccaagaattgaaccaaaagttctggctttaaggcccatgatgcactttagattttacacgcttctgccatttgtattattcctgcagactatgccttaggtcctcattattcttttcttttgtccttctgtgatttagaagagctcatttctactgctcttacctttgctctctacaatctactctcaactcttaagccaaagtaattatttaaaaccataaggcaggtcgtgctacccagtggcttctcacctcactcaaagtaaaaatcaaggtccttgtagtgtctggaagtgccatacatggtctgatccctgccacttttcataggtcacatttcctattattctacattgttctccatgcaccaattatactggccaccttttggtttctgggacatcccaagcattgattcatggctttctatcacgtggtcacaaaaacaatgtggttaaaaaactggactctaggctcagactgtcagggttcaaatccttgcttcatttccctaccagtaaggtcctacagttaacatcttcatatattagctttctcacttataagataaggacattattattacgtatattatttttatgaagtcccaagaaacttattaatgtataacagcacagtgtcacacatatcttaagtagtcactctttaatattatatttattgctgttaatgtcattattggtctaatctcattgtccagtggggtgttccatactggagagttcaccaattcttcaacatacaatgaactttaccttctatatgccattactcacagtcagaatatccctcttgtctaccaaaattctggccacttttcatggctcagactgtgtgttaactgctccctaaatattttcccatgtgtgcaatatacttaataactctatcacttgttatgccaacaatttaaaaagtattttagttatattattcattgtattataacttatagttgcctctatgtgttttcttcaaagaaattaaaaactctgtgctagttttctatggttgcgataacaaattagcacactttagtggcttaaaacaacataaacttctcattgttcaactcccacttatgagaacacatggacacagggaggggaacatcacacaccggggcctgtttggggactgggggaaaggggagggagagcatgcaaatatctaatattagccccctcatgcaaatatctaatgcatgcaaatatctaatattattagccccctcatgcaaatatctaatgcatgagggggctaaaaacctaggtgacgggttgataggtgcagcaaaccaccatggcacatgtatacctatgtaacaaacctgcatgctctgaacatgtatcccagaacttaaagtaaaataaaacaaaataaaataaaataaaaaacaatgaaaacaacaacaataacataaacttcttatcttatttcataggttagaaggctaaaaaggatctcactgggctaaaatcaaagggttggcagagctgtattccttttctggagtttgcaggcgacaatccatctctttttctccaaatctagaggccgtccatgttccttggttcttggaccccccttctctgtctacaaagccagcaatgttatatctctctgactgttcttctgtggttacatctccctctcactctgtcttccatctcgctcttgcagttttaaggactgatccttgtgattgagccttacactgagcccattatggcaatacaggataatctcttcatttcaaggttattaacttaattatatctgaaaagccctttttgccatgtaaggcagcatattctcaggtctcaagtattaagacttagacgtatttggtggaacggtattattctgtataccacagattcctttaccaatttaagaggccatacatttttcttctctgtatctttcacagtgcctagtgcagaataatatttgacctgaaggttttctaatgagataaataacagcaatccatgttccaaatgtgtgacctagttctctgaaaagcattttggttactatcaaccttcagcatcaccttttccatgcaatcattatgttttagtttttaaagcagtattgtggaggaagatttctagtgtttagttattggactcttaaaacctgcttctgcttcatttggcaggagctgtgcagtgaatatcgtcattatgtgaggaatggacgactcccctgtaccagagagaatgatcctattgagggtctagatgggaaaatccacggcaacacctgctccatgtgtgaagccttcttgtgagtgggcggcagccactgctgctactgagtgtgggagaagatcagcatcgggtgggcaagaggggtgacattggaagttttctccaggagatagataataaaggctgtctttgcactgagtttggaaatttactattataaagccatatattcagcccatttatttctggtgttcttcaatagtctgagaggtacttgaatcaccatcaagaaaggaccatgtgctaagagcaaaattacactggagttaatggcataaaaggattaggacttctgttctctgcaagcataggtcactgtcaaataatccaaaggtgtaatcattaggtgctaataaattgaaaatgagttaacatctaattgatatcttagtttatttctggggagaagaacaatatctttatttttcaaaagagatatagtcataaaagtttcttcactggtttgctatggcatgtgcgtcttattctttaaacaaccttaagaacaagaacggctgggtgtggtggctcatgcctgtaattctagcactttgggaggccgaggcgggcagatgacgaggtcaagagatcaagaccaccctggccaacatggtgaaaccccacctttactaaaaatataaaaattaactgggcatggtggtgcacgcatgtagtcccagctacttgggaggctgaggcaggagaattgcttgaacccaggagaaggaggtttcagtgagccaagatcgcgccactgcactccagcctggcaacagagtgagactccatctcaaaaaaaaaccaaaaaacaaacaaacaaaaggacaagaacaatgatgtagagagatgtgtgtttacctttccactccaaagctaagttggtggaggtatagaagtaatggaccatttttatgtagagacatttctcctttagggtagtatgtattgggtgctaggaatgattgttttgtcctcccttttcttatagccagcaagaagcaaaagaaaaagaaagagctgaacccagagcaaaagtcaaaagagaagctgaaaaggtagtaatcctgaatgtttatactgcaatgaaaggatgagattttgcagtatctctgtaaaaataactatggaattactgaaaccccagttgtgagggaactaggggttcatttagtccaggggttgagaaactttttcttaacagaacagatagcagatatttctgtttttgtggccatagaatctctgtcacaactactccacttggctgttgtgactgtaaaacagccctagactgtatacaaacatatgggcatggctgactccaatacaattttatttataaaaacaaacggctggccagatgttgctcacaggtcacagtttgcaaacccctgatttattctgttcccatatattaatattaagatttaaaattcagagaaaaagaagaacttgcatgtaaagttaatgggagtatgagtatcagtaccaatagcttcatatttcaaagttctggaacaatagaattcaatcctagacttcctgataccacagccagccttctttctagtacactatttgtttttggattaccacatttggtcaacacatgtgttccttgctttacctgtggttatattttggtgccagcatttaggaaaaagattaaaaagtagcatccccaaataatattttcttggattcaaaaaggctggctccaagtagtttattccaagttgtggtcatttccctgcccccatcaaagactattgagattaaaaataacctctaaagaagtatcgccctggaactctgtatgtttggcttgtttacagttgtattgcacagttgtaataattctaaatttaaaaataatagcagttcatatgaaaaatagattcactcttcaacatctacaagagaaaattcttcagtatgagctaatttctgatttcacattactactacagacaaactctcctctcattattttttcttttgctaaatataactagttaggggatctggcaatgaacctttaagcagagctaggagaaaaattccctctttcatcctcattgaatttcaacttgaactaaagaattcagaataaaatacaaaatcaattgtaattgccatttgtaattaactctttgaacttcagtgattgcttattctgtctcaatttctcacgtaaccctaaacaaggagtgtgcccagtcatcagagaactaagtttattgagagtcttgtgtatggttgcaggtttagtctggattttggggctatcaaggaaaaagaaatacagccaccttcttaagtcctttgtgtttaatataaattgaacactataactgccagaaaaaaaattctcaggtcattttctctctcttttttttttttctataaagcacttagtaggaacccagtaaactaatttcccagaagatactcaagctttctccttttcttttccttttaggagacatgcgatgaatttcggagacttttgcaaaatggaaaacttttctgcacaagagaaaatgatcctgtgcgtggcccagatggcaagacccatggcaacaagtgtgccatgtgtaaggcagtcttgtgagtgcacaaagaaaaccactactgtgggatggtggaattggggaagcaatgagccaggcaaataatatgtattgtgtttgtcctttccttacatgtaatagaaacagaaggttatctgtaaagcatttgaaataaatcttttctttataatggccaagattcacagttctagaaataaaataaatacaactaagctattacattctctgttagttctggggtagaccctgccagtagatcacacttccttgataaaattcttaagttatttgctatcaagtggatcctttctctggattatctcgcaactcatgttggaaagaaaacacacagattttaatgtcaaagtccttacctacattgttgaaaataacacattttcagaaaatgaaaagtaggtctttacacaaagtttggaagtacacctagaatatttaagtccttcaatagcatttaccaaacatctacaatgtacaatgtgtataatgtgtataatgattatacaaaggtgaatgaaatagataatcttctcagaaatcatatagtccactgatattagtcacagacgtaaggtaatataatacaaaggagggactgttgaatgaaaaatttgtctgtggtatgttacagtacttcaagaaagggataattaatagaaagttttatggtgggataaaactagaccttataatttggataaaatgtggacatgacagaaagtaatgagaggagaagaagggaacagcaagagtaaggatctaaaattaggaaaaaaacaagtcatttagtttagtcagaacttaccaactttatcaaccttgaatgcacaccagagatttcgaggtcaattctacatgtaatgggaagctgcaaaagttgttcagataggacagtaagtggcataaatattgttcctttaggaagattcatttgttagcagtaaacaggagaaaaagagaaagaaagtactaaacttaagaattgctactcatgtagagggaggagctgcaataaataacccaggaagaggcagctacgcagagcaaggaggtaggctagaaggcgagtggatcaaggtgggggatgctgtgaaggtgaagtcaatgtcatgtggtgacagctatgcaagctgaaggacagtaagcaattagagatgattccactgttttgtgtttgtttttttgtgaaaggtagaaaatccaggagaaagaatacatttggtagagaagataatgattttggggcctcttgaacattaggtattggcgataaacacagctggagatccccagtgaacatttatgaagtgttagttaattgctcaccttgtcttttttttttttttttcttatggagtcccactctgtcgtccacactgaagtgcagtggtgtgatctcagctcactgtaacttctgcctcctgggttcaagtgattctcctgccccagcctccctagtagctggggttacaggcatgtaccaccacgcctggctaattcttgtatttttagtagagacagtgttttgccatgttggccagactggtctcgaactcctgacctcagggatccactcacctcagccttccaaagtgctgagattacaggtgcaaaccaacacacccagctttactcaccttgtcttgtttatggtgatatatatgtggtgttcttttattttaatgagacccttcctggcaaaggactccatataatttatatttttatttttagagaaggcctgcagcatagtagatgttaactcaatgctcgataattctgtacatatgtgatttgttcatataatgagaaactcaaagaaatgcacaccactctctgtaatctattgttccctacctcccactttctaatttccagccagaaagaaaatgaggaaagaaagaggaaagaagaggaagatcagagaaatgctgcaggacatggttccagtggtggtggaggaggaaacactcaggtgagagcaacctctaatttcagtaactggggcgggctcaactccttgacaataggactgtgaatagcgtatatagtctatggtaaaggcagtgctaagtccttgagagaacagagaagtttctccttaaggttgcagggtaagatatcagcacattttcactgctctggggttcatttggatttctttacaccttgaaataattaacaatatgtaatgaccttatcccagtctcctgagccctctttatggtaatctagacctcatatcaataatcgttctcatcagtatcacatgctcttcattttctttcattattctttcttgccttggacagagccactttttttaggtgtcttttctgttgatccaaggcagcatgataggacaaaagagcacaggctttggagtcagattgggttatgattctgctcctactacctggacttgtgagacattgagtaaattacttcctctcactgaattctactttccctgatttagcagtactcttccagggataaaagaaaataatttaggcaaaggtttagcatgtttcttgaggcatttttaagtgtcagcatggcaatgttgcacataaggtcactccttgggtctctgaacacagtttcataaaattgcagtcgccttatttatctttttacaaccttggaatatcaaaaccatgtcttcacttccagatctgacaaaggcccaatatttacctttgataaactctggctattctgtttttttcccatcttttttgctttaggaggctgagttctcccttttaaggaatagccctgttgattagaattgtctgatagacattttgtgtgtcttgttcataacttggtcaaacctaccttccttgacattttgcataactttgggttttcctccagcatttttctctctcttctatctgcactagagacctgcacatttttttctgtataaggccagctaaatattttaagcaatgtgggctttgtgggtcatatgatgtctgctgcaactattttactctgccattgttgtgggaaagaagcaaaaaaataatatctgaataaatgagtgaggatgtgtttcagtaaaactttatgtgtaagaacaggaagcaggaaagatcttccctgtgggctatacaattgaaccttgaacaacatgggtttgaatttcccaggtccacttgtacttaattttttttcaaccaaacttagataaaaaatacaggatttgtgggatgtgaaacctgcatatatggagggctaactttttgtataggtgagttgtacagggccaactgacagacttcagtatacatggattttgatcctggaaccaatcccccaagtgtaccaaggggaaactgtagtttgctgacatttaatatatgctattaaattcagtcatatttataatttccttgtgtagatccttaaaagcaacattagtagccatgacaactcatctcttataattacaacatgggtgattctggtccccttttctctgcagatgccagacctagatgttaggggtttttttgtttgtttgtttgtttgagatggagtctcaccctgtcacccaggctggagtgcaatggagcaatcttggctcaccgcaacttctgcctcctgggttcaaacgattctcctgcctcagcctcccaagtagctgggattacaggcacccgccaccatgcccagctaatttttgtatttttagtagagacagtgtttcaccatgctgtccaggctggtcttgaactcctgacctcatgatccacccatcttggcctcccaaagtgctgggattacaggcatgagccaccgtacccggcaatgttatgtttcttataaagagaggtgaaagaacttctcttactcagactgttaaaacaatttactaagaatacagtagactaagtaatccaggggctcttcgttcttctctgttttcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattgtaagtatttctctcaacaggcatgtctaaaatatagtcacattcctcttgaatgaatggctatttctcatttgctatggctccttccatgcaaattattctttttgctaatttccaaatattctatttttttctcttgcgttctctaaggaacaatgagccttagcaagggcagctaaccaagtggctgatttctattgtattttctattacaattctgtgaactctaagtgctatcatgatagacccttgttctttattgtgccagaatcctaggaagactttgtcacggccatttggaatcattgaccagcacagttgaagaaagctgacttcttgtcatttgcacgggacacacttagtgcataatccagggtcaatatttgttaacaagatgaatattcacttttttctcctccagggaaagagaagcagagagaaaaaatgagtattctcgctccagatcaaatgggactggatcagaatcagggaaggtgagttattttttgggttttggcaagaatcgtctttctgtgagtcagcagttggcgatcaaaactatagaagaaggtgtcaacatgatcaagctagagcttgcccttagaaggtcaggagttaccaagttatcagtgactctcactgataacttgttcagtgaagaaacctaatgccaagtggacatctttaagtctgacactttacaaggcatttttataaattacagtttatttaattatttcaacagcctggtcaaatttggccttttaaccttatttcgtagatagggaaaatgaggttttgcaagtatactgggatttatttttgtttttgcattattttgctgctagtgtaagttactataagcagatgcgtaaaataacacacatttattatcttatatttctggattccataagttttaaatggtctgattgtgataaaaccaagatgttggtaatgccgcattcctttgtggaggctctaggtgaggatctgtttctttgctttctctaacttctagaagctacctgtattccttggcttgtggccacccttaagccagtgatggccagtcaagtccttcttatgctttatcattctcacactgactgtcctgccgctgcctctctctttaatgagtaagaacctttgtgattacatgggccccacttggataatccagggtaacttccccattttaaattcaactgattagcaatcttaattccatattcaaccataattcctccttgccacgtaaagcaacatatttggaggttccaggaattagaacatagacgtctctctctgtgggacattattttgcctatcacagcaaggttacatggctgcctgactcttggaaagaaatcctctgattctcaaatccaatcaaatattatgtaaaaacagcacttccaatataatcttcccatcttttcaggatacatgtgatgagtttagaagccaaatgaaaaatggaaaactcatctgcactcgagaaagtgaccctgtccggggtccagatggcaagacacatggcaataagtgtactatgtgtaaggaaaaactgtgagtatgtttcaaaatgagcttttgactgtgagtcttaaagtacaataatcatttcttaccagtttgggaaaatgacaattgttttagaagcagatctggtaattaatgaggcgtttgttcactttgattgaaatgtttcattgttttccccccagggaaagggaagcagctgaaaaaaaaaagaaagaggatgaagacaggagcaatacaggagaaaggagcaatacaggagaaaggagcaatgacaaagaggtaatagatgttagacacgctaatacctgaattcagttagttcattgtatggtatatttattcaacaaatatttgtgaaatgctgactctgtcccaatcattggtgatataacggtaaacaatgaagtcatggccagatcttgaaaataaatagcatgctcttcagttccccaggagtgactctgatgcaattgtagaaccagtgacaactgtcaaattattgtagttagccagtgaatttcatttttgaattttttctttcctttgagacagggtcttgctgttgctcaggatggtctcgaactcctgagctcaagcaatttgccggagctcaagtctcagcctcccaaagtgctgggattacatgagccatcgcactctgctgtttctgaattttttaaacaaataaatatcaagcaatcagatgccaaaaattacaaagaaaatcagtatcaaaaatttggagtttgaggccaggcacggtggctcaggcctataatcccagcactttgagaagctgaggcgggcagatcacgaggtcaggaaatcgagaccatcctggctagcacggtgaaaccccgtctctactaaaagtacaaaaaaattagccgggcacgatggcgggcgcctatagtcccagctacttaggaggctgaggcaggagaatggcgtgaacctgggaggcgagcttgcagtgagctgagatagcgccactgcacaccagcctgggcgacagagcaagactctgtctcaaaaaaaaaaaaaaaaaaaaaaaaggaaaagaaaaagaagaaaagttggagtttgagataataaattcttgatctggcatttcattgccacctagtgttcagttttggtccttataaatagtattcaacactacaacaccaacacgtagaatattacacagcacaatcttttaatgcaccgacggactccaattagaaaagataaatagcgaaatttccctgggaagatttttcctattagtagggcaacttttcattaagcctgtagtggctaaagaaaatgaaaccttattagtaattatcattatttaaaaatattttgggaatatctgttgtgtgttacggtagatgaaatggctttgagaaaataaccttattgcacaacttcacatgatctctaaaggacatctatttaaaatcttggtaaatttttaattttatgatccttatttaaaaaattttgaacagaaaaatgctatatatatttatatatagaaaatactgagtaaaaaaaaaataaagaaaatatggaggcagggtgtggtaactcactcttttaatcccagtgttttgggagaccagagcaagagaattgcttgagcccaggagttcaaaaccagcctgggcaacatagtgagaccctgtctctacaaaataataataattaaaaaaaaaatagccaggcatgatggtgcacacctgtaactctagctacttgggaggttaaggtgagaggatcacttgagcccatgaattcaaggcagcagtgagctatgatagcattattgcactccagcctgggcaacagagtaagaacttgtcttaaaaaaaaaataaaaatattgagattgtgtgtgagtgtgtgtgtgtgtgtgtgtgtgtcaaatagagaactaccgttttatctacacatgcaacgttaaataaggtttaccaataattatatttaaacctccccaaaatctattcagtggtgatattgttccaattttttagaattcaggaaaacttaagagaagtgaactacacataattaatgaatagaagagccaaagactgaattggagggttgcaatacagtcagaggagtgctattataaaaatatgtggtattgtgagcacctggaaaagaaaatacttccagtaatttgtgaaaatggtggttgtgagacatttaatatgttgataggtatttaattccagagaattttttaaaatgctgcaattaaaagtaaggcctggaattgtttgtttacggacatcacaatttaaagaaagaagggtaagtacaatctaggttactgtgttattttttaaggtaatgtttccatatcaccactttggctctttgggcttacaggaagttccagagacttctgtagctctctgaagattttagtacattctagatcctatctgtagactcggttctattggcttctttttatgatcattatgtttcaatgaacacaaaaggcagctccatatacttatccacacataggagttttattctctgacttgtaaaagcaaataagtaaaaaggtataacctggtggttagcaggtttctgatcacaaattcaacactgactttatttaatagctctgagatttatttttctcatctgtagaatggggatgatgcgtatttatcttataagatttttacaaccactaaaggaaatctattaaaccacacgataaagcacctcgcacaataatttttttttttttttttttggtaaattgtggttgagaaatgaagctgaaagtttacgtgtttttatgttttgccagaagagtgtcgtttagttcattccagggcttttgaagtagacttatgtgtggaatactgagtgcactcatagggagacaggtttggggctctgcctcatagaaaatggtattaaaatgagatgggacagggcactgggggctcatgcctgtaatctcagtgctttgggaggccaatgcgagaggatcacttgaggccaagagtttaagatcagcccaggcaacacagagagactcccgtctctacaaaaaattttaaaatattagccaggcatggtggcacatgcctgtagttctagctacttagcagactgaggtgggagtgttgcttgagcccaggagttggaggctgcaatgagctatgattgcaccactgcactccaggctggacaacagaacaagattatatatatataacaagattatattatatacataacaagattatatatatatatagatagatataatatattatatatatagatatatattatctatctatctatatatataatcttgttatatatatgtaatcttgttctgttgtccagcctggagtgcagtggtgcaatatatgtgtatatatatatatatatatatatatatataatcttgcttgcaatatatatatatatagtttttaaaggaatgggctgctttagtgaaattccattagggcaagacaatcatttgatagagatgcaatggagaagattcaaacttcttaggtagagattgaataaagtgcctttaaaacatatttcttctctgaaatttcacttctctgtttttttcctgtgttatgagtttatatctaatcggtcaatcatgttatcaggtttgaaagattataccatgacagtaacaactttttctgctactgttggtaggatctgtgtcgtgaatttcgaagcatgcagagaaatggaaagcttatctgcaccagagaaaataaccctgttcgaggcccatatggcaagatgcacatcaataaatgtgctatgtgtcagagcatcttgtacgtaaaaaggtttatcaataaatttgatagttgtgcctgtttgctagaaattagtttttgttacttttaaaacctaagatacttggcatcacacattaatgatatgatacctcctctcttttgaagagacaatttccaaagcactttcacaataatttttttattttgatgttgaaaagcataatcatacccagaacctctggggtaggaagaggtagcttatcagctaggtaacctgggacaggccagttcattgtgcagagcctcagttcctcctgagggaaaaatgactgaacaatatagttttgtggagattcaaggacattttaaaaatgtttatgaacttcaaagcattatacctacgtaaataacattcaaggacattttaaaaatgtttatgaacttcaaagcattatacctatgtaaataacaatcaatattgtgagtttggttataatttaattggaaaagtaaaaatgagaattatagcaactttctagatgagagtcttaagtctattatattaaggaaaaataaagaccttttaggatcatatttttctggataagagtatagtaacagcatctatgaaagttgatagcattgccacaaatatattatcatgaaaattccaacaatcagaactgattagcttataaaaatattcttagatttttttttaggtataagaaaacagtgttagatttgctaatgtttagaatcgcagaaatacttggttaaagacaattcagtaacaacccttgaaaaattaccctatctttttttttaattattctgcagtgatcgagaagctaatgaaagaaaaaagaaagatgaagagaaatcaagtagcaagccctcaaataatgcaaaggttatttattaaaggataccaaaataaccattttacttttcaccttcagaattttgcattcttctccagctttgggaataataaatatattaatatcttaacttcaaagaaaattgatttttcttgtcttgtcactttgtatcataacaagatttttgggggtttgggggtttgataccttttttgattttgtagaaaattctctgagagtgtgtgtctattattgttttagtctttcctccttgggagaaatatggattgaaaagtagagggtaacattctttaccaactcaactgcatgcttatctttgacactttaagtgtgaaacaaggctttgggtagcttgctgatgtttattttaataattcaggcaatataaaccaatctaagtctcccttttagcttcccttctgttttcaccagatgattctatcagcattaaagaatcagcagtgtgcatgcgtgatgctttcttttctatttatttttcaagactacaaagaagacatctttattcaattctttaacagtaacaatcacatttgtagagttagatccctgagcaattgtccttttgtcaaaagcatgcttcatggggaaaatggggaaaggaaggatggatgaacgggagaaaaaaacaggaaggtctatcaagtgttgttttatgtttccctacatttttcaggaccagtgcagacaggttcagaatgaagcggaggatgcaaaatttagacaacctgggcgttccttggcctctgttgccaggatgagtacagtgagtctgagcccagagctaagagaggacttcctaaaaccaagtttgaagaaatcactaagccaaaaagggacaaagccatgttcactttccctttctcattttctaggatgagtgcagtgaatttcgaaactatataaggaacaatgaactcatctgccctagagagaatgacccagtgcacggtgctgatggaaagttctatacaaacaagtgctacatgtgcagagctgtcttgtgagtaagaggattctgctccccctgtagctagcaggggaactgcatttttagaaactgctgcttgaataagtttgtatatttatgaaccccatgggattttaaaaataagtctttagaattaaagccctcaaattgagaacacctgatatagtagaaagaacactgagacttggagacaaaaattccgtatgtaagttctaaccaagatgtatactagctgtgtcattaaacaatttgttttcaactttcagcatcataattagaagaaattcttcaagatctttattccacaactagatcagactcaattgagatgcctttaaaaataaatacaaatttttacaccccaaaatatattatatcagaatcttggggctatggaatttgttttttagaaagagtttctaggttattctaaaaagcaaatagaaatggagaccaatggacattataaatgatgatgatgatgatgatgatgatggttgtaaagcacactgtgaacacaacaataatcaaatttctttagcttttcatagtgagtgttctttgagggggaattaccaaatactactcccattttatgttctagaaaatcaaaacttcagaacattaacccacttgtcatctgttaagtgatgaaagttctaaaccagctcctaattgtgtacttttcttaatatgtcatcctggtcactatctcaatgttctgtgattctgttttatttatttatttatttatttatttatttatttattgagacagagtctcactctgttgcccaggttggagtgcaatggtgcgatctcagttcactgcaacctctgcctcctgggttcaagagattctcctgcctcagcctttcgagtagctgggatgataggtgtgcaccaccatgcccagctaatttttgtatttttagtagagatggagtttcaccatgttggccaggctggtctccaactcctgacctcaggtgattcgccagcctgggccttccaaaatgctggggttacaggcgtgaactaccatgcctggcctctgtcacattttatgaggattgcttaacttctcactggaagttataggaactgtttcttattttaaattattttttattttcttctctagtctaacagaagctttggaaagggcaaagcttcaagaaaagccatcccatgttagagcttctcaagaggaagacagcccagactctttcagttctctggtaaggaggactatttctgaaaagctacttatcaatttaattttcttgattttttttgacctgttgctatttgctattttcatagaagggtctgaggtttgctgattcagtgcagcctgaagtcctttgaggactatatgcagtttatgcttggtgagagttctgggatttctcattagtgccttatcctgtgccctttgagattatttgccctgcttcaatttagtacattttgaaatttacaatgtgtgtgtggaataattgtgactaatttcacatatggtaaaatacatagtcaggtgcctcaattctgtaattttagcatacctcttggtattcttagcttcctcacctagcttccgcttatttccctcctccaaccaaatctgtttctacatcctggaactctatgccaagcatgctcacaggtataaatttccgccaattagcaattcgcagtagctaaagcttcttgtttaaaatataggctgagctgggtgcggtggctcatgactataaccccagcactgtgggaggccaagcgggcagatcccttggccccaggagtttgagaccactgtgggcaacatggtgaaactctgtctctagaaaacttacaaaaaaaaaaattagctgggcatggtgccttgtgcctgtagttccagctacttgggaggctgaggtggaaggatggcttgagcccaggtggtcgaggctaccatgagccgtgatagtgccactgcactccagcctgggtgacagaacaggaccccacccttctctcttcctctctctcgtagctgatggtcaccagtaatgtaagtattagtctacattagcatgataagatttactttgtagagccttcacaagatgaggagtagaaaggagcaaagaggatatgagaacatcaagcagattctcagattgggccctaaaaggaagattttagcacctaggctgatgacccagaaaaggagaaagaaaggtatcaaacatgaattttacttcattattcacccaattcaactagggtaatagatgagttacatacatgaaatatgcattaattacatatttctggtaaattgagctccacatcagggatccgaaggcatggagaagagctattaacaaaatatgtttttttttttaaatactaaagtataatagttacatagaagaaatgtacatatgcaagtaaatagctaaatgaaatatcacaaagtgatcatacctgtgatagcagcaagaaataagatatcatcagcagaccagtagccccctcattctccctcataagctacagtctgctttggagctatttcttttggagaaataaatctttcattattcatttttttcatcaagccggcagtccttttgtcagtctacaaatacttactgagcacctgctatttttccaggcattatttatttacttatttatttatttatttattttctgagagggagtcttgctctttcgcccaggccggagtgcagtggcgcgatctcggctcactgcaagctccgcctccgcagttcacgccattctcctgcctcagcctcccgagtagctgggactacaggtgcccgccaccacgctaattttttgtatttttagtagagacggggtttcactgtgttagccaggatggtctcgatctcctgacctcgtgatccgcccgcctcggcctcccaaagtgctgggattataggcgtgagccaccgcgcccggcctccaggcattatttacgtatgctaggttaatagccataaacaaaacagatagcgctcactacatgaagttcatagtatattggaaaagcagatacaataaataatatgaataaatgaaaaaataatgccaaggaggaaataaggcagaaaaaaatggtacagtaaattctgagatggggaggggaggggatacaattttaagtgacatatacagagaataactctctcagaaggtgacatttacatcaagacctaagggtattgattctgtaggtatatctgaggagaacatattccagagagaaaacatagcaaagcgtttagtgttgttgaaatagagctacctcagctgtagaagaggaagtcaggaagctaatgggaggccatgttataaagggttttgtagacaattttaaagactttgcctaatattctgaatgaaggttctgagaagactaatatgatttgatttatgttttaaaggaataactttgcctgatacctattgaaaacactgcagggaggcaagggctggacagctagttagctattgcagttgtctacagaagagatgatgctggtttataccatgttagtagtggtggagctcttgagaggtggtaagatactgggtctgttttgaaggtggagtcaacagaattttttgagttgatgtactatgttaaaaaaatgaagagagagagagagtaaggaacattgtagtaccttttgaacattatagcaccagttacctgaaaaaatacaattgatatacctggttgagtctaacctttgccagggtttcatataagttacttatctaaattctctgtgaatatttgtaccaatatggaactcaccacaatctaaagcaattcatttaggtgtttgaatcatttatcaaaacaaaggaacaagtacacaaatactgcttgactcctccaaaatgagtattagcagatataatactattaaattttctatgtcgtctttgtatctgttttcagtaagtagttttcaaggaatttattaatttcatctatgttgtcaaattttttggcatgtagttatttataacatttctaaattattcttttagtatctacagctcatatagtgatgacctgttatctctaatattggtaatatatgttttcttgactctggtcaattttgcaaatagcttatcaacttattcttttcaagcagctaacttttggctttgttctattttctatttcatcaatttctcctctttattacttattttaaaaaattttctatgctcatcattggctagctccttcagatgaaagtttagatcatccattttagaacctctttcttttctaatatatgtattaaagttataattttcccccaaattactgctttggctgctgggatttgataggttgtattttctttgtgattcatttcatttctaaattctatgattactttgagtcatgagttatttagaactcatccttttacttataaatatatttcttataaatattatatagttgattctttttgttcttccagttggataatttctgtcttttaactggagtacttacttcttaatattctatgtaattactgataccattggatttaagtcttccatcatcctatttgcttttgaatactttttttatattttggctctactttttgcctttttaaaaaactaatcaaggtcttggaattatcattaattattaaactcatacttccaaaacactacgaagagcaaatatgtttcttcttttacatggaaaatatacatatgttttttaccgtggaaaacatactaacaactaaaatttactgaacacttagtatgtgacagatactgcgttaagcatgaacttacatgcattatctgttttaatcccttcaagcagtaatataaagtaaggactactattatttatgattttctggtgagaaaattaaggctgagaaaagttagataagttacttctctagttagtggtagagctaggactcaaaaactcatgcaatttatgagtatttacctctgagtctttcctttctaggctgtatataaccaataccttcacttaaaaaggcgaatattatttctggcatgcctatcattctagatttcttcttatgggcaggtaattgtgtcacatattataaaggatatttgctttcttattgctttgctactccttgtttctttgtttacttaccttgtcaagttaaaaattgccaaatacaggaagttaaatccacctcatatggtgcaaaatcaatctttgagtttgaataacatatatcacactccttttacaaccatttattcaagttggattaaggaactcaagaggttttcttaagcccacccctcttcttgaatgccataaagtacgtctgctttattttttgcttcttcaggattctgagatgtgcaaagactaccgagtattgcccaggataggttatctttgtccaaaggatttaaagcctgtctgtggtgacgatggccaaacctacaacaatccttgcatgctctgtcatgaaaacctgtaagtattcaagttgccccatcatatcttccagtttagaatttctcagctagagtgttaacccatagtaatgcactgatataaattcgaaatgtgttgcaagtaatttattcatcatagaagttaaaaattcaaaatttgtgaattatctttcttatatgtaaaatagaaaagatttaaggctattcctttggtaaattgcttacctacattgttatatgctctactgagaagaagagaaagaaaaaaaatagtggagttacaattgcagaatattggtataatcctgtgtacagtcatgggagtgtgaacatcattcattctgtgtgtagtggagaaaaacagtagagaactactgctatataacccagcccagtgtattatatctaaaaggtcctgtgactataatatagctacatattccccatttctttaaccctgcctcttgaaagaagtagtaccttgcaaaaggaaagtgcactgtacaaaagaaagcccaataaataaatagctgatctgatgtctgctctcatatttatgactatctgggtatctggaggcatattatttcatgattctgaatctcactcccttcattggagaaatggagacagttctctgagctgctgacttcacagatgattgaaaagaactgctagatatgaaaatatttttatcttaagttaaatacaagggattcattttaatactcttattattggctttagttttgttgttgctactctgctcaaatgctgtctgaattttaaaataatttttaaataatttccccttgtctctatatgcatcccttcccttctcctggccaccatttggccagctttcaaggagagaatggtgacaaaccttggttttcccatctcacctgaccccagacctacattgtagtactactttatccttcttaggacactataagcaaggcccagaacatgaggataggactccctgatatcctgctttttaatcctggaaaaatatttaaaagaattcatcttttaggtaaggtatggtagatataggtaaggtatggtaggtatggtatggtaggtatacttcatctataggtaaggtatggtagataaggcactttcagatttcagtcactgaatccctgcaacctgctatggaatgttattatctttattgttcagaaggttaatctgaggctcagagagtccaggtaatttgtttaaagttacaaagctagggagtaaatcagacaggattttgaccttattgatttggatctaaatacagttttcttttttctccactaaactactgttatttctaagacagtagttccttaaattgtcaaagaccaaagattccttagataatatgaagaaagttactcctttcaagaaaatttaaaaaaatgtgatatgaacaatccacacacataatattcataggctcgtggagtacttgaaattcatctgtagaccttataggtttttaagaattaagaaattcccgtttaaggaataaatataactgtccaggaattccattactatatataccttatctccagcccagaaatcctttaattcctctttcttataaatgtcagggcctaaattatccatataattttcttcaacattttcatcaactttatagacccataacaagtgatctttttaagggaaatttagcataagaaactgaaatgatgaaaatattaagaaagcatacctcaggatagtttgtttagctaagggagctgggagtagatattataaagaaggatcaggttatctgaggcaaaaggaaacaatattcatttctaaggttttagagaaagttatatgagagcaatttcaatttaagcaatgctaaaagacaaattgcactgccttgatagataatgagtttcccattaccagaggcaaacaagtacatgtctgattcataatatttctccagtgagaggcattaaaattcgtactccttaagattcattccaactacaaaactcagactgtatcatttgtgtcttgttatatttttccccaggtcgtattattggtactcaatatagtcaaacatctctctgggatctgattctcgcatctataaatgcgagatcacctttagaccagatgatctccaagtttatttccaacattctctatgaatatatcagtgaatgaaatgtgacaggataggtccagggctaggggatgaatctggagcagaagagagacagcctggatgatacctactgaaaatgaaagtagttgaatgcagatcccagatcctccctctaaatacagtttggtttgatacccaagtgtcctgcatgttggtccttatttattttcttattataactgagaacttcctcgttgttgaagcatcctctgatctgttttaggatacgccaaacaaatacacacatccgcagtacagggaagtgtgaggagagcagcaccccaggaaccaccgcagccagcatgcccccgtctgtaagtacataagtagactggcctccatggttacgttgtgaggagcactgggttctggttttgttctcttccactgagtaatggacatttatctggccagagaggtgacactaggtcaggtgacccagaattggtcacattttcactataaggataattaagtaattactgaaataagtggaaataatgtagcagttaatattttaaaatatttaatgggtccattaatagattgtttatgagcaatgtctccaacataacgttacttatttcaggataggttttgttttctgtgatctataataaaaagatgagacagagaccaagagaggtcagagagtgacagagttggatttaaacaatttctatataatgcccatattcttgaactttacattgtattaaattatttcccagcattaaaagttgaccaatttcatttaaactcctgaaaggatgtttcaacgtacgttactgaatttaacattctccctggtggctatttgaatagtcatcctcagggagatggtatgtaacatgaaaaaataggaattttcaaataagagaaaaatgttttgttatgggataaatgtgagtgcaaatttcagtttttgctgtgcttatacgagactcttggcaaatcacataaatactctaaaccaaatatcccaatgacctatgaaaatattcaataaatactgacttttatgcatttggcacagtgtctgaaaaattaatgtcactattattattatgcctaagaccaaagtatgaatttagaaaaagagtcgaaagtatgaactttttctaacagaccatggtatagtgcttatttatttttaataaattattgtcaattgtagtttgataaaattatgtgtaataaacaatattttaatgcattatatttaataaagctatttattattattcacattctctttgctccattccactgccacaaaaagctttggcaataatggaatcagaaactattcagccagatttgaaaatcttagtcaagcaatactagataaggccatattaaaaacgtctgcccaacaatctttgttaagggaaattgtgaaaacaagaatcataagctagagtcttcctagtttcacattagcagctgaaagcaatgtagaggaagccgaggactggaatgaaatcagaagaccttatctttctcatgtgggcttgacaaagttatttaccacccatttaaagacctctactctggttctttaccaggatccataaaaagggagtttaaactttaactctagtccctatattgtgtttgctgtcttattatatagaaattcttagtagttggctcccattttattgacagaatatactgttccccgtcctcacaaactcacctttacatatatctcaggagagaaaggtcaaaatagctttatgccagtccaatagaccacaccttagaccacacttccctgtaactctcatcctgtgtaggcaacttggaaaaactactttataaagaacttgccataggtttatactgataagatgtatttctttaaataatgaagaatgttgccggggcttatcacacagggtgttgtaaaagagtgccgttcttccatttctgagtgtatgctttccactggagttgcatagcaggcattaataatgacagaaattattatgctgttagttaatgaaacaaaaattaacgtgtcctggacacaggtggaacttcagtccctgtgtaagattcaagtgtgtgatctcgggtacagttggtacagactggtcatggcctagcattgttctgatgactagtaaggatgtatatattggggtggaagcctgttgtttgaactttatttctgggtggaagtttctctaagaaagtctggaatctcaagaatagaataagagtccaggcagtcacaagtttcttggaaaagtaggttgagtatcttggaacccactcttttgttactaagtacataatactttctattatgcaataactattatacagtaactactaagatttacataggtctttagagttttatgtacattttctgtttgtactcttacaatagtcatttgattagggcagggatcactgtctttcccattttacagaaaatcatcctgggggaaactgtcacttattaaagtcccttagtataatatcttgggttcaatgtagatatcctgacttcaattccagtgctctactaccattccttagttgtcaggagattctgaaaactaagtgctgttgagaaggcattatctcaattaaaagatgatttgctatattggaaggaaatttctatattaagaaaaatacaaatattattttgtgagataaatgactattcttatctatatctgtcaatttcatgacagattttcaaggattcaggaaaaccgaagcttgctactttcaaaccaaagaaaacctcctggagttgatataggcaatgaagtggagatttgagtttggaatgacagtgctgctcgtgccccaggtggtactagttgaagatgtgcagttatgtgaaagaaaacttcctgaggccctcgccccctttaagattatttttaaatattcatttaatgttttaaaggctgatttcaaatatatggatgagtcaggcaaaggaagacagctgattacattctagtggtctacaacaaactatagtagaaaaacattcgtattacaggaagtgaattcaagttatgacgtaacatgacagtggcaagttactaaacttctctgaagctcaatttcctcatctgcaaaatggtgctaatgacacctacttcttttttatcagcatgaaggctgcatgtaatcaaaggcagaattaagccatgttcatatttgtgtccacctcaacacgtagtacatactaggtgctcaatatttgttgtatcaaactggataaaatgtgaaagtgattttaaattgctacttctttgcagaatgcaggatctatggatttctttgattaagatgcagctataaatatacagcccacatttctgcaatatctctgggttctagcatctaacctacccatcttctcttctaggacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacaccctttctgggatttctttgtcactatctggataatagatatttgcttttaaagaaactgaataaactctacccttt

SEQ ID NO: 2039 - DNA, 73391 bp, Homo sapiens; identical to SEQ ID NO: 2038
  source 1..73391: mol_type = genomic DNA

SEQ ID NO: 2040 - DNA, 60969 bp, Homo sapiens
  source 1..60969: mol_type = genomic DNA
ccgagttcagtcatactgcaccagctgagcaatgcatggagtggacctgtaggcgacttgcatcgtcttcaacatgaagatagccacagtgtcagtgcttctgcccttggctctttgcctcatacaaggtgagcaatttgtgtgtaatctaagcctcttgccacacatctcaaagccctggggaagggacttttctccccctactcctgccaaaaaatgtttacgtatgcatgtataatcctgaaatgtcttgccagacacagagttctgaagatttatatatgtggctttataattatgttgttatctttagaaatggcaagtagtttgagataatctgaattttctaaccatgagaaattcttccattaattctttattaattcagaaaactgaatagattcttcttcatcttcctcttgctaaatgtatcaattcataatgcatattcttatatatgtaatagacatttaaaacttaattgtaaataatatatgtattttaatgttataggtataaatgaaatattttttaaaattcaatcatctgttcttattttaaagcagtggtatcttctagcttattttagtcttgtgttttcaaatgctaaatgggttgaaagcatttctcccaaagagtgagggacttttgtgggagctggaaggtagatttttatatttgctatttaaccctaagagaacacaaattgcctagacttacgttgctctgaaacattaaaatttttaaaaagagaaactcatagatagtctgaaatcatatacaaataatgcccattttcctaaaataggtgtgtaggtacaaaagagcctatgttaatgagagagtataatagcctgtgaccttaatcttaccttctgtcagatctctaacttttgcagctgtaataaggaggtagagctgccagaattcagaaaattaaattttatgtatatatcctataaatgtaatgctatattatagtttcaactataatatagtttcaaaattataattggtatagtattttgtgtgtatgttatattgtaattttaaaagggaggctggcatttattactccgaaaggaccttttgaagataagctattttgatggggttagaattcacatgagtattattttccaaagtaattgtaactttctgagtgattagacctttgtgagtatatatactaatctcctggtccagtgcccttcttttatttgccatgataaatcttaatgtgttcaaaaaccatttgcggttttacaacatattgtcattaaagcaatcaagatgctgcattaaatggattatttgttttgtttattaaatattttacatttccttaactttggtttctatattttcatcccagatgctgccagtaagaatgaagatcaggttagtcctgctttttctgttcattgaattcattccaagattcccaaagaaaagtggtttgtggccaacaccttcatgttaataatacaaacatattatactggtaggtactaatagcttttgttaaaaacacagaaacagatttttatgaatcaggacatgagcctctctctcacacacacacacacacacacacacactcaacatattaatgatgatggatgtctgcaagaggcaatttatcatgttaaaggagcattttaaaatttcataaacaaaaaataaatcaactggaaaactactattgttccatttaacatctcaacaagccatgatacaccacataggaagctgaaataaattttctagtaatcattatgcaaaagagggtggtctgtatcttgtatatagtcggtgtatatagttcatgtaatgaatatttattgagcatctcttagatgtcagaccctgtttgagatgctggggttatttttaagtaaacaaaatagatgaaattcctgccctgaaaattacgttttagtgtaggaaaacagacaaattaataagtagcttagcaaaacatatggtacgttaaataatgataaatgctaggagaaaaataaatcaggaggcataataggatccctgagaatggaggtggtatccattctcataaggataatcagggaagttctctctggacagacagtattagaataggaatctgaaggtcataagggaatgaaccacgaaggtatttgcagtttacagcaggccagacagaagcacctgtgagcgcagaggccctgacgcaagaaggtgctttaccaactcttaaacctcttttgtttgataaattaaaaaatcattttctactagaagttaaattttttaatctatttgaaagataggatgaccaattactcacacacacacattttatatatttatatacacacacactgctatgcatgctattaattcagcacttaaagcacaatcttaaatgttttgctgaatatgtggcaaaatttgttttatctctggccacgaacattaaaggaataaaaatgtgaaacagctattctttacgttgaaactctgagaaccatggttaaaatactctcttgccgtattttgttgcaatgattttttttaaagaaacttcttacatgagtgttctagagaattttatcatgttctctactatttcatctaagtttactgatagggagaggtccagaaagttcagtagagtagaaaataagctagacatttgggaatcagagagcatgctcacttggaagttttatactgggaaaaaagaaggatattatataaatatcattgtgtataaaaccatcattttctttttcagagtccgtgatgatggttggtgatttatggcagatactgtgaattttacactgctatttttcatagcattaacctctatttcactgaaaaatattttaaaaacaaatttagtgacttcttatatttggtattaaaggcaagaacacaaagaagtaattatttatttggaagcctttctaatcagagtttttggatactgtgtcagaaatgaaaactattgatgtagtcttttttacgatgctgtgattttggttattttccaagtttagtagcttgggttcctttcagcatgataaaagcatgttaaatgtcataaacatgaacctaaacagcagggaaaagcactgcagcaatctgcaaggatcttaagcatgcttaaatttgtcatcacctaagagtcattcttcaggcaaaagcaagctggtcagtgctctaacactgagatagggcaatggcagctcctggagggttttattataatatctggagatggacaatagaagacaacaaattaggcctcagccagtgagggaaacaggaagaacttggccctagagggctccagttttcctgggacatgctgagaaaaagagaataacagcaacagtaacaaaacaaaacaaaaacaggccagggactggaagttaccctgcaagtaaacaggtgctgaaaagtcatctactcaactcaggatgacttttggtctaaatatgcttctgtttcaaccctctctattatggtcattgaaagggtattccattttgctcagagaaaaactcaactgctgctttccatttttatggtcttttcctgtttcccaagagaatacattggataatttcataactcagaaaaatagcattgaatctcatcttaactaattaatcactgtgaacaaatttcttaacctattatttgggcctctgatgctcagtttgtaagaaagggagtctttctaggaattaagttctcatctaacagtgatattggagaagtccaatttagggattattcttattgatgcaactctttaatttttcttataagtagagacaaggtctcattatatttcccaggaggatcttgaacttctggcttcaagcaatcctcctccctttgcatccaaaattgctgagttacagccatgagccactgcacctggcctgatgctactcttttatgataagctttcaaaattatttagagctttattccaggattatcatgagtcgtctatatactttctataagacttacttaataagggatatattttcattacaaagaccccaggctcttctctgattctactatatggattttaggatcaattatattcatcaaggtaagcataacttgcaaagttggcatttgatactgtagaatcagagatcagacaggtctcaagatgcccagttattaatctgtgtccagaaattactactctgctactctgatggagtcactgtgtagctataataatcttagagatatttaagcatgccatccttagctaaatttcccagggctggtctgtgatatcgtttagttattctccttcaccattaatcattttgcaagtgctaccaactgcctaccatttttaagaggctagattaagtacatcattattcatccaggcaagtatacttctgttctacctaatgctgtatctatgtcacctagcaaagtatagtaatccaataataagtgattgctggctcattcaatgatgatcataaagatataggagactactggagttcaagaccagcctgggcgatgtagtgagaccctgcctctccaaaaaaaaaaaaaaaaaaaaaaaaaaagaaagaaagaaagaaagaaaaaacaagcacaaaacaccagatatagatataggagcctaaatagaaacctttaataaattttttggaacaggttgtgtttgtcagagttgaagcaaaagctttgtttatttgtttcctgatacaagcaacttgaagcagattaaaaaaaatcaaaacaaaaaacaacaaaaatccccttagattccaaaggcctattctaaagacctagtgaattttcactgggtacagtggctcatgcttgtaattccagcactttgggaggctgaggcaggtgtatcatttgaggtcaggagttcgagatcagcctgcccaacatggtgaaatcccatctctgctaaaaatacaaaaattacctagatgtggtagcatgcacctgtaatcccagctactcagggggctcaggcaggacaacctcttgaacctgggaggtagaggttgcagtgagccaagatcatgccactgcactccagcctgggcgatagagcaagactccatctaaagataaataaatacctagtgaattttctaaattaaaagggaatataacattttaaaatcatactttactaggtagcagaaatgcaccatattttaagctcctaaaaaagaatgagtgatgtatagcaggactttaataataatatttaatattatttattaatatttaatattgaatgaatcaaagaattaccacttttgaagatcattctactttccttttccccaccaattctattatttaaaatgtttcccctgtcctccttaaactttgtataacggagttattggtatttacaaaaccaaaagcccaaaacaaacatagtaggattttagttccaagggatgtgccaaaaaaaaaattaccagagagagagagaaagagagagaaagagagagaaagccttatgcaattattgagaaatttcctcagtacttccatagattcacaaggtttgattctgatggtagtgatagtagtgctgatgacatttgtggggatggtggtgggggtggaagtatgggtactttctaaaaaatataatacaaatttgaaaatgcaaaatggttaggcctctcccagaacctcggaagggggatgtgacagtgaagggccctgaatcttaagctttattagctttaaggtaagtctgcctgtgctcataagtcaaatgatttatcaagggacatgaagttcttttcagaaaataaaccagtctagaaacttgttttccagataaatataaccaagaaatccttttttcatttaacactgttaaaatttctaggaactgatatgttgcagtacagccatggggaaatgtaggcagacattttataatgttcaatgctcaaacaccttgcctcagtccttcagcaacattttcatattcctttcacagcaattactattggcctactgtgtactaggtattttatatgtgtcatcttagcatattccagtaataatactgacaatcaccagcaacatcaaaacaataataataaaaaaggaggaagaaggaaggaggataatttattaattgaatatctactatgtatcaggcattctttgagggctttacatacttaatcttcaaaaaaccttggaattgtgtgtgtatatatatgcagacatatacatatatctacatatatatatcaaaataaagcttgttttgatgtacttttagctaacacaacttttttggcattatcttaggaaatgtgccatgaatttcaggcatttatgaaaaatggaaaactgttctgtccccaggataagaaattttttcaaagtcttgatggaataatgttcatcaataaatgtgccacgtgcaaaatgatactgtgagtaaaggtttctttctttctttccaatgtttgagttaacagctagtctctgaactggtaaatgtattctttttctttcaagtgcatttttctaaaccgaaatggttaaataaaagtgctgagcagatcactctgacatttcccatcagataaagttggataattaccacccacctggaaagattttaataatcactcaaacaagattctgaaagcattccagagggcccagtgtcaataccttctgtagcactctatagtcttttgaggatgtagttccactttgaacttcctggttttggaaaaaaatgaatttgacaaagaaagtcagattccttgggcctgttaagacctgattctgttgcagcctagggactgagaagattggcttaagcataatgccagactctcccgtgacagccaaccagcagaaggacttaagcaaggtataccctgattctgtgagctgccagtgtctttagacacctagcattattctaggatgagatgaactaaagggtagattatagtttccaactccttgcagctcagaaagaattagtatcctggaagtttaccaatctctattcaatgcttcttaacttggtttccttctctccattgtcaccccaaaggtaaaagaaggcttgggttatcaattgcaaatcctcaaaccagaatgtcctaatttgtttttgaaaaggaaggttagcctcaatttctgaccactgtcaaaacttcaacagtggtagcaagccaatactgagcttacccacttaggataattatattacaattggctttttaaatgtcaggttggtgtgtgtcacaggatttaatttggggattgacgtagtcaatcatattgggataatgaagctcagatcgtttgatcatgcactgcttctagtgaagagactgtgagactataaagaagccaggacaagatttaatagaggatgggaggcctagggcaggttgaataattctttctttttttgaaagctgaatgtaaaccagcaggtatattatttattataaaattttcttcttgtttcataagatgttttaatatgagactgaaagtatgaatataataaatttactgaaaaataatgtaaaacaaaaatgaaatgccttaagagtctaaagacagtttatcattttgaagttattcaattattatttttatgacttacgtaaattatgttagaataaaatttttttttttacctggaaagaaggaggctgtgcaaagcataaaagctgtcatcagattcctaaagaactggcttatggaaaagaaaattgatttgctctgtgggtccctagatgttggaattagaaccaatataagcaggttcaatgtgaatattctctttcaaaaactgcattcaaaaaatggtgcagatagctttgagagttggtgaccacctggctgttggaagtattccaggaaggtagtctgttatgcagttaaagttagagattcttcctataataccatgttcgagatatttttcaatgttgaagggagatctggggttctgtgtccacttctgaacatgctaccaattttgacatgccaggctaggctgaggagagcagttaaaattaagtttaccatgttagctgttattgttaaaagttgagcaaacaatgtttaaactatgctatttcttgtccttttccagggaaaaagaagcaaaatcacagaagagggccaggcatttagcaagagctcccaaggctactgccccaacagaggtgagactatttggagccaacctgtttacttttgagaggatgtttgactctatttagagctatctgtttattccttaattactaggtcatacctgttttgaagccaacaacttaggagggagggaacatgggttagtccaggggtgggctaaatatctggtacatcttgtccataggcccaacccatgatccgactctaaaaacattttaggcactgacggaaactaagaggtggagtgagccagtgtgatgtctgccttccaaggccatcatttctcattcctcttgtcctgtcttagcccaaagaagagctttcctgggactgtagaactaagttcaaatcttagaattcttattgcttgtgtaacttagaaaatttatgtatctctggatctcaatgttttcatctgtaaaatgagttttagaccgaatagaaactaagttttaaaagccggtctcagggtttaacatgttctagcaggcatttgactcattctgtttcctttttcttttactcttttgctttttactgtatatgttccagtacctggagggtcctcctaattcaactatagttgcttgtttatatctattttgcagacagggactcaggctaatattttgtttaagaaaagtgttctctggtaaaaaaaaaaaaaggtcataaaacattaagaagtaagatagaaggaaggaaagaaactgcaaatttatcctactatataaaccatttcacttgataatttttttcacttagaaacatttttaaaatctttacaaaattataaaaataaaatttaaaaaataaaaatttggggtccagattggtggaaatatatatctagcctacaatatctcacaaatgggttactgacaaagctgggactaccaccagctattctaaccactactcacatcaccccaggtctcctatgcagtttcttcactaatttccactttcttttccttctctgctggccccaacacgtaattaaaataatcagtcaaggttagtacaccttaattacttataacatccatggtctaacaacgctgacatcttccttggcagtgttagccaagaacatctgagaacctcagcctccacagtaaacatagtctactaaattatttgcctgggctcaaccagtctcacttttaaaacaataacagacaccacaaaattgatccataattgaaaactctttatctgtagcaaaagagagctacttttatattctacaaaatctgtgggggccagaaaggtttagtggcaactttatatgtgtcttatttgtcacattcaaagagtggctcactttctaacatccattctcctcttcctcctctgtcttcatcataaaaaaatgatatatctatagtgtttaaaaatataaaatatgaggaaatgacaaaaaagcaaaatacacacaaacataccaattttaacaaacctatctaaaaaatatagctagttagatgtttccatatgtagacacaaatttattgaagtttaataaagtaggagttttaaaaaataaaattacagtcttaagaaataaaattactttttgttaatatattatgcctgagtcacacacacacacacacacacacacacacacacacacacacacacacaaaactgtaaaaaaaaaaaaaaccctctagataaaactcttaatagcgatgtggttcactacttaggaaactacttacataaccaagtagtaacttacattaagttaaggcagttaacatttggctgtgtgcctttcaaataagttctgtctaaatttttccttgtctctgtatttaaaaggattcatccaattataccatgtgttttttgttgttgttgtttttctctccactataaaacagaacaatgtgctgattttttctgcttagactccgcccatcagaaatcaaccctgctactccctctcagaataaggtgctctgcatttcaaggagtttcctcctacagacatcctctcactctctctttcatcactaattttcttttcactagtatgtcatcctttcatttcccgactctagtattccctccattaacaagtcttgttggtactgcctccaaagtctaactccttttctccatttccatccctaccatctcaatccagtcatccataatttctgatctctggtgttttggtacatgtaaagacttgtttttttaattgatgaattcattcattcaatgtttatcatgatttaggttgccaactttatagaatattaagttcacacgagtctgtgtgtttctgaggtccctcttttttcagattcatttattgctttaataactagtatggtaagtcccccttcttagttcatgttgttaaaggttgatgggacctatgcatagatatatggtttccatatacatgttagagataaaaataactgagtttataaaaacttcatcttgaatttggtaacccagtgtgtttatggatacaaagaatttgtaaattaattggggtaaaattgactttttacagtattaattttctaaactcatgagcatagaatagtttatgaataagtcatataattttgatctactttataaaatttacaaaatattcagatttttataatttttgttaatatttttaaaatgtgtaaatttattactattttgaatatattttgttttttattgtgttttatctgtttattgttgatatagacaaattctattgatttcttcaggttaatcttatgtcagacaacttttgtttttgttcttggtagttgatcatattacctacatataacaagagttttataatattcctttcaatcttagcacatctttctttcttttcttatataattggtaaaggatccagacttcaatagttaaacactagtgatggtaatgaacatcaaataatccccttgtctcttcatattaaagggaatacctctaaagtttctccattgaatgtaatatttatcatagcggtttttacctctacacttcagcaagtttggaaaattcctttctatttttagtttgctgaatatgtgttgcttattattaaaagtcttctttgcaactattaaaataatttgattttttagtctattaatataaataaatttctggatatatttcttaatattaaactattattattttcttagagtaaatcatactttataatatattttaaataaatttatgaatttggatactaatatcttaattagaaaatttgcaattatgttcttaagtaaggtgaatctccacttttatcttttaaataattcttatctggcttgggaatttacataaaattatcctaaggtgtgacactttagactctgactaaatcaggtggtcagcagatcctctcctcagaaagcaactataaagctagacaaaattgaccaaaaaccattttagcaatctgaaaattgatcagcagtctataccaatctgagaagcatttatcttgaaaaactgctgactttaggaataaaacgagaggtctgtgatgttcttgctcagggatattcccatttcatcccctggcttggttggcatggaggttctatacagggtacaaaggtcagcaaaggcattgccattgttgaagaaggctaacctaatttggagtaacgagcaaaagtcatacccagaggtgttttcagtgtaagtgataatcttcaccaagggtaaggaaaatggtctgaggttgcagtcataattgaagcaagtgtattcctggctgagccttcacacgtagttgaaagagcccaaagagggtcaagagattcgcaaactcctaactgactataaagctgcgcatatccgcttaataaacacaaaatgtcccagtgagaagcaaatgctggagtagatgcaaaagtggcctgaactttgcatgccctcccctgtacacaaaggtctatctgagagggtgaaagcattgttagcttgaagtatttgaacacaaactgtgttaaatccttagctgaccattaaactacaaaaacataggggaaaaacataggaagccaggcttaaaaaataaccatgatagaaactatcattttcttagctgcacatcagcagctgcaattatgagagaggaagatttcaaagatttaatccagccacagaagcaaaaaaagaataaaaaagcagtgaaaataatctttaaagaaaaaattgtaaacctgagtacctatattatctaaaatgttgtttttataatcaaaatgttcagtttttataatccacgttagtgaggttaaaaaaatgtcagttttcaccaaaagttataaaattttcaaagtaacaagaatatacaacccatactcaagaaaaataattaatggagtttgtctttaactgtgtacagatgttagatgtggcagacaaagacttgaagcaactattaaaaatgtattcaggatactaaaaaaaatcatgtttgagggttcacaagaaagtataataacaatgaataagccgataaaaactttcaatgaaaagacagaataatttttaaaaagacccaatgaaaattctggagttgaagggcacaataactgaaatgaaaagttcagtagagaggctcagaagcagatttgtgaatccttaaaaaagggaattaccaaacttgaggaaagcttaataaaaactaacaatggaaatacagagacagacaatagagaagaaaaatgaacaaaattatacactttttgagacagcagcaagaaagccaacatatgcataatgggaataccacaaatagaggtgagagaaaaaggaatacaaaaattatttgaagaaacaatggcctaagatgccttaaatttgatggaaaaaaattaattttaacatttaagaaactcaatacaccccaaataggataaatatgaagagatccacatatggctcatcatgattaaaatgttgaaataaaaaaaaaaaacaaagagaaaatttagaaagtggcaagagaaaaatgacacatcctatatacaggctgtatacaattaaaagctggcccctcatctaaaataatgaaggccggaaggcagtaaaatgacatgttcagaatgctgaaagaaaaaaaagattaagcaatattctatattctcaaaagctatcctacaaaaattaaaacaaaataaagatattactgtactaaagaaatctgagagactttgttgttaacacaactaccttaaaaataataatgaaggaggtcatttagctgaaaggaaataactaccagatggtagcttggacctacagacagaaatgaaaagcaccagaaatagtgaaaattgagttaatctcttagcctttttaaaagaaataatcttaatatataaggcaacaattataatgctgttttatcaggtatatatatatatatatatatatgacaacaatagcataaagggtgatagagaaaataaagctttattaaggcaaagtttctctattttaccaggattaagtattattctgaagtggtttgtaataaattaaggtgcatattgtaattactagagtagctactaagaaaatagcatatataataaatatataacatcaacaaaggaattataaaggtgtactagaaatatttaacccaaaacaagatggtagtagaacagagaagcaaaaaaagacaaaagcatattgaaaacaaatagaaaagtagaaatgtaaatacaaccataaaagtgattatattaaacataaatggtttaaacatcccaatcaaaatgcagaaattgtcaaatgataacaaaggaactataagctatctccagtaggtgctccttagattcaaagacacaaatagttgaaatgataacagatcggtaccatgctaagtttaaccgtaagagagcaggattggctatattaatatgtgataaaatagacattaagacattattagagacaaatagggatattttgtaactttaaaagtgtcaatacgttaagcaatataacaatgataaatgtatacacacctaatagaggctccaaatttatataacaaaaaatgctataattaaaagaaatgaaaagaaatgaagaattcaaaaataatcgttaggaatttcaatactccacttaaaatactgatagaacagctagactaaatatgaccaaatagaatacttgaagaatactatcaactaattcaacctaaactgaaatatagacagtgcttctccgttgattgtagaatatgtattattttaaagcaacagaggaacattttcaggatacactatatactaaggtacaaacataataaattttaatatattaaaatcatatatagtatttttttttaaccacaacagagttgaattcaaacccagcaaggaaaatgaatcgtgaaaatccccaaatctttagaaattaggcaacacacttctggataattggtgggttaaagaaacaatcttgagagaaattggaaaataatttgaattgaatgaaaacaaaaagacaacaatttaagacttactggacttgtctaaagcactttctagagatttaaatggcttaatcagaaataagagataggattcaataatttaatcctctaccttgagaatattagaaaacaaagtttagcaaactaaacccaaagcaagcagaagaagaaacatataaggattggagcagaaattagtaaaacacaaaacatacaaataatagaaaaaattaataaaaccaatgttggttctttgaaaagatcaacaaacctgacaaacccttagttttattttcccttcaagaaaagaacagaagacaaacattaccaaaatcaagagtgaaataggagacatcagtatgtgccctggagaaactacaaggcttatgatgaatattatgaaaaatattatgccaccacattaaataacttagatgaaatagaaaaattcctagaaataaccaaattattgaaaattgacccaagaagaaatggaaaatcataatagacttacagcataagtaaagacattgaatcagtaattaaatttaaaaaaatgcccaagagcagatgactttattggcaatttccattatatactgaaaggagaaataatatgaattctttacagattcattcaggaagaagagacactttacagctcattatatcagtccagcattattctgatacaaaatgtagaagacatcacaaaagcagaaaactactgacaaatattcctcataaacatagacagaaaaatccttaacaagacactggctggcaaatgaatctgcaatatgaaaaaaataaatcattaccaaataagaattatcccaagaaagcaatgttggtttgggaacagaaaatctattagtctaatacacaatattaacagaataaagggcaaaaccacatgattatcttaatagatgttgaaaaatcacttattaaaatccagcactcattcaagatgaaaactcacacaaaatattatcaatagaagtaagctttttcagtctgataaagaacgtctgtgaaaaacctacagctaacattataattaatggttagagaatgaatgctttgcccttaggattgagaagaaagcaaagggtggtttactgtcaccactcctattcaacattgtactggaggttcttagccagtataaggcaaaattaattaattaattaattaaagacactttttattggaaatgaagcaactgtctttaattccaaaacatgataccatatatgaaaagttctagggatccacaaaaagaaaaattactagaactaataaatgagtttagtaagatttcggtgtgcaagattaataatacaaaattgtatttctatatactagcaatgaacaatttgaaaattaaaatatttcattcacgatagcataaaaaatgtggaaatgaatttaacaaaatgagtacaagacttatacactaaaaactataaaatggtactgagaaaaatgaaagatccaaataactagtgagataaatagtccatgttcatagatgagaaaactcaatattgttgagatggcaattttcccaatattaatcaataaattaaacatattcccaatcaaaatcttgtcagtctttctttttggtagaaatagagcagttgatcctactagttatataaaaaatattgagacatttaacagtaactgaatttaaattttgttataatgcaatagtgatcataacagcgtgccgttatttcaagataggcataaagatcaggggaatagaatagggattacttacttttatggtcagttaatgtttaaccaacatgtcaaggtaatgctgagaaaattgaatataattaattttaaaaaacagttttatcttataccatacacaaaagttaacttaaattttattttggcactaaatgtaaaagctaaatatatgaaacttctcatgtaaaatataggaggaaaaaaattcatgaacttgggtaggtagagtgactttagacataaaactaaaagcgtaatccatgaatacaaaattaataaactgaaatttataaaaattgcaaatttgtgtgcttcaaatgacaacaagaagtcaatgaaaaagcaagttatagactgggagaaaaatagtcacaacctatatagcaggtaaggacttaaatccacaaaacataaaaacctcttacaaccttattataaggagacaattcaattaagtatagatattacaccaaagatatatgaatggctaataagcacacaacaagatgcgcaacaccgttattatttaggcaaatgctaattaaaaccacaatggtgtatcactacacgtacccactagaatgattataatcacaaagacagaaaatgcaaaatgttaagggtgtggagaaactggaacacatatagtcagatcggggtaatatacaaggttacagccatattggaacacagtttgagaacttcttaaaattttaaacagattgaccatgtgatccagaaaattcagtcctaggaattcagtgaagtgaaaatacaggtccatagaaagtcaggcatgtgaatatttatagcaacaatgtttttaatagttctaaactaaaaacaatccaaatgtccaaatgtccactggtgaattgataaacaaaaggaatatatttatacagtgaaatattattcaacaattagaagggatgtgctactgacaattttgcaatatggatgaacttcaaaaacactatgcaaagtgaaagaagctagaattaaacaattacatatttataattccatttatatgaaatgtccaaaaagggcaaatttacagagtcagaaaaatgtttaatgattgcttgaagctggaggtgggggctggatatactgtacacaagcacaggggaatctcgtagggtgatgaaaatattttaagaccagattctggcgatggctgtacaactctttccatttactaaaaatcactgaatcactttcaatgggtgaattttatagtatataactaatacctcaataaagctgtttagaattttatttttcagttcatatgattgtaactgctttggaatgatttgtacattactattatttaatacaaaatttcctagaccttcagaaaaatagattataaagctattgggactgagttattttggggtgggaatatctcagaccaatatatcaattggattaatgtttattgacctgtgtaacaaatgtagttatcttatactttttcatagtcatatatgcaatttggtttttgtaatgtattagcatactgatactgatgaaatgctttcatcgtattaatgtctcaatatttatatggtagtttttaattatcattccatatatttttacttttcatattacttgtctctttggtcagtcctactagaaatcttttatatcaggttgtttgataatatactctgttgtttctgttttctatggtgttaattcctgtttctttatgtttgttcctgttcattttacaatggggttgaggaatactttattctttaaatttaatttttaaaaaatttatgacaaatatttttgaagatattaataattatacatctcaggatttatactttaagtatttctatttatcattattttccaaacacttcttaatttctctacccctaatgttatttagtaatagattatctaattttcaaatatgtggaacttttaaatattttatattagcttttaattttattaaattttggtcagagaatataaatgatgtagtattgattatttgttatttcttaagactttgtgacctcacaaatattctgcttttatgaatgttttatatattctttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctatatattcttaaaaaatgtttattttctgtttcttggttgtagttgtctataaaaatctaatggcttaatattcttttttttttacttaatatataaatttctgagaagtgtttgcttaaatctctaactccagttattgatttatttaagtctattacattctgtttgttattgtttgacatatttaaagtctatattattaggtgaatatatgctcatgattgttatactttcttgttcttgttcttgtcattttttacttcatatattgtccttctttgtcacttatgatacatttttggactcaattctaatttttaagtgttaatattgctgcatatgctctcttcctcttcatttttgtcttgtatatttttattatcttactggtttgatatttgcatgccttttcattttaatttttctcaatacatgggttcttttttaaacatcaaattaccaattgtctcttaatttgtaggtttagcacatttatatttattgttatttctgttatagtgagacttggttctttcatttttaaaatattttcggttactatatttagtagtttcttctttctagctttttttgggtggtgatttatttttgttcttattatgactatccctaaacaaatagccatacttttgattatttattctattgctaatatctgtgtctattgtcaatttctttgtcttctctccaaatgtatgttaatccactctccatatattttctgtaaatataattttgttattaacttgattttagcttaaaattcttattgcttttctcttttattctttttttgttaattatagaaattgttcctttcttcagatatttctttctatatttatttccttcttttggagacttctaattctattttaaatgttctttagcttttccttttttagaaaaattgtttcttatttccattgccttctaggagaattccttgatctgatcatctggttcacaagttcattatttatttgtacctatcccatctttattctttatattgctagatttattatcatttgaatattttccatatacaaaatttccactttgttcttcctttataacttctttcttgttattgttttacatttgtttatgcagatatcttctcttatctctccataacataattagacttgataaaatatttttctacccattccaatatttctacttcaattaatacatgttgtttagtatattctattttttacttgtcagatatacagatattcttattgtaatattccataatggctgtatttattttttctgctaaattcagttaggtagtgttcaatgtcaagcttcagtctgtagcccttctggtgagtataaggatagaaaaagagataagacccagtgctggaggttctgaatcccctcttttccactccagcttgctgccacttcaccaggtcaggaatctatctgtaaggtctcaggcattgtcaacattaggaagaggtgttttctgtaggttgtgatccaccacctaggggtttggaggggaaggagatggagtcatatatccttgcgcctgttttcatcatcccccagctggccttttgacttgctctgtcattcccctctctacacctgtgacctagttagtacgttgctgttgattttctggggaagggggatagtagtgattgttttgagttaattactttgatctgtaatttccctatgcttctgtagtatcttcaggaatgatttttgagagaaaaccaagagccatcctgctttttctttatgcttcggtcacatttcccttctttctgtccattccttaaaaaggacagtctagtttccaccacaaatcctttgcaattgccgttctctatgcccagaatgttcttccctcaaatgtttttgccactatatctaaaatagtccccattctggtcactattgtatttttctgtttatttgtgagagcacttactataatttatagttgttgtgcatatctgtctctttctatcagaatgtaagctccttagaatatgtattccatttttttctctctctctcttttttattttatattttctgtggcagcttcacagtccagaagagtgctaaaatgtagttaatatgtaataaattttgtggaataaatgaacaaatgaatgaatgaaataacttatatggccactgcttatcttattttcaatgtatttttaacttctttctaaacatatgaatagtggagtatgttctttagcttttcttttctattttcagttcttttccttctagataagagtttctcaacctgatcttctgtatcctacttttattctttatattatgtgacatactgatacatcataggtctacattctaagtgtttcatatttatcattaaaatgtctttattttgacaatgataacatgaagttgtattttgcaatgtgatattctaaagaaaaattatccagttttattatttggttttaggtaaaagttaaagtcaagttaactctatatcttttttagctaggttatgtcacaataataagttgccaaataatgtttcataagaattcacttgatccttattgcaaatctggaatgtaggtagggtgtgaatttccatttttctgatgaggaaagtgaggtgcaaagaggtgaagtgagtgggtggcaggtctgagacttgaacactagtcttcagttattactttgtacatttgtttttctttaccatcaggtttgttcctaagtgtatgtcacattattagaatagagatttgggctttctcctgccgtacctaaaagatgtttagtttacttggcttgtcagtagagaaaacattgaaaataacaacaacaacaacaataaatggttctgtgtcaggcactgttccaagtgctatacatgaattaacatatgtaaatccctatatagtcctgagagtttgacaaaattataaccattttgcacatgaggacactaaagcatagaggtgttaaataacttgtccaagtcccatagcttaagtggcagacttagaaatatgaaacaagcaatcctgctcttaattactattctaatctataataatagaaactttgctgtagtttatagtttacttagagctttcatatccgtaatctactgggcctcactactactctgtggagaaggcaggcaggattggacagacgaacaacatgccaagtttcagagtggtgacgtggcctacttcacccagacagcaagtggctgaagtaatactgaaattctttcttttgaaatctaattttatctgttcttggatcatgttttattgcccataaatttattagctcaatgtagccttcatgatatgtttttcttctccagcaatttacattattgtgggcttaaaatgttaatctatttatacatctaaggactattttgtttcttacattttgacgttccttgatcatgtcttttgcagctgaattgtgatgattttaaaaaaggagaaagagatggggattttatctgtcctgattattatgaagctgtttgtggcacagatgggaaaacatatgacaacagatgtgcactgtgtgctgagaatgcgtgagtattctctgaagtaggctttctccctaaaacgtgttctctctataattacatgacacaattttccctacagtctttaagctaacgattcattatgtgggagttagccattcctaaattattagtaccacttcttttactactcttaagacaaataaaggtgtatagcataacactttatattttacaaagcacttttatgtatgatttatcagatggttatcactttatgaagtagacagaatagggagattatagattatatgttcataatctataaaatgttatagattttatatttaaaatgtataataaaatatagctttaatataataaaacagatttaatattttaataaaatatagacttatgattttataatctataagttatagattatatgattatcatatataacagattatataatatatttacacacatacatacatatatacatatatatacatacacacatctatcttctatctatccatcatctattatctatttgtttatctatgtgtataccctttttcacagagaattatttcatcatcaaattatgtttattaagtgcttaataatttgtaatattagagtagataattgagactttcaatattaaatttcttcccatctctcaacatttaccaaatagctaaggcatcttactgtcctatatcttgtccctgttttgttctttctctaccttcaatgctagatttggttatcaattgtcttcaccaacaagatgacatacctgcttggcgggttctggcttgtgatctcaatcttgaattgtctggtcttaaggttttgcaaatatgaaaaccaaggtgtgtacaggctaatgaggggtattataattattcactttttgagatcctgcaagctttagctctccttgcaataaatattttcagcaaaataaaactgcattaaaacactctcatcttttgcaggatggtattttcagaaattcactttaaaattatgtcctcaactctcaccaagggtcaacatagagaaaccgaaaacaaacgtagatatatgaagaacacacagatttttatcagatatatattgtgtagcacaagtatgagcatgctatatatttaattcttactgtgtcttatgtggggaatcccattataaatctttaaatctctggtccaggtgaaagtttctctcccctaatttctggtatatttctttgtactatgtactttgtactatgcgatgagaatcatacttctccttgtgttgtttcccttgcagctctagctgctaggaggctctacaataaaattgaaaattttatttttatagtgcccctcagctgatatcctttgaaataacttttttcttatcacttttaaatatttagtttttttctttatattgtttttactaaatttttattgttttacagatgttatcattgtaatctgctttaactttttacaaattaggaaatatgtcttacatttgcggttctgtgttttcagatatactttaaaggtctacgagactgaacaaaattaattatcaagactttatgtactttctatgaaaaataaaatactagtcttcataacccaaataaagagtagtatagtgggatgttagataatacaaatttgactttgtttatttaaaacaacaaagttccttgggtgctgagtgttatctattatccagttacaagctttacttttccccatcttctgatgtggatccctcctctaaacaaaggttaaaaaaagatttctataaataacatttacaagtctgaatctttaccatctcttccatgttaactacatttctttgacttgaagttataaacagtgacttttattagaaaaagtaataaaataatactatgtggcagctgttttcgggagtaaaggagaatgacaatgcaatgtagagcagttaggtttgaatggtgggaagttctgtgatattaaactgctgtgtctactaacttttgattctaggaaaaccgggtcccaaattggtgtaaaaagtgaaggggaatgtaagagcagtaatccagagcaggtgaggtcaattgtcagcctgatgggaaatactgggaggctaacttcaaatagtaagtaggtgctctcctcttccttcttaggtgggagccttggaaggaattaattcttgctttatgtgaaatggaatacccagtactgcccactaatatgaaaaagctaattatagtctctgaaactggatcagattactttggtggttagatctttcaatctattgctgctttgtataaaaaaaaaaagaagaagaagaaataaaaaggaaactacatgtgtagtagaaagggcacaacacttcagtcacttagcctgcgttaaaaccccagcagtgtcacttgctgtttggagaccttggacaaattacttaacctaaaatgagatttgaactaaatagattttttttctatgatacagttttgtgagcctgtgatggtaggggaaggggaaggaagaaaggatctcatacatgtcacacttgtctttttccaggtgaatgattttcctaattttcaaggtctgatgccctttttataagcttccagagcacctgaggtgacttgcaccaagtcatttagcatcatgcaattttaaatgtctctttttatcacctaggagattgggagcaagttgatggcaaggactgtgctctgtctgagttctggcacatagtaggttatctgtttactaaataaatgaataaacaagtaaaaaagttttatatttaaccacatgaattatagagtacttactgagctacatctacacagctggtactgctctaagtggcccatagcaatgtcagagggactgagttcaataaaatttctgaaaacagtgttgtcagcattacaatcttggtaagtttcaagttcttttccctgttcttcaggatgtatgcagtgcttttcggccctttgttagagatggaagacttggatgcacaagggaaaatgatcctgttcttggtcctgatgggaagacgcatggcaataagtgtgcaatgtgtgctgagctgttgtaagtagcatcatccccaggtggacttgatgatgatgcacttggttgctgtcccgagaatcactcagcagagagataaaatccttttcatgaagcatgcaattctttgtctttacactgtgaaatagcctttctcacagaaaggcttcttttctttttcttcttatcattgattgaagtttcttaaaagaagagaataaggtggtcatgttagttattaaattcaagactctcatttcttttaaattacagtaatttgaaaatgtatagtgttttataaggcacaatattttaaaatttagaaagcactttcatatggaatgatctaggtcagtcgtctgacatccattgcttcatttgggcatatgtagagacccttcctgagtaatgtgaggctaattaaaataataatagtaataatgccatgtgtctgaatctatttattagcttaaaaagtggaacgcggatcattacaaaaggaagggctattgggttaatctttatctgagtgcctggcagtgcttgggcattaaagacgcagatgtggataagatctaattagtctttcatattctggctgttaaacaaggtttagactctctaattcacgtgccagcaaaccttaaattgctatatttacatcactggaactttaaaatcaggacagagatttaactgattagcaaacaaacgtcacacctgcctttgaaaattacagttagtccttgtagaattcaaggacatgtccaatcaggtttacaaaacagtgatgataactggtttccagacaggaaatcagcctgatttccactttcttatctaggagacatgttctctcaatgttcaaatctgccctaattctgtagggtttttttttctttttatgcattatgtgaaaaggggaatttgacctctctaactcctggtttcttactctgtggaactgagatagccacacctatctccggaatgagacgctaatcaaatgatagatgtgaaagggcttaaagctcaattcaaatgtagctttcattaacaacttagtacttttacatgaaagcaaacaaatactttacaaggtatacaaagttatacttaagggtgtggatggcaatgtctcaaatgctcagtttggtttcacccttgtcacagcattattttaaagctcttggttctgcctgttaaagggaattttcctgacaatcttctgtttgtcaatcaaggtgtcacacccattcagttttacagaacaaagcttctaattgactgtcagtgagtcagtttcacaccctttcttactataggcaagaaagctaatttacagaaagcaagtttcccagataagctattgccgtctttctttctttccttatctttggcaatttctctggctcaggcattgaagacggaaatgcttgtctcttgtaagaggatcattttcagcaattcgtagcagaggatatgaaagtgtttagcacaggactgaggatactgaaaatatgattgagtcataaactgaccaactgtttacttttcttaacagtttaaaagaagctgaaaatgccaagcgagagggtgaaactagaattcgacgaaatgctgaaaaggtaaaatgactcaccaacgcaattttgttcttgtggccatatttattaacaaatgtatgcctaaacctttgagtaatgaaataaagtcattgtcttttattattatatagatatttttcttaatatcaaaattccccaaattgactattcctagaatattaatcattagattcagatttaaaacagcatttcctacctaaggcccaaaatgtgcagtttccacctgtgtttctccagtcctctagcccccaaaagaagatataagatagaaagtttgtataaaccaaattctgcttaatttctagcagccttctttttggtttagtgtaaacccattttactctgtataaattgtttaaaattggcaatgaaatataaattaaacaggaataattttaaaatagtgagagtgttttaaacactatatccactagtgcattttatgtgcaattaaattgacacaagttgaagttattcactttgccattgtgattattctgttcagaaaaacctgcatttataaaggtcttgattctgctttaaaaaaaaaaaaagacaaatttttagaatgtgttttaaaaaaatccttaaaattatttttttgaaattacttgataatttaattattcaatctagtataaaaagttttgaataagcactttaggtaatgcagcctggatttcttaaatcacctactttcaatgagagggatagcagtttctttgctaaatggctaaccttttgttgagaagtcagaacgcctgagttttagccttggttttgccatgctctgggtgtgggagactaagtaaataatcatcctgggccttaattttcttgtcagcaaagtaaagaggttggataatgacctgaattttaccttcctgttggactgtgattctacatcctgcacacttttgtactaatacaagtgcactcctttttgcagatcgtagggcttatgttttcctaaaggaagaaacaagcccaccttttggtagtcaagagctagcccttcagttcgtaatgcttatttaatgaagcaaagctctcaacctaaatagggtattgaaggtttacatttaggaaaactaagtattcagaaccatctacagtttatgcaacacttgccaaggattgaaaaggaattcttttgtggtggttgttaaatttcagtctaaaactttgggtcatcctgtgatagttaacattttattacttcataaacacagagagttattttcctttgtttttcattaggtctctgtacttccctcttcctctctgtggctagggtcattgttttggtggggtcaccgggcatgatggtgtgaataggactgctttattgtgatggctcaatatgttccctataattaacttgtcactaggttgcaaacacagtgtttcttcagaatctccttggctgaatcacaacttataaactgaaattatcattgtttcttttacgagaatcattgagcattaattttttataccatgctatgattatcaggtgactgtcttctgcttctctatttctaggttgttacaaccatgaggtttggagcacatccattgctcctccaaaaataaatatcttcttaataggaagcagttaggattctctgttaaagcatcccaatggaatttgaattattttttaaaaaaccaaagaatgctagatctagaaaaggtcctacagagcatctgttccaaaaacctcattgtagaagtagtaactgtggttccaaaggagaagggactttgctgtggtctcccatttgggtgagagggacaatctagtggcccaggtcatttgactcctagccatgctctttatgcccatgttttcttgcctgaaattgaatgacgaaggtcacacagttgaaaagaaagttatagaccaggattttttgtaggtcatattatagtactatatctcaccacaaaatgtttaatgacatagagatccccaagcctagagtagcttagagtatcatttttttggtaaagtttagccctcctcacatagtagagttttcaaaacacagaaagtagcctgaaagtattgaaccaaagcatcaggaaatctgaaaacaaatctttcttggattttttttggtggggggaagtcactcctttttagcttttctaaatgagtatcagtcttgatgatctatctgtctaaggtgagggtgaaaggaaattagatctactctctctctacaatgtcagaaattattatggataaagaaggcagaatacacaaaaattatccacagatccatagagaaaatcaactaaagtaagcataacactgttggataacatcttgtttctttatacttacaaacttagctggattattcttgacttgatccatattaagtcacttttagacatctcatcttctcacaacttttttttctttttttttttgtgatttggctgctgcattttgttgtgtttgtgctggaacctcatgaaagatatcccctgacccctattgatctgaaagttaaaaagaaatacctagttttaatccaagaaaactcttggtcagccttattttttccgaggctgttttttatcttttaataaacctaccacataacagatacaagtgccaagtagttgacaatataattactgtttcttagtaatcctcattaatatgttgtatgtatttgccaacttctagacctgatgttttgtggtaataaatctattataaagtttccagattaaaacgtagaaaaatggtaaataaaattacttgttggctggatgtgttggttcatgcctataatttcaacactttgggaggccaaggcaggaagattacttgagccaaggaattcaagaccagcccgggcaacatgatgagatccagtctctaccaaaaaggaaaaaatttagccgggtgtggtggtgcatgtctgtagtcccatttagttaggaagctgaggtggaaggatctctgagcctagaggttagaggcttcactgagctatgatcattcccctgcaatccaccctgcgcaatgcagcaaaatcctgtctcaaaaaataaaatatcctgaaatgaaatgaagtaaaataaatataattgtcttttcaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttgtgagtatagaagtggttttttcagagtgattcaaagggtgggagtggagattgattggattgatgagtaaaaataactttgaaaggaagctttgttgttgagaaccatctgagcagttttatgccctccacaaatcataatgccacctagtgagcaggcactactgatgtttgtctatttctgaagagaaatggattccattttccagttgaaatattgacttacagcatagcacacttcttaacattcccctgtgactgtgacctatgtgaaactgtttgtgaactaattctagtatagaatgggggtaaaagcaggtaccacgacttcgattgtttttcttcagtaattatcccatggtaacagtgttgatgcaacactctcagatacttcaggtttatacattaattggattactcttatctttttatctgggacatatgaccttgggagaagggcaaatctcacaacatacaaattatcacatttatgaaaatgtcttagatgacatctcatgacactttcggcttctctagctctacaagccctttcctgtgtcctgtcctatgccagttcctcccggtcttggccagatgatgtcccctcctcttgtagattacatttcagattatctttccttggacaagaactcctaaagtccttccctaattgaaattaaattctcataatccttagtaattgtcttttctaaccaccatcacagttggcaattatacaattatttctccaagtttttgttgactttcagtcttttctaccagcctcaagaactacaagagggcagggtatgtgtttgtattatatactcctgcatgcccagggcccagccaacacttgcccaaaaaaccataattactcactaaatgaatgaatgaagatatgaatgaagatctcccactctcaagaagcttaagttcagtagcagaaataagccatggacatgtgcacatatttatatattgcaaaatagaataaaaactgctgtataagagaagactattcgatacaaaaacacagcaatagacatagcgctcatttgtatttgggaactggaatgtcttcttcaaaaaggtagaatttaagctgcagagttttaaatttcttttaagaaagggagatgagaaaaaagatcattttagtggaagtaaatggtataaaggtgaaattaaagggtctttttggggatttgaggtgtttttaaagtgtttgtactaaaactcaggacaacttagatatttttccatctatacctaatgactgttttgtaacatgaagatcggaagcatctctactcatttattttactttttccagcaagcagcgtttttcagaggaaaacagtaaaacagatcaaaatttgggaaaagctgaagaaaaaactaaagttaaaagagaaattgtggtgagaatcagtttgatcaatctagttacaacttgtgtgtgtgtgggggggtgcgtgtgtgagagagtgcatattacatagtatgcactttcaatattgtttaatattttccacactactagtaggtttgctggaaactaatttctagttattattttgtgaaacttagattaaaaaattatggcattacaatttctagctgtatatggaggcaattaatcaagtcacattaataatgtagttttgcactcctaaatgaaggtgaaatatcaaaacattgtctgaattcaaagtgtgatatgtagtcttcgatgtgtggtagctattgtgaaggtatttacttcaaaaacaatatcaatgttgaattttaatgtgcttccttttaaattatactgttctctgctttctaagtatcttttaactagtcacctgtctgtttttctactgctaccctcttagctcagacacttaatagttttcttttgcattgacgtattggcattgtacctggtttgtacactgttggtctccatctttctcaatcttcaagatttaattcatcctccatgttgttttcatatgtcatagaatatgagaacaaaaactatggttccacgagtcagcgatgctataaaattccaatgtttgaagatattctagagtatattcagaccatttcacttcttatagaaaccctaacttatttcttacagacagttttccagacttctatgatgtgcagtcaacagttctcctaagtaagccactccatcaggccaccctctgccagtataactccattttctttctttctttctttttttctttttctttttcttttcttttctttttttttttaagacaatttctttctttcttttttttctctgtcacccaggctggagtgtagtggtgggatcatggctcactgcagccttgacttcccactctcaagctatcctcacacctcagctttccaaagtgctaagattacaggcatgagccactacacatagcttaagcctcattttgaactgctttcttcccctcagtcctaggttaccaagtccttttaattttgatattcaaatatctgtcaactactattttatcatttatttccaatttttctccttccttccctttcttcctttcctttctcctttttctttttcttctctctattcttttttctcttttcctccctctctttctctcttttttaataatataattactgttctaacttcagtccctagttaatcaaatcctccacacatctggttgataacctttgtaaaacaaagatttgattttgccattttctgctataaacatttataattttcccattgcctaaaagtaatatccaaattcctttcaaagtttagtggtctttgattttcaaggtctccttttgaccatttcccaaatattattctctttatccaactaattatttagccactatattcataaatatgttagattacctcaaaatagcatgttctttcacacccctgtgtgtttgtccatttaattcctcttggatggcctttttccacattatgttcctgaatatattctcaagatagaacttagacataagttccctgaacttccatgaattattcttttcattgtacttgtacacacttaattcagactagtgttatatttcttagctttttatattgcaattacttatcttttccatttgactgataaagaacataaatataaataaatcatatttctatttatatattcctaacttaagcattcgttgaaaatgtaaatggatattacaaggagagaaatatcacaatttttggatggtcctaaatcttaaaagttttatttttcatccttaatttctcttttttctttgtaaaataacatttaacattcatacatagaaaacagaactatatctcaactttttcttattcattattcagaaactctgcagtcaatatcaaaatcaggcaaagaatggaatacttttctgtaccagagaaaatgaccctattcgtggtccagatgggaaaatgcatggcaacttgtgttccatgtgtcaagcctacttgtgagtatagagttttagaatgtcaaagaaagaagggatcttgcaggtaatttaatagaaacagcttctttcatagatggggagactgtggctcaagacagggaagtgagttgaaaacattacatggaaaatatcagtgatagagctgggagtaagtacctagagttatttgttttaagacgccttgttcctctgacactccctcttttagcactggaatgtcctgacaaacatgaacttgtacaaatagtagatgcccccttactcctgaaacttcacacgttagcctgttttagcaatttataggtatctcatcttccatgggagttaagagtccaaaggtgatgcttaatgtagaaatggaataaagtcaaaattcccatgaaacaacactaaactcctataaaattacaatgggtattattttatgtaatgcaatatttctcaataagttagaatggacagttttctttcaagatttacgatagctctttatttggctgagctcaaattaagtatttaacttatatttagaatctatggctttctttgttttgattgacaactacatatggttgaaatatcatcagttaactgtacatactgtgcaattccattgtacaaagcaaatttaggcttatttgttttatcagtatatggaaattattgtggttttttttttcacatcttgtcctttagatgaaacagctatgagtaagcaaaatatttaagtttaaagcaaagctagggtacacatggtgtgatagatagaccatggtcttgagggaggagaccttggttgtagtcatatcctgagatgtagcaaagaccccctctacctctcatcttctctgattaacaaggggatgagtagatgtgctttgttaaggccactttcagccttcaggttatgccaccatgattttagttttggtgcctctgttatgaacattgatcatgctccttttcttactatgggcaagaaaactaatttacagaaagcaagtatcccagatccactattgccgtctttctttcaacattaaacagacattatgaagaaatcatagcaccatactatcctggaggatattttgttgcttctcattgatatgcagtgataaagggacaaaattgttccactctaaggagggagaacagttaacagtgcaaggatgtggagaaatcatggcatgtgtttgttcctaatggatctgcttctttttccctcttattcagccaagcagaaaatgaagaaaagaaaaaggctgaagcacgagctagaaacaaaagagaatctggaaaagcaacctcatatgcagtgagtggaatccatccaataaatcctatttggtgctataatttgaacaaattttaagagcctaaagggtgagattttgccctgcagaaatccccagaatatcttaactcttcaatctggggatggtattgagatgaattatatgggaagattgatccattcttgctgattaaaaactaactctgcaaaaaaaaaaaaaaaaaattgtttaaaagctgaaaaactgagttctacttctagttttatcacttatagactgttagcttttgctaactactttccagagaaattctacatgtatgctttctacatatgagtttctgatatttcacatctaatttgagataaaaaataccttgattcccccaccaacgcatgatttttatccctgaaatattacaatattagtttccaaagccttagctcagttatcatcaccaatggttttgatgataaaagtctcctaattttcactctggattttatcctttcccttgcccaaccagtctccctaacatagttggagtaatgtttcaaaatgtaaataagatcataatattgctcttaaaacccacaagcagctcatcatcatatacaggatatgctttaatcctgttatctctcctcttatttgtatccttatctccattcagaaaatcatgctctgctatgtgccatgtcttttcctacctgtgtttttcagctagttttattttcataaacctgtgtgcgtatttcccaattcacttttttttgcccagtcaaatcctatttacacttccacagtctcacctaaattgttcttgctccctgacaccttccctggtttcctttgagttctcagattttattgtaccctgtatgttcgtacctattttattctgtttagattatagtggaatttgcttatatattgcttgtattatatggggacattgtgctatgttttattttttcctatctcttggcatatgatgtttttcttgttgtcaaattgaattttacatttgagaaaaacacaattaaaatcctcagctcaaagagatgtaacattagtttctgccaatgtagatgtttgaaccttctgctttaagtagaaatgaaatatatggccaacttacttcttctatctcggcaggagctttgcagtgaatatcgaaagcttgtgaggaacggaaaacttgcttgcaccagagagaacgatcctatccagggcccagatgggaaagtgcatggcaacacctgctccatgtgtgaggtcttcttgtgagtagccctgcagctgggaacatggaggaatgattttgttctttctatttcatttccatgttcaattatgggagggccacttcaacataaaaatgaaagaattaaggcatatttagagaaactgtctgattggagacatgtatttgaaaatccatgtcctttgaagattgtcaagacttcacacttaagcaaggagaaagtcataatcttgaaatattcaagtagttttgtcttttaagtgtggaaacaggacaagttctagcttatctccgtgaataaaagtgaggccagtgggccaaagaatgaaaggtctggaagacaggttccaagtggatgccaggaagaacttcctaacagtttgcggatttcaaagatggatgatttaccatggaattccaaggatgatatcagtacagactttacaggcagattaaagcaaaggcttgggagtcattagagatacagtaatgagcattggaaatttagaaaaccacctctggactagggtttaaatcccaagtctgtacttattatttctatatcttcaggtgagttatgcattccgtctgtcagtttatttgtatgttggggttataataatagttttgtaatgcaattgtgaggatttcacagtgtaagcacagggttaggcacatcacattcaaagaatttaatcgttgttaagtgtaaaattaaattatatttgagatcacttctaatgtggcgattctatgatttttacttatctcttcttaaccatccttttttagccaagcagaagaagaagaaaagaaaaagaaggaaggtaaatcaagaaacaaaagacaatctaagagtacagcttcctttgaggtgagtttatatcctccagcaactcagagggatatggccctgaggatccacagatcatgttcagggaacacgtgcattccttaaaactgtatgaaacaattgtacagtttgtgttttcatatgtgttttcatgtgtgcagttatacatgtgcatatgtgactatttcttggttgttgggttcattgtttttatcacttaaaaaatccatgccttcaaagttaatcattctaaaataagccaattgctaatcctcgtttaagaaaaaaagtacaagctttagctatttttgcaatctgattcagcctatgttcaacactttcaacttcctgcctcaatttcacaggagttgtgtagtgaataccgcaaatccaggaaaaacggacggcttttttgcaccagagagaatgaccccatccagggcccagatggaaaaatgcatggcaacacctgctccatgtgtgaggccttcttgtgagtagagcagtagccccatagcgtctgaggattgagcagtgggaatttccatgggaagttttcaaaccattgtgaataatgcattttcttcttcagtgtagcattcagtcttgggtgtcatatttaaatggactaaaaacaaacaacagcaacaataaaacaagtggagggctttctattatgatataaagagatgcagaataagccagacacagaaaaacatataatgtgtgatgtctcttatatgtgggatctaaaaaaagctaactcatagtagagagtaggatggtgcttacaagagaatgggagtagggaagggtgagggttgggaatgaggaaatgttaatcaaagggtgcaaagttttagttaagcaggaggaataagtttatgggatgtattggacagcatggtgactacagttaataataatgtatcatatatttcaaaaacattaaaaaagtaaatcgtaaatgtccttacaccttcccaaaaaagataagtatcatgagacaactatgtaaattgcttgatttaatcatcacaatgtatacatataccaaacatcacactgaattcaattaatatgtacaattattatatgtcaagtaagaacacaatttaaaaaagtgaggtgcagaataatttcttctatgacatttaaaaagtaacctagaatcattcacccagagaagagaatacttcatgataattatactaattgcttttagttttatgaaaacattatcagatgaaataggaaatacatatgattacacataaaatattacaatgcatggaaaatttatgggatttttttgttcactatctttcttcctacttattctatgtgattttaaggaatataattaaaatggaaaagagctataggaagaaagatttgggctcatgatgaagattaactttgtaataaagcagaaaaagacaagaatggagattttattatgtaggagttgggagcctattgatagggtgcctaaaataggtctttaggatgaatgtcatggtatggccggcccttcaaaaacgtgactaggcttttcttaaactcttgatttttgactaaaaaaacccccattttatttcccatgtgccaagaatcttagaaaggacttaatttatttagtcttcccatatagaaagcaatataatccagcatattttcccatagcatttgaggcttggagcactaaaaatctattagaaggaaagttgagatcatgaccatataattatcacaacaaacgtttgttgaacgcatataattatgtgacacttgctcagagatttgttgcctaatctcatttcatcttcacaacaaccatatgaaatagatgaaaccagataaaaagcaagaacaaaaaacaaaactaaggcccagaacagttgagaatgacggaaaagtcaggacaggatatgggacttacagatgaaggaaaagttaatgtatttcttgttgtggggtataatcacttagtgaagtctttcagcctgttttttgttctcccttacattaatttttcagtagcaagaaactaattctgccacttagtggtcatctttgctgcctcctctgacaattttccattggggaaagaaaatgctgcttaaatgttttagtcaacttagactcgtgataaaggttagatcggttttcatataaagatgtatgaacaatcccataattttagatctattttagtcagtttatttcataagtatataaattctttattgaaaagaaataacctttatcacctcatgttttatagatatgttaacaaaggtgattgattttttttgagaattattctaccctccatagttagtttttgcacactttcataccatgtgaaaacagtcttttcaatttttaaaaaagttttagtttgatctatgtgcaagtattttgttgattgggacacattaaaacattttcacaaattatgtaatttttttctacattttgaactatttgtgttatatatccaattatgctgtagatccaatccaccaagctcaatttgcaacactgttagttatccaaaatgtaacagctatcactttcacttcatttccatcatatgcctagttttggaaggaaagtttcctttcaataatgacaataatgattatgtcaatctcttataacaattatatcaattattttattttgtaccaggtactgttctaattgctttacatgtagcaactcatttaatgctcttaacattccaataagaaaggtacttttattacctcttctattcctcctaaacacacacttaaagatgaggaaggcacagagaggttaaggtacttcttgtcttccttgcagaatttggctccagagtctttcctcttaaccaccatgctatactgcctctcagaagataaatattacctctccataaagagtaatcacacatgcaaaagaatcagcaaataagaaagtactattgcagtacatatactgggaagttaaacaggtttactccctaattcaggggctttctcttgcacaccattctcttgaggtagagtgaatcataattgtttattgtctaataaaagtataaactactatgggtggatatttggcagtgtttgagaatagtcaaaacaataaatgatcaagctatgaaagttaaggatctagtctactatattaagatccatttctggccaggcacggtggctcacacctgtaatcccagcacttttggaggctgaagcgggtggatcatgaggtcaggagttcgagaccagcctggccagcatggtgaaaccccgtctctactaaaaatacagaaaacttagccgagtgtggtggcatgtgcctgtaatcctagctacttgggaggctgaggcaggagaattgcttgaacccgggaggtggaggttgcagtgagccgagatcgcgccactgcactccagcctgggtgacagagagagactccgtctcaaaaaagaaaaaaaaaaatccatttcttctctctttttcttttcggtttcttaaagtcaacaagaagaaagagcaagagcaaaggctaaaagagaagctgcaaaggtaatattctcaggaatgctgatgctgtgccctgacatttttcatttctttataattctttacttatcctattagaataaatgttttctgtttaattttcatgcctgaaataaatgaagaacatttttaacctgaacaaaaagggtcctgataagaagtgtccagagtaccaattttatttcacaattattcaaattttgaggtttatttcataaaaagtggaatgttaactttttgtaaggaattttccccatatttggcttttattagatttctgttgttagagtattaacttatgccatttactaatttcaatttacattattcatatctctgttatttcaaatagagagtataagatctcaatcattccaatttacaaaacgaaagcacatatattatcatatttgagctttgtcaccacccagctatggagcaagtggtggttttcttgcacccaattaagattattaagttgggcctctgactttccagttatttttattccactctccatgcttttataattttatacatagcagagtcaaatttatctgtgtggagatgttgaattattctcatataatagctacatacaagatttatctttctttctttttttctgttttttttgagatggagtctcgctctgttgcccaggctagagtgcagtggcgcagatctgggctcactgtaacctctgccgcccgggttcaagtgattctcctgcctcagcctctctaatagctgggattacaggcacgtgccacaatgcccagctaattttttttttttttttttttagtagaaatggggtttcaccatgttgaccaggctggtctcaaactcctgacctcaagtgattcactcaccttggcctcccaaagtcctgggattacaggtgtgagccactgcacccggcctgtttattctatttcttaacaatagccacaacagtacaaacctcatcattacttggggaaaagttgacacagtttaaaatttgccttcttactgactcttttttttttaaataagtgtttctactaggtgaaactatcttttcattgatcatttagaattgaaaatgtgttttcatccattatgtttgatcagctgccaaatcctcttagatatttccagtggtattaacatattcctccttctctccactcctattcttaccctcttgcttcaaatccacatctcccattcctggtttttaatttttttaaatcaatttactcccagaaatatgttagtttctccagggatcagacttattctcttctctatgtataaagatatgtctttttaaatttatttatttatttatttttgagtcaggtcttactttgttgcccaggctgtagtgtagtggtgcgatcaaagctcactacaacttcgaactcctgggctcaagtgatcctcccacctaagcctcccaagtagctgggactacaggcacacaccaccatgcctggcaatttattttatttttttattttgaatttttctgtagacacagagttttgctattgtgtccaggcttgtcttgaactcctgggctcaagcactcttgcagtggcctcctaaagtgttggaattacaggtgtgagccaccatacttggacaaaatatatatttatttcttaggttaagcatgttttttctcttctttctcagacccctaaagacaaatcacaggtaagcaatattctcatttcctccaggaaggcttctcatctaagcctgcctatggaatcttcccacctctgatctttcctagcttttacagaccatgctatgcaacacaacacacacgtatgtttttgatgataaatattttcagatctgctataatgatgggacaattctgattgatgacggaagctttgtaaatacttactgatttactactatgtgttatcacttttgtttttactttttactctacgttacatattcctcataataggaaaagatgcaggaaggatagaaaactactctgagaaaatattttcttcatttcccaggaaatctgcagtgaatttcgggaccaagtgaggaatggaacacttatatgcaccagggagcataatcctgtccgtggcccagatggcaaaatgcatggaaacaagtgtgccatgtgtgccagtgtgttgtgagtgtccaccccatctctcccactgaatttcttcatccatgatcgcccctgagtctcagatccttcatgcatgtgtagagtatagaccgtgagttatatattagaaaggtttacaagcagatggataagacattaagtaatattgaatcatatagtgacaatactattatttattcaattatccttctattttccaattaagtcaagggaaaaagctcaatttaatggtttttttttaacacttgataatcttcatttgtgaaaaagagagagcagaaatttcatgatttggattggatgatctttttgatgtctttcccactcctgacattttatgatttgttagtctattcagataggagctaaggagaagccagctggatggaggtctgtggggtcagtacataaagactattaaaatagcctgaacaataaatggaataggaaggattgttatttatcctttcaaggacattactatataatgcaaacattcataagtggtttagtgtggagtaaaacctttaggaaacaggctcataccctaaatgtttactaaaatgtctccttgttaagccaggttcatggccttctaaggtctttgttttgctgagtggtgtaggtaagcctgtgactacagctccatcgtgtgggacaatatagaggttaattattatcacttctaattctcctttttaggctcttaatctgctcctgaacttaaccctaaaataaatgccgagaaaaacgcttatttaaataatacctgctgaggtgcaaagttaatgtctcctaactttcacatgtcttgatccaaccttaagtggatgcatacaattccctaaaaggagaggttgacagagtagagcactagaagaaaagtggcctgaaattcaagaagccagggtttttctctcacccgttcaatttgctggtgttgtggtaatgactaaatgtagtaaatgctaaggattttccagcattaacatgctatatgtcagtagaaaatggcaagaataccagaatattaggcttgtgttcaacccccaaagattagcagttgaatctaactggacttaaatcactactgcaatctaaaccttgaatttcaacttcaatattagctccattgaaataatatttaaaatttttagtttaaagtaaaacatggtttattatgattttgagcccatcatctgacttagcatcaccctttgcctttatcacggatatggtagttacttggagaggaaaggtttaagcagtgaaataaaatcaagacaattgtagctttattcggaatgttaattaaaattagcgacgtacaaaaaataagatcacctgagggccacagactgataaagatgcatgcttgttttgtaattattcttctttagagggggaatgtaaacagctaagtttatctgtactattggttaaagcaaaagcacctctcagactagataaatttgtattgaagactgaatctgactgttggtttggaagatcctcattccttttaaaaatgtactaccaaaaagagtagggaatcatattcagcctatatcttctttttctattacagcaaacttgaagaagaagagaagaaaaatgataaagaagaaaaagggaaagtcgaggctgaaaaagttaagagagaagcagttcaggtagttgtttgagatcatcagagccacataaatattcaacgatcactctccctagggagggctcctattccctcctcctcattccagtattcttagtttctttgcaaactgggaaaatgtgtttggatccccatatacaagagtactcccctttccttattcaatttattcacattaaatctattaattgctcgtgcaggagagagatcaatcaccattttctcccctgattgtgtcaattatattacctaagaaagaagtatatatagattgttatcttactgtctgaatgcagactaatagagacagatgttcagatttttctcaagtacatttttgaatatgaatatttaccttaaaaacagcaacaactagggatcccacttaattatctgtgagattttgaggagataaaagcatctctgagtcttgagtttgcattctttaacatctcacatgatggtgataacaatgataattgtacattcgttgctactgtatgcatcatggcataaagttttatgactgatatttgtagtagccattgaagggacatattattatctgtgttttatagaagaggacttggaagctgacataagaagttaagaaatatatttaattagttacatataatacaattatatactgatatattatttactatatattaacataaatattatatgatacaaataatatcatatataattataattatatgtagttagtaacttgagaaccaagaattgaaccaaaagttctggctttaaggcccatgatgcactttagattttacacgcttctgccatttgtattattcctgcagactatgccttaggtcctcattattcttttcttttgtccttctgtgatttagaagagctcatttctactgctcttacctttgctctctacaatctactctcaactcttaagccaaagtaattatttaaaaccataaggcaggtcgtgctacccagtggcttctcacctcactcaaagtaaaaatcaaggtccttgtagtgtctggaagtgccatacatggtctgatccctgccacttttcataggtcacatttcctattattctacattgttctccatgcaccaattatactggccaccttttggtttctgggacatcccaagcattgattcatggctttctatcacgtggtcacaaaaacaatgtggttaaaaaactggactctaggctcagactgtcagggttcaaatccttgcttcatttccctaccagtaaggtcctacagttaacatcttcatatattagctttctcacttataagataaggacattattattacgtatattatttttatgaagtcccaagaaacttattaatgtataacagcacagtgtcacacatatcttaagtagtcactctttaatattatatttattgctgttaatgtcattattggtctaatctcattgtccagtggggtgttccatactggagagttcaccaattcttcaacatacaatgaactttaccttctatatgccattactcacagtcagaatatccctcttgtctaccaaaattctggccacttttcatggctcagactgtgtgttaactgctccctaaatattttcccatgtgtgcaatatacttaataactctatcacttgttatgccaacaatttaaaaagtattttagttatattattcattgtattataacttatagttgcctctatgtgttttcttcaaagaaattaaaaactctgtgctagttttctatggttgcgataacaaattagcacactttagtggcttaaaacaacataaacttctcattgttcaactcccacttatgagaacacatggacacagggaggggaacatcacacaccggggcctgtttggggactgggggaaaggggagggagagcatgcaaatatctaatattagccccctcatgcaaatatctaatgcatgcaaatatctaatattattagccccctcatgcaaatatctaatgcatgagggggctaaaaacctaggtgacgggttgataggtgcagcaaaccaccatggcacatgtatacctatgtaacaaacctgcatgctctgaacatgtatcccagaacttaaagtaaaataaaacaaaataaaataaaataaaaaacaatgaaaacaacaacaataacataaacttcttatcttatttcataggttagaaggctaaaaaggatctcactgggctaaaatcaaagggttggcagagctgtattccttttctggagtttgcaggcgacaatccatctctttttctccaaatctagaggccgtccatgttccttggttcttggaccccccttctctgtctacaaagccagcaatgttatatctctctgactgttcttctgtggttacatctccctctcactctgtcttccatctcgctcttgcagttttaaggactgatccttgtgattgagccttacactgagcccattatggcaatacaggataatctcttcatttcaaggttattaacttaattatatctgaaaagccctttttgccatgtaaggcagcatattctcaggtctcaagtattaagacttagacgtatttggtggaacggtattattctgtataccacagattcctttaccaatttaagaggccatacatttttcttctctgtatctttcacagtgcctagtgcagaataatatttgacctgaaggttttctaatgagataaataacagcaatccatgttccaaatgtgtgacctagttctctgaaaagcattttggttactatcaaccttcagcatcaccttttccatgcaatcattatgttttagtttttaaagcagtattgtggaggaagatttctagtgtttagttattggactcttaaaacctgcttctgcttcatttggcaggagctgtgcagtgaatatcgtcattatgtgaggaatggacgactcccctgtaccagagagaatgatcctattgagggtctagatgggaaaatccacggcaacacctgctccatgtgtgaagccttcttgtgagtgggcggcagccactgctgctactgagtgtgggagaagatcagcatcgggtgggcaagaggggtgacattggaagttttctccaggagatagataataaaggctgtctttgcactgagtttggaaatttactattataaagccatatattcagcccatttatttctggtgttcttcaatagtctgagaggtacttgaatcaccatcaagaaaggaccatgtgctaagagcaaaattacactggagttaatggcataaaaggattaggacttctgttctctgcaagcataggtcactgtcaaataatccaaaggtgtaatcattaggtgctaataaattgaaaatgagttaacatctaattgatatcttagtttatttctggggagaagaacaatatctttatttttcaaaagagatatagtcataaaagtttcttcactggtttgctatggcatgtgcgtcttattctttaaacaaccttaagaacaagaacggctgggtgtggtggctcatgcctgtaattctagcactttgggaggccgaggcgggcagatgacgaggtcaagagatcaagaccaccctggccaacatggtgaaaccccacctttactaaaaatataaaaattaactgggcatggtggtgcacgcatgtagtcccagctacttgggaggctgaggcaggagaattgcttgaacccaggagaaggaggtttcagtgagccaagatcgcgccactgcactccagcctggcaacagagtgagactccatctcaaaaaaaaaccaaaaaacaaacaaacaaaaggacaagaacaatgatgtagagagatgtgtgtttacctttccactccaaagctaagttggtggaggtatagaagtaatggaccatttttatgtagagacatttctcctttagggtagtatgtattgggtgctaggaatgattgttttgtcctcccttttcttatagccagcaagaagcaaaagaaaaagaaagagctgaacccagagcaaaagtcaaaagagaagctgaaaaggtagtaatcctgaatgtttatactgcaatgaaaggatgagattttgcagtatctctgtaaaaataactatggaattactgaaaccccagttgtgagggaactaggggttcatttagtccaggggttgagaaactttttcttaacagaacagatagcagatatttctgtttttgtggccatagaatctctgtcacaactactccacttggctgttgtgactgtaaaacagccctagactgtatacaaacatatgggcatggctgactccaatacaattttatttataaaaacaaacggctggccagatgttgctcacaggtcacagtttgcaaacccctgatttattctgttcccatatattaatattaagatttaaaattcagagaaaaagaagaacttgcatgtaaagttaatgggagtatgagtatcagtaccaatagcttcatatttcaaagttctggaacaatagaattcaatcctagacttcctgataccacagccagccttctttctagtacactatttgtttttggattaccacatttggtcaacacatgtgttccttgctttacctgtggttatattttggtgccagcatttaggaaaaagattaaaaagtagcatccccaaataatattttcttggattcaaaaaggctggctccaagtagtttattccaagttgtggtcatttccctgcccccatcaaagactattgagattaaaaataacctctaaagaagtatcgccctggaactctgtatgtttggcttgtttacagttgtattgcacagttgtaataattctaaatttaaaaataatagcagttcatatgaaaaatagattcactcttcaacatctacaagagaaaattcttcagtatgagctaatttctgatttcacattactactacagacaaactctcctctcattattttttcttttgctaaatataactagttaggggatctggcaatgaacctttaagcagagctaggagaaaaattccctctttcatcctcattgaatttcaacttgaactaaagaattcagaataaaatacaaaatcaattgtaattgccatttgtaattaactctttgaacttcagtgattgcttattctgtctcaatttctcacgtaaccctaaacaaggagtgtgcccagtcatcagagaactaagtttattgagagtcttgtgtatggttgcaggtttagtctggattttggggctatcaaggaaaaagaaatacagccaccttcttaagtcctttgtgtttaatataaattgaacactataactgccagaaaaaaaattctcaggtcattttctctctcttttttttttttctataaagcacttagtaggaacccagtaaactaatttcccagaagatactcaagctttctccttttcttttccttttaggagacatgcgatgaatttcggagacttttgcaaaatggaaaacttttctgcacaagagaaaatgatcctgtgcgtggcccagatggcaagacccatggcaacaagtgtgccatgtgtaaggcagtcttgtgagtgcacaaagaaaaccactactgtgggatggtggaattggggaagcaatgagccaggcaaataatatgtattgtgtttgtcctttccttacatgtaatagaaacagaaggttatctgtaaagcatttgaaataaatcttttctttataatggccaagattcacagttctagaaataaaataaatacaactaagctattacattctctgttagttctggggtagaccctgccagtagatcacacttccttgataaaattcttaagttatttgctatcaagtggatcctttctctggattatctcgcaactcatgttggaaagaaaacacacagattttaatgtcaaagtccttacctacattgttgaaaataacacattttcagaaaatgaaaagtaggtctttacacaaagtttggaagtacacctagaatatttaagtccttcaatagcatttaccaaacatctacaatgtacaatgtgtataatgtgtataatgattatacaaaggtgaatgaaatagataatcttctcagaaatcatatagtccactgatattagtcacagacgtaaggtaatataatacaaaggagggactgttgaatgaaaaatttgtctgtggtatgttacagtacttcaagaaagggataattaatagaaagttttatggtgggataaaactagaccttataatttggataaaatgtggacatgacagaaagtaatgagaggagaagaagggaacagcaagagtaaggatctaaaattaggaaaaaaacaagtcatttagtttagtcagaacttaccaactttatcaaccttgaatgcacaccagagatttcgaggtcaattctacatgtaatgggaagctgcaaaagttgttcagataggacagtaagtggcataaatattgttcctttaggaagattcatttgttagcagtaaacaggagaaaaagagaaagaaagtactaaacttaagaattgctactcatgtagagggaggagctgcaataaataacccaggaagaggcagctacgcagagcaaggaggtaggctagaaggcgagtggatcaaggtgggggatgctgtgaaggtgaagtcaatgtcatgtggtgacagctatgcaagctgaaggacagtaagcaattagagatgattccactgttttgtgtttgtttttttgtgaaaggtagaaaatccaggagaaagaatacatttggtagagaagataatgattttggggcctcttgaacattaggtattggcgataaacacagctggagatccccagtgaacatttatgaagtgttagttaattgctcaccttgtcttttttttttttttttcttatggagtcccactctgtcgtccacactgaagtgcagtggtgtgatctcagctcactgtaacttctgcctcctgggttcaagtgattctcctgccccagcctccctagtagctggggttacaggcatgtaccaccacgcctggctaattcttgtatttttagtagagacagtgttttgccatgttggccagactggtctcgaactcctgacctcagggatccactcacctcagccttccaaagtgctgagattacaggtgcaaaccaacacacccagctttactcaccttgtcttgtttatggtgatatatatgtggtgttcttttattttaatgagacccttcctggcaaaggactccatataatttatatttttatttttagagaaggcctgcagcatagtagatgttaactcaatgctcgataattctgtacatatgtgatttgttcatataatgagaaactcaaagaaatgcacaccactctctgtaatctattgttccctacctcccactttctaatttccagccagaaagaaaatgaggaaagaaagaggaaagaagaggaagatcagagaaatgctgcaggacatggttccagtggtggtggaggaggaaacactcaggtgagagcaacctctaatttcagtaactggggcgggctcaactccttgacaataggactgtgaatagcgtatatagtctatggtaaaggcagtgctaagtccttgagagaacagagaagtttctccttaaggttgcagggtaagatatcagcacattttcactgctctggggttcatttggatttctttacaccttgaaataattaacaatatgtaatgaccttatcccagtctcctgagccctctttatggtaatctagacctcatatcaataatcgttctcatcagtatcacatgctcttcattttctttcattattctttcttgccttggacagagccactttttttaggtgtcttttctgttgatccaaggcagcatgataggacaaaagagcacaggctttggagtcagattgggttatgattctgctcctactacctggacttgtgagacattgagtaaattacttcctctcactgaattctactttccctgatttagcagtactcttccagggataaaagaaaataatttaggcaaaggtttagcatgtttcttgaggcatttttaagtgtcagcatggcaatgttgcacataaggtcactccttgggtctctgaacacagtttcataaaattgcagtcgccttatttatctttttacaaccttggaatatcaaaaccatgtcttcacttccagatctgacaaaggcccaatatttacctttgataaactctggctattctgtttttttcccatcttttttgctttaggaggctgagttctcccttttaaggaatagccctgttgattagaattgtctgatagacattttgtgtgtcttgttcataacttggtcaaacctaccttccttgacattttgcataactttgggttttcctccagcatttttctctctcttctatctgcactagagacctgcacatttttttctgtataaggccagctaaatattttaagcaatgtgggctttgtgggtcatatgatgtctgctgcaactattttactctgccattgttgtgggaaagaagcaaaaaaataatatctgaataaatgagtgaggatgtgtttcagtaaaactttatgtgtaagaacaggaagcaggaaagatcttccctgtgggctatacaattgaaccttgaacaacatgggtttgaatttcccaggtccacttgtacttaattttttttcaaccaaacttagataaaaaatacaggatttgtgggatgtgaaacctgcatatatggagggctaactttttgtataggtgagttgtacagggccaactgacagacttcagtatacatggattttgatcctggaaccaatcccccaagtgtaccaaggggaaactgtagtttgctgacatttaatatatgctattaaattcagtcatatttataatttccttgtgtagatccttaaaagcaacattagtagccatgacaactcatctcttataattacaacatgggtgattctggtccccttttctctgcagatgccagacctagatgttaggggtttttttgtttgtttgtttgtttgagatggagtctcaccctgtcacccaggctggagtgcaatggagcaatcttggctcaccgcaacttctgcctcctgggttcaaacgattctcctgcctcagcctcccaagtagctgggattacaggcacccgccaccatgcccagctaatttttgtatttttagtagagacagtgtttcaccatgctgtccaggctggtcttgaactcctgacctcatgatccacccatcttggcctcccaaagtgctgggattacaggcatgagccaccgtacccggcaatgttatgtttcttataaagagaggtgaaagaacttctcttactcagactgttaaaacaatttactaagaatacagtagactaagtaatccaggggctcttcgttcttctctgttttcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattgtaagtatttctctcaacaggcatgtctaaaatatagtcacattcctcttgaatgaatggctatttctcatttgctatggctccttccatgcaaattattctttttgctaatttccaaatattctatttttttctcttgcgttctctaaggaacaatgagccttagcaagggcagctaaccaagtggctgatttctattgtattttctattacaattctgtgaactctaagtgctatcatgatagacccttgttctttattgtgccagaatcctaggaagactttgtcacggccatttggaatcattgaccagcacagttgaagaaagctgacttcttgtcatttgcacgggacacacttagtgcataatccagggtcaatatttgttaacaagatgaatattcacttttttctcctccagggaaagagaagcagagagaaaaaatgagtattctcgctccagatcaaatgggactggatcagaatcagggaaggtgagttattttttgggttttggcaagaatcgtctttctgtgagtcagcagttggcgatcaaaactatagaagaaggtgtcaacatgatcaagctagagcttgcccttagaaggtcaggagttaccaagttatcagtgactctcactgataacttgttcagtgaagaaacctaatgccaagtggacatctttaagtctgacactttacaaggcatttttataaattacagtttatttaattatttcaacagcctggtcaaatttggccttttaaccttatttcgtagatagggaaaatgaggttttgcaagtatactgggatttatttttgtttttgcattattttgctgctagtgtaagttactataagcagatgcgtaaaataacacacatttattatcttatatttctggattccataagttttaaatggtctgattgtgataaaaccaagatgttggtaatgccgcattcctttgtggaggctctaggtgaggatctgtttctttgctttctctaacttctagaagctacctgtattccttggcttgtggccacccttaagccagtgatggccagtcaagtccttcttatgctttatcattctcacactgactgtcctgccgctgcctctctctttaatgagtaagaacctttgtgattacatgggccccacttggataatccagggtaacttccccattttaaattcaactgattagcaatcttaattccatattcaaccataattcctccttgccacgtaaagcaacatatttggaggttccaggaattagaacatagacgtctctctctgtgggacattattttgcctatcacagcaaggttacatggctgcctgactcttggaaagaaatcctctgattctcaaatccaatcaaatattatgtaaaaacagcacttccaatataatcttcccatcttttcaggatacatgtgatgagtttagaagccaaatgaaaaatggaaaactcatctgcactcgagaaagtgaccctgtccggggtccagatggcaagacacatggcaataagtgtactatgtgtaaggaaaaactgtgagtatgtttcaaaatgagcttttgactgtgagtcttaaagtacaataatcatttcttaccagtttgggaaaatgacaattgttttagaagcagatctggtaattaatgaggcgtttgttcactttgattgaaatgtttcattgttttccccccagggaaagggaagcagctgaaaaaaaaaagaaagaggatgaagacaggagcaatacaggagaaaggagcaatacaggagaaaggagcaatgacaaagaggtaatagatgttagacacgctaatacctgaattcagttagttcattgtatggtatatttattcaacaaatatttgtgaaatgctgactctgtcccaatcattggtgatataacggtaaacaatgaagtcatggccagatcttgaaaataaatagcatgctcttcagttccccaggagtgactctgatgcaattgtagaaccagtgacaactgtcaaattattgtagttagccagtgaatttcatttttgaattttttctttcctttgagacagggtcttgctgttgctcaggatggtctcgaactcctgagctcaagcaatttgccggagctcaagtctcagcctcccaaagtgctgggattacatgagccatcgcactctgctgtttctgaattttttaaacaaataaatatcaagcaatcagatgccaaaaattacaaagaaaatcagtatcaaaaatttggagtttgaggccaggcacggtggctcaggcctataatcccagcactttgagaagctgaggcgggcagatcacgaggtcaggaaatcgagaccatcctggctagcacggtgaaaccccgtctctactaaaagtacaaaaaaattagccgggcacgatggcgggcgcctatagtcccagctacttaggaggctgaggcaggagaatggcgtgaacctgggaggcgagcttgcagtgagctgagatagcgccactgcacaccagcctgggcgacagagcaagactctgtctcaaaaaaaaaaaaaaaaaaaaaaaaggaaaagaaaaagaagaaaagttggagtttgagataataaattcttgatctggcatttcattgccacctagtgttcagttttggtccttataaatagtattcaacactacaacaccaacacgtagaatattacacagcacaatcttttaatgcaccgacggactccaattagaaaagataaatagcgaaatttccctgggaagatttttcctattagtagggcaacttttcattaagcctgtagtggctaaagaaaatgaaaccttattagtaattatcattatttaaaaatattttgggaatatctgttgtgtgttacggtagatgaaatggctttgagaaaataaccttattgcacaacttcacatgatctctaaaggacatctatttaaaatcttggtaaatttttaattttatgatccttatttaaaaaattttgaacagaaaaatgctatatatatttatatatagaaaatactgagtaaaaaaaaaataaagaaaatatggaggcagggtgtggtaactcactcttttaatcccagtgttttgggagaccagagcaagagaattgcttgagcccaggagttcaaaaccagcctgggcaacatagtgagaccctgtctctacaaaataataataattaaaaaaaaaatagccaggcatgatggtgcacacctgtaactctagctacttgggaggttaaggtgagaggatcacttgagcccatgaattcaaggcagcagtgagctatgatagcattattgcactccagcctgggcaacagagtaagaacttgtcttaaaaaaaaaataaaaatattgagattgtgtgtgagtgtgtgtgtgtgtgtgtgtgtgtcaaatagagaactaccgttttatctacacatgcaacgttaaataaggtttaccaataattatatttaaacctccccaaaatctattcagtggtgatattgttccaattttttagaattcaggaaaacttaagagaagtgaactacacataattaatgaatagaagagccaaagactgaattggagggttgcaatacagtcagaggagtgctattataaaaatatgtggtattgtgagcacctggaaaagaaaatacttccagtaatttgtgaaaatggtggttgtgagacatttaatatgttgataggtatttaattccagagaattttttaaaatgctgcaattaaaagtaaggcctggaattgtttgtttacggacatcacaatttaaagaaagaagggtaagtacaatctaggttactgtgttattttttaaggtaatgtttccatatcaccactttggctctttgggcttacaggaagttccagagacttctgtagctctctgaagattttagtacattctagatcctatctgtagactcggttctattggcttctttttatgatcattatgtttcaatgaacacaaaaggcagctccatatacttatccacacataggagttttattctctgacttgtaaaagcaaataagtaaaaaggtataacctggtggttagcaggtttctgatcacaaattcaacactgactttatttaatagctctgagatttatttttctcatctgtagaatggggatgatgcgtatttatcttataagatttttacaaccactaaaggaaatctattaaaccacacgataaagcacctcgcacaataatttttttttttttttttttggtaaattgtggttgagaaatgaagctgaaagtttacgtgtttttatgttttgccagaagagtgtcgtttagttcattccagggcttttgaagtagacttatgtgtggaatactgagtgcactcatagggagacaggtttggggctctgcctcatagaaaatggtattaaaatgagatgggacagggcactgggggctcatgcctgtaatctcagtgctttgggaggccaatgcgagaggatcacttgaggccaagagtttaagatcagcccaggcaacacagagagactcccgtctctacaaaaaattttaaaatattagccaggcatggtggcacatgcctgtagttctagctacttagcagactgaggtgggagtgttgcttgagcccaggagttggaggctgcaatgagctatgattgcaccactgcactccaggctggacaacagaacaagattatatatatataacaagattatattatatacataacaagattatatatatatatagatagatataatatattatatatatagatatatattatctatctatctatatatataatcttgttatatatatgtaatcttgttctgttgtccagcctggagtgcagtggtgcaatatatgtgtatatatatatatatatatatatatatataatcttgcttgcaatatatatatatatagtttttaaaggaatgggctgctttagtgaaattccattagggcaagacaatcatttgatagagatgcaatggagaagattcaaacttcttaggtagagattgaataaagtgcctttaaaacatatttcttctctgaaatttcacttctctgtttttttcctgtgttatgagtttatatctaatcggtcaatcatgttatcaggtttgaaagattataccatgacagtaacaactttttctgctactgttggtaggatctgtgtcgtgaatttcgaagcatgcagagaaatggaaagcttatctgcaccagagaaaataaccctgttcgaggcccatatggcaagatgcacatcaataaatgtgctatgtgtcagagcatcttgtacgtaaaaaggtttatcaataaatttgatagttgtgcctgtttgctagaaattagtttttgttacttttaaaacctaagatacttggcatcacacattaatgatatgatacctcctctcttttgaagagacaatttccaaagcactttcacaataatttttttattttgatgttgaaaagcataatcatacccagaacctctggggtaggaagaggtagcttatcagctaggtaacctgggacaggccagttcattgtgcagagcctcagttcctcctgagggaaaaatgactgaacaatatagttttgtggagattcaaggacattttaaaaatgtttatgaacttcaaagcattatacctacgtaaataacattcaaggacattttaaaaatgtttatgaacttcaaagcattatacctatgtaaataacaatcaatattgtgagtttggttataatttaattggaaaagtaaaaatgagaattatagcaactttctagatgagagtcttaagtctattatattaaggaaaaataaagaccttttaggatcatatttttctggataagagtatagtaacagcatctatgaaagttgatagcattgccacaaatatattatcatgaaaattccaacaatcagaactgattagcttataaaaatattcttagatttttttttaggtataagaaaacagtgttagatttgctaatgtttagaatcgcagaaatacttggttaaagacaattcagtaacaacccttgaaaaattaccctatctttttttttaattattctgcagtgatcgagaagctaatgaaagaaaaaagaaagatgaagagaaatcaagtagcaagccctcaaataatgcaaaggttatttattaaaggataccaaaataaccattttacttttcaccttcagaattttgcattcttctccagctttgggaataataaatatattaatatcttaact

SEQ ID NO: 2041 - DNA, 17236 bp, Homo sapiens
  source 1..17236: mol_type = genomic DNA
cctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtgagcgggccggggagcggcgggggcggtgacgcaggccggacacggcctcctgccgcggggtggctgccccctcccttctcggcgacgcctggcgggccgtgagggggtctgcgctggctgctccctggatggcggtggcctgcatgggtccccagttcggccatgggagccggcctggtgactggagtggtgaccaaggccgggacccgctgctcagcgtcggccccctggggcggtggagccctgccggccgggggctcgagcctgggggcgtcagacgccccgctccaccccccgcgctgttggggattttggcaaggacgcgccggggcgaacgctctggctctccgcgggcactgggtggtcaggcgggcactcgggttacactgacaccttgctgcgccaggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcacagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcatcaccttataaacgccatacataccttttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaaggtaaggggctgctctgggggctgcctgaagccagctcagcttgtactcagttccctgctgagtaaaaaacagggctcgatgttccaccaatgaaggggtcagcaatttgagggctgtttaagacagagacataggccaggtgtggctcacgcctgtaattccagcactttgggaggccgaggcgggcaggtcacctgaggtcaggagtttaagaacagcctggccaacatggtgaaaccttgtcgctactaaaaatacaaaaattagccgggtgtggtggtacatgcttctagtcccagctactcaggaggctgagacgagaatcacttaaacctggagagcggaggttgccatgagccgaaatcacatgactgtactccagcctaggcgacaaaaaaaaaaaaaaaaaaaaaaaaaaaaaaaaaaagacattttaagtgctgtgcctgacctgagaaagaggagtccatgttcactctagggatggggtctggtgccgtggtgcttgggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacagagggggaggactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgaggtgagcaggccctctgtgcaggcctggggtgggctcagggtggcaggaaccttgacccgctcactgcctgccgctctgctaattcctcccccagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcaggtgaggcttgtgttggaacctgcttctgattggtgacagtagtcaggcagcctgtgtgcagggcccttgtgcaaagcgtgtgtgcaaggcaagaattcaggataccccccaccttcctggtgccctacaatcacacaagaaccctgcaaagtggggtgtattctctccatttcccaaatggggaaactgaggtgcctaagtgcctgaggccacaaatttacctgcacagcccttcctacctcaggaggctgccctctcaaggtaccctgaggtgcaggcagggaggcccttccagcccaggggtctttgatgcactttgttctcttttgtgatggttgtcaggaagatcagagccaaagttgctgaagtcctttgaaacatagttataagtgaaagacttaccgttagctttgtagtctagatttttggattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccgggaacacagggaccttggcaagaaggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctcaaatcaacctttagtagtgctggaccacgggcaactcaaggttgaattccctgacaaaattctcgagctttctacatggagtgaagtcgaatcagctggcatttggttgggataatcccagtgagggagggtgaccagactgtggttgcaggtcttgcctgtcacctctgactgccctcctttggatgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtggggtgggtgaaggtgccacctgaccccaggcatgagctcaggctctgagacccctccctgctgggctttagaaagtgcctgttgcgtctggctaagggtctcgggtgggtgctgcagggttaggcatgcggcagtgagaatcagtgaatgaagccaacttctagttcaagatgacggtggatctgtgatggcagatggatcgctgggacacctgcatctctcgctagacgagtgagcttgtttttgtgactgcagtggcaggctgtgtccacccagcctgtccaaaggttgtgttcagtgtctgaaagaatgctgctaggaggggcgtccgaaccatgcctgctgcctcctgtggctacagggcgtgactgccatctgctccaactttgctcattccgatttttttttttttttgagatggagtcttgctctgtcacggaggctggagtgcagtggtgccatctctgctcactgcaacctccccctcctgggttcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagggtaaacagtggaacaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggatttgtctgggaggctgcccaggtgcttggggtcacactgtctcaagacccacctgtgctggtgcagcatctcggaactgaactggacgccccacttggcacagacaggaataatcttgcagatgctcagatgtctttttttttctgagacggagtctcgctctgttgcccaggctggagtgcagtggcacgatcttggctcctgggttcacgccattctcctgtctcagcctcccgagtagctgggaccacaggcgcccaccaccacgcccggctagttttttgtatttttagtagagacggggtttcaccttgttggccaggatggtctcgatatcctgacctcgtgatccacccgcctcagcctccccaagtgctgggattacaggcgtgagccactgcacccggccctcagatgtctttgagcactaaaagctaaaggcttaaagtggatagaattgctttctccgaactagggaggagcctgaagctctacaaacaaggaatatttcagtaaaatagactgagtggtttcagctgaggagagccagtggaggagcggcttagactgttgtggaagttagggctagtttctttctttatgaggaactataagctggatgactcacaggttaactgcctagaagggactgttcccagagcagggcccaaaggggaacgaacgagtcaacagctgcctcccggtggcagtgtgtgtagggtaagcggcagctttcatgtgaagtgccaaggccttttggttggggggctgagaacctgctgagggagccacaactgagacccaggctgctcctggctgggaggctacaggccccgaagccacagggcccctcctggtcgtgggatctttgataaaccgacacgcagaggctttgtgaggcagcagggcacggagcatcgtctagtcttttttttaagtgaaagcacatttcttaagaaagtaaaggaatacaagaatggctactccgtagacaaagtagcctgtccagtcttacgacaaggcctgaaaatctcacgctttcatcaccaagttggagagatcctaattctataatttctctgatctgcttacaggcgagtctcattacccatttacaaagcatatgggtattgattgtactattctttcaacttttcaacttttctgtttgtttcaaccttttttttttcttatctttttttttttttttttttttgagacagacttttgctcttgttgtccaggctggagtgcaatggtgtgatcttggctcactacaacctctgcctcccgggttcaagcgattctcctgcctcagcctttcccagtagctgggattacaggcatgcaccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaaggaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggtggggagtccctgctgagggaggttgaatgcccccagagaagtgtcctacagctcctgcctgccagacccccaggcaccctgcagagggaaagttagtgatggcgctggccccacagaaggcttcctgtcaaccttagtgcttcagtgggatcagacccctgggtcaccagccatctgaggaaagcccccacacatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagatagtttttttatctttcctctcctcctaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaacaaaacaaaaaacaaaaatgcaagatagtttcttggcaatgaggccattatcttctagattgaaagcggccctgacaatgactgagaaagaccccacagcaaagcttatcattgtcaagtgtcagaaccctgaggataaagaaagaggggcttctaaaactctaggttattgtaaatacttgggaatacaaagagcaaacaaacatgaacagctaggagacaatggaacaactgatgactccagaaatcagttaaaaaggcttttcggcctagaattcttttgtttttgaaaccgggtctcactgtcatctgggctggagagcagtggtacagttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaagcaattttctgcctcagcctcccgagtagctgggattacaggcacccgccaccatgcctggctaatttttatatttttagtagagatggggtttcaccatcttggccaggctggtcttgaactcctgacctcatgatctacctgccttcgtctcccaaagtgctgggattacaggcatgagccactgtgcccagccccgtgcccagctattttaaaatttttttgtagagatggggtcttgccatgctgcccaggccgattttgaactcctgggctcaagagatttctcatgttgttctcccaaagtgttaggattacatgcatgagtcactgtgcctggtccagcctagaattctatacccagctaaaacgatcaagtatcagggcagaacaaagttactttctggtatacagtcttaattattttaaccttggtttgaaccacatgaagagagaaacccaaaatgaagcacagaggtattaggaaacgggggacctaacaggacagagggtgaacgtaaagggggtcacagcatcacagcgcagcctctgcccagagagctgccagtcctggctggaacaggaggctgcacagcaagcggcactctctatggaaaacaccagaaccagtggggtctctgatccacttcacccttgtagaaaactatggagatgctgtgggagaacatagggaaagttagcaaatgcaaagagaaggcaggctgggtgcagtggctcatgcctgtaatccaagcactttgggaggccaaggcaggcagatcacctgaggtcaggagttcaagaccagcctggccaacatggtgaaaccccgtctctactaaaaatataaaaattagctgggcgtggtggcacgtgcctatagtcccagctactcgggaggctgaggcaggagaatcacttgaacctggtgggcagaggctgcagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttcttttttttttttgagatggagtcttgctctgtcaccaggctggagtgcagtggcgccaacttggctcactgcaacctccgcctcccaggttcaagcgattcttctgcctcggcctcccgagtaactgagactacaggcgattgccaccacgcccagctgattttttgtatttttagtagagacggggtttcaccatattagccagggtagtctcgatctcctgatctcgtgatccgcccgcctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcgtgagctgaaagggcacagggagagtttggggagtgggatgggggcagggagtgtgcaccacagcctttggcaactggtgactctaagctgtgggtgtggagacttttgacacatttaatttcaaaaatagtgcaggtgattctcccctctgtccctggtgagtcacgtgagcctggaggtgtgcaggttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttcgactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattgcggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgccaggagccagggccatggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttaggcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagaggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaaaccaaggtccgtgtgcacaacctgctgtgggccgccgctgtgtgtcttctctgccttagggcaggggatggcgagctatggcctatgggccaagagtagttcttatttttgtttatttatttatttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttgggggtaaggtcacagatcaacaggataagaatttttcttagtacagaacaaaatgaaaagtctcccatgtctacttctttccacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcgcggccaggcagaggcgctcctcacatcccagacagggcggcggggcagaggcgctccccacatctcagacgatgggtggccgggcagagacgctcctcactttccagactgggcagccaggcagaggggctcctcacattccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggcaccattgagcactgagtgaaccagactccgtctgcaatcccggcacctcgggaggccgaggctggcggatcactcgtggttaggagctggagaccagcccggccaacacagcgaaaccccgtctccaccaaaaaaacacgaaaaccagtcagtcgtggcggcgcgcacctgcaatcgcaggcactcggcaggctgaggcaagagaatcaggcagggaggttgcagtgagccgagatggcagcagtacagtccagctttggctcggcatcagagggagaccgtggagaaagagggagagggaaagctatatcattcttatgtctttgcatcatcatagcttagcatctactcataagtgagaacatatgatatttggtatccattcctgaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaa

SEQ ID NO: 2042 - DNA, 31690 bp, Homo sapiens
  source 1..31690: mol_type = genomic DNA
gcgtcggcttccggccgccttccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcgggtgcgcggcgggcgcccgcggggccgaggctgcatggcccgggggaccggggccggggcgcaggggtcggaaggcggcggcggcggcggcaggggccccggccccgggtcggggaggggcggggggcccggggccgggcggggaccgggccagggagcgcgccggccgcccctcagggcgcaagctttgtgccctgtactcagggaagaggaacaggctcagaagggcagaggcaggtatcaggctcactgcagatatcaggggcgcgggacactggcggcctcgcctccgcggcagggccgggccgggccgggctgggctgggctgggcggcgagagccgcggcccggcctggatctggggcctggatctggggccgccgcggagtcgacggcgcagggcggggcggcccggatttaaaggggccgcagcaccgccgtcgccggcgccgcgagggggtggggtgggggccggcggccgggatcccgatcggctcccgcagccccgcgtgggctcgtgcgagtcggcctcaggtaaggctggagtgggagtgcaggtcgaccgcagccggggcggggggcgggcggcgggggcggcgctccgggaccccggtacccttctcagcaacatctcctccgcgcgcggaccccgaccccattcgcacgttctcggggctctttcccgggcgtgaggggctctgggtggcgcgggggactgggcggttgaagccgggagcgaccgctgccttcgctgccgcccagggcgcttccccgctcaggagcttcctctgggcctctggacggaggcgcgcaggggcccgggaggcgggaacgatgggcctttctaggcggtatcagggccgatgctcgtggatgcagagcagtgaccagcccagaaccgtaccggcttcccggggcaggggcggcccgagagcgccgctaacgggagcaacgggccctgcccccggtggtgtaggggccacctcgccccgcccagcccagcccgatattgatgggggcccacgccttcattgtttttttgttgttgttgttttttgttgttttttgtttgtttgtttttgagacggagtctcgctctgttgcccaggctgcagtgcagtggcgcaatctcggctcactgcaccctccgcctcccgggttcaagcgattcccctgccccagcctcccgagtagctgggactacaggcggccgccaccacacctggctaatttttgtatttttagtagacacgaggtttcaccgtattggccaggctggtctcgaactcctgaccttgtgatccgcccgcctcggcctcacaaagtgctgggattacaggcgtgagccaccacgcacggcccatttgcgttctaatttcaggcgttcctcaatcctctgtggaaccaggaagggcgcaaattataaagggactggcccagcgccgcctctgggcaggctttgggcagcgcctggcccgctgccggcttggacctcccagacctaggggcccggttcctggtggaggctgcagggacctctgccccacccgcccgggggaggcccgaggggctggactcagactgagattgaatgcggctttgtcttcctagttcagccccggcccacacctggggctgagtggaatcgggagcttcgaggggtctggacagagagattgatgccaagaagggggtggccgagccagaggttgaagtgggctggatcctgaggccccctgttaaaggagagggctccccactcagtgctcctggaactttccgaactagagactgggacttataggagccttctagaggaaactgtcgtgttttcacaggtgtcttctatttgtggcaaaggataatggcttttcacttaggttgtgacataaagggccttagaaattgttaatgagttacttaatgttaaaacttagtcacccagaggccgggcgcggtggctcatgcctgtaatcccagcactttgtgaggccgaggcaggcgaatcacgaggtcaggagatcgagaccatcctggctaacacggtgaaaccccgtctctactaaaaaatacaaaaaattagccgggtgtggtggctcatgcctgtaatcccagcactctgagaggctaaggcaggaggatcatttgagctcatcagttcaagaccagcctgggcaacatagtgacacctcatctcattaaaaattttaaaacaaatttttttggatttttttgtaattttatttatttatttatttatttttagtttatcttatttttttttttgagacggagtcttgctctgtcgcccaggctggagtgcagtggcactatctgggctcactgcaagctccgcctcccaccttcaccccattctcctgcctcagcctcccgagtagctgggactacaggcacccaccaccacgctcggctgattttttgtatttttattagagacggggtttcaccgtgttagccaggatggtctcgatctcctgacctcgtgatctacctgcctcggcctcccaaaatgctgggattacaggcgtgagtcaccaccccggcctttttttttttttttttttttaagacggagtctcggtctgtcgcccaggttggagtgcagtggcaccatctcggctcactgcaacctcagcctcccaggttcaagcgattctcctgcctcagcctcccgagtagctgggattataggcgcccgccaccacgcctggctaatttttttttttttttttttttttttttttgagacagagtctcgctatgtcgcccaggctggagtgcgatggcagaatctcggcttactgcaacttccacctcctggatacaagcaattctgctgcctcatcctcctgagtagctgggattacaggtgcacggcaccaagcccggctaatttttttgtatttttagtagagatagggtgtcaccatgttggtcaggctggtctcaaactcctgacctcgtgatccacctgcttcagcctcccaaagtgctgggattacaggcatgagccactgcgcctggcccttttttttttttttttttttttttgaaacggagtcttgctccctggcccaggctggagtgcagttgagtgatctgggctcactgcaacctccgcttcccgggttcaagcgattctcctgcctcagccacctgagtagctgagattacaggcgtgtgctaccacacccggctaatttttatatttttagtagagatggggtttcaccatgttggtcaggctggtttcgaactcctgacctcaggtgatccacctgcctcagcctcccaaagtgctgggattacaggtgtgagccaccggcggcgcccagcctaatttttgtatttttagtagagatggggtttcaccatgttgtccaggctggtctccaactcctgacctcaggtgatctgctcactttggcccctcagagtgctgggattacaggcgtgagccaacgcaccgggccaacaatttttttttaatttaaatttaaatttttattttttaattttttattttactttaagttctagggtacatgtgcacaatttgcaggtttgttacatatgtatacatgtgcccggttggtatgctgcacccattaactcatcatttacattagatatatctcctaatgctatccctcccctcttcccccaccccacgacaggccccagtgtgtgacgttccccaccctgtgtccaagtgttctcattgttcaattcccacctatgagtgagaacatgcggtgtttggttttctgtccttgtgatagtttgctcagaatggtttccagcttcatccgtgtccctacaaaggacatgaactcattcttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatgggattgctgggtcaaatggcatttctagttctagatccctgaggaatcgctacactgacttccacaatggttgaactagtttacagtcccaccaacagtgtaaaagcattcctatttctccacatcctctccagcacctgttgtttcctgggtttttaatgattggcattctaactggtgtgagatgctatctcaatgtggttttgatttgcatttctctgatggccagtgatgctgagcattttttcatgtgtctgcgggccaacaatttttttaaggaaaaaaaaaaagtgactcagttgggcactgtggcctacgcctgtaatccaagtgagacagccaagtctaaaggggtcccgctttgggaggccgagacgggcggatcacgaggtcaggagaccgagaccatcttagctaacacggtgaaaccccgtctctactaaaaattagccgggagtggtggcgggcacctgtagtcccagctactcgggaggctgaggcaggagaatagcttcaacctgtgaggcggagctttcagtgagccgagatcgcaccactgcactccagcctgggcgacagagcgagactccgtctcaaaaaaaaaaagaggtccaggagaaactcccacacctgcctaagcactggaagaactgggtagagccacagaagctctgcaggggggaggagctttgcagggggaggagctatgcagggggaggagctatgcagggggaggagcatgcagggggaggagctatgcagggggaggagctatgcaggggggaggagcttggtctcatgttcggggtggaacttgggattctatctgggaggcgagaaaccagctagcgggactctctctcgctttgctgagagtccctgtttccctttttttccttcttgcccaataaattccatttttctcactcttcaaagtgtctgcgagattaatctctcatggccgctgcacaagaacctggcttttagctgaactaaggagaaagtcctacaacagtttggcgtgcaacatggggcttgagaaagggtgagtgagatgcaaaccaagaaatttttttcctctctttctaagcctatttatcttcggacttctgagggggaggggaggggaaaccgtgaccccacccccttggtctccgtggccttttccttacttctggacggatgggcgaacggcggttctctgtcgcccaggctggagtgcagtggcgccatctcggctcactgcaagctccacctcccgggttcacaccattctcctgcctcagcctcctgagtagctgggactacaggcgcccgccaccacgcccggctgattttttgtatttttagtagagacggggtttcaccgtgttagccaggatggtctcgatctcctgacttcatgatccgcccgcctcggcctcccaaagtgctgggattacaggcgtgagccaccgcgcccacccctccatgaagaaagtttttctaaatgaaaaatgtttaggacgctcaggagagaaagaacagattaaggaatgatctccaccgcacagacctcaaggctgttatgcatgcagggcacagttccagtgcaaatgtccgcaggcacggcatgagggcccccactgggtgcctcgggctccttccagggcagcagttgaagcgggtcgtactgcaggcctgcagaaaggctggggttcctctccttttcgggttccttcctgatggaatcctaggttttcagcggttccttcctgatggaatcctaggttttcagcagcttccggaggccgcctggactgcagaaggcgccctgggcgtgtgtacttccacctccgcaggcgctggcatctccaggctgcttcaggccgctttggacctcaccatcggtagcatctgcgtcttcttgaggtgactggagcccgtctatggtttcagccattgacttctggacatggaagtgtcgaggccatttttggcccctctcatatccgggaagggctccgtgcccagtagaggtgcagtgcagcagccagctcgcagcagtgctcccgtagagctgatggcattggcaggagtggcggctcagcacagggaagttctccagtgcccaggcccaggcttgctctcggtttaggtcccatggcacgtggggctctggacctgcctgcctccaagacagctcttccaaggttgagggttggaactccacagcctcagcctcccaaagcttgaccaggcccagccatagctagtctaggaaaagagcaaatggccgtgtttttatattttgacttttgcatttcaatattaatttttttggtaatgtaatgcattcaaaacatggtccccccccccccaaaaaaaaaagaaaagaaaaagaaaaaagcatgtttctaaccaggggtccttcatcttctgcagatgccaagggtgtccctggcacagtaaaagtttggaagccctgccctaaagcctcacctcacctggcagctgggtgtttcattcatagcaaatgttctgtatattcaccatgtaccaaacacacatgtcactaatgatacaaacacatgtgcactgacattgacctcctcactgtcttactatagtcccatccacagccaccttatcagagtccatgggactctgacaacttgtaatgggaaaattaaccgtgcctgtaggggccgcctgggtagcgggaggtggttcatgagtaccaggaaagctggccctggggcagacctgggcagggcagagcacagcttgcaggacctagtacacagtgttgggaattgaatttgggttttgacctttgaagctgtgcataaagtctaaaacaagaagaggagtggaggctgaggttgtatttgtattttaaaatgagcatttgccacacaaagccaggagcttcagaccagcgtggttaacacagcgagaccctcctctctgtgagaaattaaaaaaaaaacaataataaaagccaggcatgttggcatgtacctgtagtcctagctgctcagggggtgaggcgggaggatcacttgactcctgggttacagtgagctctaattgccactgcacttcagcctgggccacagagtgagaccttttctcaaaataaaataaaatataaccttttgggcaggcatggaaaggggctggagagaataagaggaaacagagataagccccctccctgggagcacaagggactcatccccagacatggcaccacaggcaaacagacactgtcacaaaactagcatattatctttcctagaagtcctttgttttccccaagtgccctttcccccaaccttttgttggtttacgagctctcaattctaacctcctagtacacgaataaaaatgtctatcggggtggtggcgtgagcctgtagtcccaggtacttgagaggcagaggtgggaggatcctctgaccataagagttcctgaccagcctgtgcaatactgactccatctcaaacaaaaaacagaaagctatacaactccgtttctcttgctaatttgtcttttgtcagtttaatttgcaggccccagatgctgaatctaagagggcagaggaaaagcttttcctccctgacataaccatccaggagaaagtctggaatggagggtcagaggggtagggaatggagttaggagaagtagatagattcaggacagtctttggagaatgtacatcactgaggtcaagatgtcctagggaatggcccttctgggttcacaattctgcttccgtcggttaacagcaacttagtcccttctatgcctgtggggataatcagtcaggataggctggattatgctgctctaacaaccccaaatttctctgatctaataaaagtatactcaaagctgtatacccttcaagggtcccctggggtctctgctcattgtagttcctgccctggctacaggcataaccatgtggaaatcaaaggctttcttggcaaagagaaagagagctctagaagctttagcactggcaaataaataaatgcttggcgtataggtgatatatggctcttctggctcaggtccttggccagaattaatcacatggtctcacctcaagggaacaggtgagttaaatgcagaaaaatattcaagctgggtgaggtggctcacgcctctaatcccagcactttaggaggccgaggcgggaggatcgcttgagcccaagaagatcatggttgccgtgatccatgatcataccacggcactccagactggggaccaaagtgagaccttgtctctaaaaattaaaatatttagaatgtttcctagcataaaagatgtgctacgtgtgtattattactgttgctattgccagaaagtacaatcaacaggaactgctggtggcttgagggggagcatatggtcatagctgactcccaggtttctggcttgtattgtgactgtttctggcctgtattgtgaccatcactgccatcaggaaccctagagcaggtcgggtgtggtggctcacgcctgtaatcccagtactttgggaggctgaggtgggtggatcacttgaggccaagagttcaagaccagcctggccaacatggtgaaaccccgtctctactaaaaatacaaaaattagccagatatggtggtgggcgcctgtaatcccagctacttgggaggctgaggcacaagaattgcttgaatccgagaggtggaggttgcagtgagcagagatcaagccactgtaccccagcctgggcaacagagcaagactctgtctcgaaaaaaaaaaagaaaagaaaacctggagcaggcatggggtatacgtcatgggtcactactcttggatacaattgacgaaaaccacaatcaactggcttaagccgttttataacccagcattaggccagcctggatccaggggtcagatactgagatcaagctttgatctgctcaggattcccccctccccaaggctcctgcttccagatgaccccagtgtgcatttcgtccgccagcgtgggtcacatgtccatccctgaccagggtgctacagtgctctggttggccaagctttggccatggggtttacctcaccctacttttacgcaagagtatgtggtggcctaacacaggtgggggaccctgcttcaataccagcctttatccacagatgaccccacgccttctgctccagagcatcagggttataacacatgggacacacggggcacacatacactcccacgcaacatccacacaccccacaaaactacctgagcccacatagtcagggcagggacaggcacagaacaaagtgggtgcacagggactcgcagggaggtcgaagagctgagtctcgtcgggaggctgagggggaagagcgggcactgggctgcgagtgtgcagagctggaggtgggggactgcggtaagtacccgtcctggggtgcgggccctgctgggaagcattgggagcaagaagggttagatcctcaaaggaggataattcttccagaaggttttctttgttttgttttgttttgttgaggcaccaagattggagtgcagtggcgccatgtcagctcactgcaacctccgcctccgaggctcaagcaattctcttgcctcagcctcccgactagctgggactacaggcacctgccgccacgcccaactaatttttttaatttttagtacagatggggtttcactctgttggccaggctggtctcgaactcctgacctcgtgatccgcccacctcggcctcccagtgctgggactacaggtgtgagccaccgcgcctggcctcttccagaaggttttcgatggcagcaggtggaggggagcgagagggccatcgctcctgctgcaagggcagcccctccacgggatcccacactcctgacccgttcagtatagacggggtactcccggtgcggcctgtcaccgctctgtctggcgctggcgctcctagagaaggccatgccgacctctcccccacctcgctccagattccccttcttgagctgcttttcccacagtccccccaggcgccactgagagcctcccgtcttcgatgggcttggggcgcctggacccttccggggtcactttgccgtcttcctccagcccccctccctactccttgtcgccgcccccccgtcttttcaggaccttgcgcactcaggctggccctatgctttggggtaccccagcagtgcccccgggtctccggccacccggtgacggagggagggagaggctggcgagggggcggcgccttaggtcccagcgcgacccgcctctcagcccctcccgccggctacagccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtctcctccccacgggcggcccgcgccccgtcttccagtgacccccacatcccttgcgccccgagctggaacttcggcaggttctgccccgggccgcgcgcgctttctggggaccagggctgtggttcctgctccgcgtcgtgcctttagacaccgccgggcgttcgtcctccatccctccccccttttccccactccgcggttgacgagggccgcccccaagtggccatgtcccccggcatggacgacccctcagtgcccctgagggcccagggtctcgcccccgtcccgaggcaggccatgtttgaatttatttggagaaattcgcccagcccaggggacctctttctgcagctctggccttccagtaggagagggtccctggggctctcaggcctgacaacttggcatcactgaattctctaaccatgtctgtccatgacttgaactccttttcttttagaaagatctttgcaaaccccttgtgggcgtgcccctcccatggcccccgtgcctcttgcctgggctttgggcttgtctgaaagggctaaaagggggtgatgcctggccgggcgggtggctcacgcctgcagtcccagcactttgggaggccgaggtgggcggatcacctgaagtcaggagttcaagaccatcctggccaacatagtgaaacccatctctactaaaaatacaaaaattagcaaggcttggtggcaggcacctgtagtcccagctacttgggaggctgaggcaggagcaggagaattgcttgaacctgggaggcagaggttgcagtgagctgagatcgtgccactgcacttcagcctgggtgacagagagagactgtctcaaaaaaaaaaaaaaaaaaaaaaaaaaaagtgatgtccagtgcctggggatttttcctagggagtggtcaaggaaggccccgctgaggaggagacatttagggtgggaagttgccatgtagggcaggagtggaaagggttttggaccagagggagagccagggaaaagtcaccaggtagaatgagctggcatgattaggaagatggcaagggagggctgtggccctcccatgtgagtggaagggagtggctgcagcgcagaaggcctggaggcccccgcacagaccaggacctctgtagaggaactcatcccctgtgtcccctgtgattgtcaatctccctaaagatggcccagagcagtgcggcctgaatccctcagtggccttgtctctggctgccccagcacccacgcggacacttgactccacgccccaaagaaaagaagcgaacctgggaacaccactgccaaggcataggattatttgggaggggggaagggggaactgaggaggtggttacaacatgctgggcagcaacagacagaaccagaccacccctgtggctgccccggctggtctcctgggaccactgggcgcttggctcaggcctctcctgccctccccactcttccacctcagcccccctgcagtctctgtcctgccctgaccccccagcttacagccccaaaagcagctaaacaactcgcacacccacggggcatcgcctgggagggcagcccaaatccttccacttcagccccatttgaaagatgaggaaatgagaggctggtccatagtgggtctcgcggctcaggtgccgagccttccctgggcatgcacgccgggccctggagggtgggaaggggccagtggacgcggggagcctgcggggtgggactgcatcgggaaaggggaaggagtcagaggcgagaagggggagagtgtctgtctggctccagccgctgcacgctcttcctgctcaggggactcacggtgaccccggagccactccccagcccagcctccaggtaagaggtcactgagatgggtggcagcaggggccggggatccccctattacgacagcggtcatgggacgctgactcactgccggccagaccacctgacctccgcggcgggaggagagggccctgccagggggttcccgccgcgccttgtttacctccgggaggcctcggcctcgcgtgggggcagggcggccgctggggccgcaaggcgtgcggggaagggccagagccgggtgtccaccccagcttcccaaagactccctcttctgtgcttccttctcccctccccgccccccccccagtctcttcacatgcccctagcccccgcggaaacttcccgcgatcccaaacgggccaaatggcgagaaagcaaaggagctccttcttgggggtgagtggggcgccttgagcgcttcctcaaagctatgttcccagagccacaggccttccttgtgtccctcaccctgctcagaccgggccatagccgggggctggggcaggaaagccggccctcggcgggggccacgtggctctcaggcgcctgggctgctgagtcacgcttggccagcacctgtctgtaggccacagcctctgccagcacgcccctctgtgtcccctgcccctgtctgcaaggcagtggctccagcaggccctggggcattttccactctccaccgccggatgcagggagaggcctgaaccctctccacagggctgctctgggcagggtggaagccttgcccacttcggagccctccgggaaggatcattcacacctgtggaccagcccctgctgtgcgcacacccacacatcaccttcgcacctgactggccccatccagccactcttgcctccctctgggtttcctcccctgggaggtttctccagctcctgcaagccctgggctgaaatggcatgagttggacccagcaggttctgacctcctactcacaggaccttgcctgggaggctccagagggtgaccactcgtcctgcccctctccttgccccagttctggcggacaggttactctggtggcataaagcagtgtttcttccttcctagctgaggaggctgttggctgacccccttggctgcccacaaggccaacgggcctgagcccccacagggccatgggcattacctgctgaattgaggagcccataaggagtcacttggaccacagtgaacacttggcgaccactgacactcaggagaccttagctggtcctccagcacctctcaactccactcctactaaactgggaacttctctggtgctcaggccagagtcggggtccgtcaccgagtatgctatgcgctgcccatcaccgaggatgccatgcgctgtaagagggctgccaccgcggcaggctgaccatggcagggtcggaacagcaacctgagagccagcttgttctggccagcagtgcccactgggcgacctagcagcctcctgatatgggggctgtgtccccctctccctgcactgggtacccccaactgaggatattgctgagtcatggccaggcccaagcctgggaggggcgaggggctggacccccgccagtaccctgatcccaggtgcagaggctggagcccaggcctgtatgagtgccagggccggtttcctggggtccttggtgcaccggggcaatgaagagaggggtcagcaatgagggggccgggagacctggagcgaggggtagcggggaaggggagagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtgagcgggccggggagcggcgggggcggtgacgcaggccggacacggcctcctgccgcggggtggctgccccctcccttctcggcgacgcctggcgggccgtgagggggtctgcgctggctgctccctggatggcggtggcctgcatgggtccccagttcggccatgggagccggcctggtgactggagtggtgaccaaggccgggacccgctgctcagcgtcggccccctggggcggtggagccctgccggccgggggctcgagcctgggggcgtcagacgccccgctccaccccccgcgctgttggggattttggcaaggacgcgccggggcgaacgctctggctctccgcgggcactgggtggtcaggcgggcactcgggttacactgacaccttgctgcgccaggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcacagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcatcaccttataaacgccatacataccttttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaaggtaaggggctgctctgggggctgcctgaagccagctcagcttgtactcagttccctgctgagtaaaaaacagggctcgatgttccaccaatgaaggggtcagcaatttgagggctgtttaagacagagacataggccaggtgtggctcacgcctgtaattccagcactttgggaggccgaggcgggcaggtcacctgaggtcaggagtttaagaacagcctggccaacatggtgaaaccttgtcgctactaaaaatacaaaaattagccgggtgtggtggtacatgcttctagtcccagctactcaggaggctgagacgagaatcacttaaacctggagagcggaggttgccatgagccgaaatcacatgactgtactccagcctaggcgacaaaaaaaaaaaaaaaaaaaaaaaaaaaaaaaaaaagacattttaagtgctgtgcctgacctgagaaagaggagtccatgttcactctagggatggggtctggtgccgtggtgcttgggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacagagggggaggactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgaggtgagcaggccctctgtgcaggcctggggtgggctcagggtggcaggaaccttgacccgctcactgcctgccgctctgctaattcctcccccagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcaggtgaggcttgtgttggaacctgcttctgattggtgacagtagtcaggcagcctgtgtgcagggcccttgtgcaaagcgtgtgtgcaaggcaagaattcaggataccccccaccttcctggtgccctacaatcacacaagaaccctgcaaagtggggtgtattctctccatttcccaaatggggaaactgaggtgcctaagtgcctgaggccacaaatttacctgcacagcccttcctacctcaggaggctgccctctcaaggtaccctgaggtgcaggcagggaggcccttccagcccaggggtctttgatgcactttgttctcttttgtgatggttgtcaggaagatcagagccaaagttgctgaagtcctttgaaacatagttataagtgaaagacttaccgttagctttgtagtctagatttttggattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccgggaacacagggaccttggcaagaaggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctcaaatcaacctttagtagtgctggaccacgggcaactcaaggttgaattccctgacaaaattctcgagctttctacatggagtgaagtcgaatcagctggcatttggttgggataatcccagtgagggagggtgaccagactgtggttgcaggtcttgcctgtcacctctgactgccctcctttggatgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtggggtgggtgaaggtgccacctgaccccaggcatgagctcaggctctgagacccctccctgctgggctttagaaagtgcctgttgcgtctggctaagggtctcgggtgggtgctgcagggttaggcatgcggcagtgagaatcagtgaatgaagccaacttctagttcaagatgacggtggatctgtgatggcagatggatcgctgggacacctgcatctctcgctagacgagtgagcttgtttttgtgactgcagtggcaggctgtgtccacccagcctgtccaaaggttgtgttcagtgtctgaaagaatgctgctaggaggggcgtccgaaccatgcctgctgcctcctgtggctacagggcgtgactgccatctgctccaactttgctcattccgatttttttttttttttgagatggagtcttgctctgtcacggaggctggagtgcagtggtgccatctctgctcactgcaacctccccctcctgggttcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagggtaaacagtggaacaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggatttgtctgggaggctgcccaggtgcttggggtcacactgtctcaagacccacctgtgctggtgcagcatctcggaactgaactggacgccccacttggcacagacaggaataatcttgcagatgctcagatgtctttttttttctgagacggagtctcgctctgttgcccaggctggagtgcagtggcacgatcttggctcctgggttcacgccattctcctgtctcagcctcccgagtagctgggaccacaggcgcccaccaccacgcccggctagttttttgtatttttagtagagacggggtttcaccttgttggccaggatggtctcgatatcctgacctcgtgatccacccgcctcagcctccccaagtgctgggattacaggcgtgagccactgcacccggccctcagatgtctttgagcactaaaagctaaaggcttaaagtggatagaattgctttctccgaactagggaggagcctgaagctctacaaacaaggaatatttcagtaaaatagactgagtggtttcagctgaggagagccagtggaggagcggcttagactgttgtggaagttagggctagtttctttctttatgaggaactataagctggatgactcacaggttaactgcctagaagggactgttcccagagcagggcccaaaggggaacgaacgagtcaacagctgcctcccggtggcagtgtgtgtagggtaagcggcagctttcatgtgaagtgccaaggccttttggttggggggctgagaacctgctgagggagccacaactgagacccaggctgctcctggctgggaggctacaggccccgaagccacagggcccctcctggtcgtgggatctttgataaaccgacacgcagaggctttgtgaggcagcagggcacggagcatcgtctagtcttttttttaagtgaaagcacatttcttaagaaagtaaaggaatacaagaatggctactccgtagacaaagtagcctgtccagtcttacgacaaggcctgaaaatctcacgctttcatcaccaagttggagagatcctaattctataatttctctgatctgcttacaggcgagtctcattacccatttacaaagcatatgggtattgattgtactattctttcaacttttcaacttttctgtttgtttcaaccttttttttttcttatctttttttttttttttttttttgagacagacttttgctcttgttgtccaggctggagtgcaatggtgtgatcttggctcactacaacctctgcctcccgggttcaagcgattctcctgcctcagcctttcccagtagctgggattacaggcatgcaccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaaggaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggtggggagtccctgctgagggaggttgaatgcccccagagaagtgtcctacagctcctgcctgccagacccccaggcaccctgcagagggaaagttagtgatggcgctggccccacagaaggcttcctgtcaaccttagtgcttcagtgggatcagacccctgggtcaccagccatctgaggaaagcccccacacatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagatagtttttttatctttcctctcctcctaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaacaaaacaaaaaacaaaaatgcaagatagtttcttggcaatgaggccattatcttctagattgaaagcggccctgacaatgactgagaaagaccccacagcaaagcttatcattgtcaagtgtcagaaccctgaggataaagaaagaggggcttctaaaactctaggttattgtaaatacttgggaatacaaagagcaaacaaacatgaacagctaggagacaatggaacaactgatgactccagaaatcagttaaaaaggcttttcggcctagaattcttttgtttttgaaaccgggtctcactgtcatctgggctggagagcagtggtacagttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaagcaattttctgcctcagcctcccgagtagctgggattacaggcacccgccaccatgcctggctaatttttatatttttagtagagatggggtttcaccatcttggccaggctggtcttgaactcctgacctcatgatctacctgccttcgtctcccaaagtgctgggattacaggcatgagccactgtgcccagccccgtgcccagctattttaaaatttttttgtagagatggggtcttgccatgctgcccaggccgattttgaactcctgggctcaagagatttctcatgttgttctcccaaagtgttaggattacatgcatgagtcactgtgcctggtccagcctagaattctatacccagctaaaacgatcaagtatcagggcagaacaaagttactttctggtatacagtcttaattattttaaccttggtttgaaccacatgaagagagaaacccaaaatgaagcacagaggtattaggaaacgggggacctaacaggacagagggtgaacgtaaagggggtcacagcatcacagcgcagcctctgcccagagagctgccagtcctggctggaacaggaggctgcacagcaagcggcactctctatggaaaacaccagaaccagtggggtctctgatccacttcacccttgtagaaaactatggagatgctgtgggagaacatagggaaagttagcaaatgcaaagagaaggcaggctgggtgcagtggctcatgcctgtaatccaagcactttgggaggccaaggcaggcagatcacctgaggtcaggagttcaagaccagcctggccaacatggtgaaaccccgtctctactaaaaatataaaaattagctgggcgtggtggcacgtgcctatagtcccagctactcgggaggctgaggcaggagaatcacttgaacctggtgggcagaggctgcagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttcttttttttttttgagatggagtcttgctctgtcaccaggctggagtgcagtggcgccaacttggctcactgcaacctccgcctcccaggttcaagcgattcttctgcctcggcctcccgagtaactgagactacaggcgattgccaccacgcccagctgattttttgtatttttagtagagacggggtttcaccatattagccagggtagtctcgatctcctgatctcgtgatccgcccgcctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcgtgagctgaaagggcacagggagagtttggggagtgggatgggggcagggagtgtgcaccacagcctttggcaactggtgactctaagctgtgggtgtggagacttttgacacatttaatttcaaaaatagtgcaggtgattctcccctctgtccctggtgagtcacgtgagcctggaggtgtgcaggttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttcgactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattgcggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgccaggagccagggccatggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttaggcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagaggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaaaccaaggtccgtgtgcacaacctgctgtgggccgccgctgtgtgtcttctctgccttagggcaggggatggcgagctatggcctatgggccaagagtagttcttatttttgtttatttatttatttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttgggggtaaggtcacagatcaacaggataagaatttttcttagtacagaacaaaatgaaaagtctcccatgtctacttctttccacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcgcggccaggcagaggcgctcctcacatcccagacagggcggcggggcagaggcgctccccacatctcagacgatgggtggccgggcagagacgctcctcactttccagactgggcagccaggcagaggggctcctcacattccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggcaccattgagcactgagtgaaccagactccgtctgcaatcccggcacctcgggaggccgaggctggcggatcactcgtggttaggagctggagaccagcccggccaacacagcgaaaccccgtctccaccaaaaaaacacgaaaaccagtcagtcgtggcggcgcgcacctgcaatcgcaggcactcggcaggctgaggcaagagaatcaggcagggaggttgcagtgagccgagatggcagcagtacagtccagctttggctcggcatcagagggagaccgtggagaaagagggagagggaaagctatatcattcttatgtctttgcatcatcatagcttagcatctactcataagtgagaacatatgatatttggtatccattcctgaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaa

SEQ ID NO: 2043 - DNA, 31075 bp, Homo sapiens
  source 1..31075: mol_type = genomic DNA
ggatttaaaggggccgcagcaccgccgtcgccggcgccgcgagggggtggggtgggggccggcggccgggatcccgatcggctcccgcagccccgcgtgggctcgtgcgagtcggcctcaggtaaggctggagtgggagtgcaggtcgaccgcagccggggcggggggcgggcggcgggggcggcgctccgggaccccggtacccttctcagcaacatctcctccgcgcgcggaccccgaccccattcgcacgttctcggggctctttcccgggcgtgaggggctctgggtggcgcgggggactgggcggttgaagccgggagcgaccgctgccttcgctgccgcccagggcgcttccccgctcaggagcttcctctgggcctctggacggaggcgcgcaggggcccgggaggcgggaacgatgggcctttctaggcggtatcagggccgatgctcgtggatgcagagcagtgaccagcccagaaccgtaccggcttcccggggcaggggcggcccgagagcgccgctaacgggagcaacgggccctgcccccggtggtgtaggggccacctcgccccgcccagcccagcccgatattgatgggggcccacgccttcattgtttttttgttgttgttgttttttgttgttttttgtttgtttgtttttgagacggagtctcgctctgttgcccaggctgcagtgcagtggcgcaatctcggctcactgcaccctccgcctcccgggttcaagcgattcccctgccccagcctcccgagtagctgggactacaggcggccgccaccacacctggctaatttttgtatttttagtagacacgaggtttcaccgtattggccaggctggtctcgaactcctgaccttgtgatccgcccgcctcggcctcacaaagtgctgggattacaggcgtgagccaccacgcacggcccatttgcgttctaatttcaggcgttcctcaatcctctgtggaaccaggaagggcgcaaattataaagggactggcccagcgccgcctctgggcaggctttgggcagcgcctggcccgctgccggcttggacctcccagacctaggggcccggttcctggtggaggctgcagggacctctgccccacccgcccgggggaggcccgaggggctggactcagactgagattgaatgcggctttgtcttcctagttcagccccggcccacacctggggctgagtggaatcgggagcttcgaggggtctggacagagagattgatgccaagaagggggtggccgagccagaggttgaagtgggctggatcctgaggccccctgttaaaggagagggctccccactcagtgctcctggaactttccgaactagagactgggacttataggagccttctagaggaaactgtcgtgttttcacaggtgtcttctatttgtggcaaaggataatggcttttcacttaggttgtgacataaagggccttagaaattgttaatgagttacttaatgttaaaacttagtcacccagaggccgggcgcggtggctcatgcctgtaatcccagcactttgtgaggccgaggcaggcgaatcacgaggtcaggagatcgagaccatcctggctaacacggtgaaaccccgtctctactaaaaaatacaaaaaattagccgggtgtggtggctcatgcctgtaatcccagcactctgagaggctaaggcaggaggatcatttgagctcatcagttcaagaccagcctgggcaacatagtgacacctcatctcattaaaaattttaaaacaaatttttttggatttttttgtaattttatttatttatttatttatttttagtttatcttatttttttttttgagacggagtcttgctctgtcgcccaggctggagtgcagtggcactatctgggctcactgcaagctccgcctcccaccttcaccccattctcctgcctcagcctcccgagtagctgggactacaggcacccaccaccacgctcggctgattttttgtatttttattagagacggggtttcaccgtgttagccaggatggtctcgatctcctgacctcgtgatctacctgcctcggcctcccaaaatgctgggattacaggcgtgagtcaccaccccggcctttttttttttttttttttttaagacggagtctcggtctgtcgcccaggttggagtgcagtggcaccatctcggctcactgcaacctcagcctcccaggttcaagcgattctcctgcctcagcctcccgagtagctgggattataggcgcccgccaccacgcctggctaatttttttttttttttttttttttttttttgagacagagtctcgctatgtcgcccaggctggagtgcgatggcagaatctcggcttactgcaacttccacctcctggatacaagcaattctgctgcctcatcctcctgagtagctgggattacaggtgcacggcaccaagcccggctaatttttttgtatttttagtagagatagggtgtcaccatgttggtcaggctggtctcaaactcctgacctcgtgatccacctgcttcagcctcccaaagtgctgggattacaggcatgagccactgcgcctggcccttttttttttttttttttttttttgaaacggagtcttgctccctggcccaggctggagtgcagttgagtgatctgggctcactgcaacctccgcttcccgggttcaagcgattctcctgcctcagccacctgagtagctgagattacaggcgtgtgctaccacacccggctaatttttatatttttagtagagatggggtttcaccatgttggtcaggctggtttcgaactcctgacctcaggtgatccacctgcctcagcctcccaaagtgctgggattacaggtgtgagccaccggcggcgcccagcctaatttttgtatttttagtagagatggggtttcaccatgttgtccaggctggtctccaactcctgacctcaggtgatctgctcactttggcccctcagagtgctgggattacaggcgtgagccaacgcaccgggccaacaatttttttttaatttaaatttaaatttttattttttaattttttattttactttaagttctagggtacatgtgcacaatttgcaggtttgttacatatgtatacatgtgcccggttggtatgctgcacccattaactcatcatttacattagatatatctcctaatgctatccctcccctcttcccccaccccacgacaggccccagtgtgtgacgttccccaccctgtgtccaagtgttctcattgttcaattcccacctatgagtgagaacatgcggtgtttggttttctgtccttgtgatagtttgctcagaatggtttccagcttcatccgtgtccctacaaaggacatgaactcattcttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatgggattgctgggtcaaatggcatttctagttctagatccctgaggaatcgctacactgacttccacaatggttgaactagtttacagtcccaccaacagtgtaaaagcattcctatttctccacatcctctccagcacctgttgtttcctgggtttttaatgattggcattctaactggtgtgagatgctatctcaatgtggttttgatttgcatttctctgatggccagtgatgctgagcattttttcatgtgtctgcgggccaacaatttttttaaggaaaaaaaaaaagtgactcagttgggcactgtggcctacgcctgtaatccaagtgagacagccaagtctaaaggggtcccgctttgggaggccgagacgggcggatcacgaggtcaggagaccgagaccatcttagctaacacggtgaaaccccgtctctactaaaaattagccgggagtggtggcgggcacctgtagtcccagctactcgggaggctgaggcaggagaatagcttcaacctgtgaggcggagctttcagtgagccgagatcgcaccactgcactccagcctgggcgacagagcgagactccgtctcaaaaaaaaaaagaggtccaggagaaactcccacacctgcctaagcactggaagaactgggtagagccacagaagctctgcaggggggaggagctttgcagggggaggagctatgcagggggaggagctatgcagggggaggagcatgcagggggaggagctatgcagggggaggagctatgcaggggggaggagcttggtctcatgttcggggtggaacttgggattctatctgggaggcgagaaaccagctagcgggactctctctcgctttgctgagagtccctgtttccctttttttccttcttgcccaataaattccatttttctcactcttcaaagtgtctgcgagattaatctctcatggccgctgcacaagaacctggcttttagctgaactaaggagaaagtcctacaacagtttggcgtgcaacatggggcttgagaaagggtgagtgagatgcaaaccaagaaatttttttcctctctttctaagcctatttatcttcggacttctgagggggaggggaggggaaaccgtgaccccacccccttggtctccgtggccttttccttacttctggacggatgggcgaacggcggttctctgtcgcccaggctggagtgcagtggcgccatctcggctcactgcaagctccacctcccgggttcacaccattctcctgcctcagcctcctgagtagctgggactacaggcgcccgccaccacgcccggctgattttttgtatttttagtagagacggggtttcaccgtgttagccaggatggtctcgatctcctgacttcatgatccgcccgcctcggcctcccaaagtgctgggattacaggcgtgagccaccgcgcccacccctccatgaagaaagtttttctaaatgaaaaatgtttaggacgctcaggagagaaagaacagattaaggaatgatctccaccgcacagacctcaaggctgttatgcatgcagggcacagttccagtgcaaatgtccgcaggcacggcatgagggcccccactgggtgcctcgggctccttccagggcagcagttgaagcgggtcgtactgcaggcctgcagaaaggctggggttcctctccttttcgggttccttcctgatggaatcctaggttttcagcggttccttcctgatggaatcctaggttttcagcagcttccggaggccgcctggactgcagaaggcgccctgggcgtgtgtacttccacctccgcaggcgctggcatctccaggctgcttcaggccgctttggacctcaccatcggtagcatctgcgtcttcttgaggtgactggagcccgtctatggtttcagccattgacttctggacatggaagtgtcgaggccatttttggcccctctcatatccgggaagggctccgtgcccagtagaggtgcagtgcagcagccagctcgcagcagtgctcccgtagagctgatggcattggcaggagtggcggctcagcacagggaagttctccagtgcccaggcccaggcttgctctcggtttaggtcccatggcacgtggggctctggacctgcctgcctccaagacagctcttccaaggttgagggttggaactccacagcctcagcctcccaaagcttgaccaggcccagccatagctagtctaggaaaagagcaaatggccgtgtttttatattttgacttttgcatttcaatattaatttttttggtaatgtaatgcattcaaaacatggtccccccccccccaaaaaaaaaagaaaagaaaaagaaaaaagcatgtttctaaccaggggtccttcatcttctgcagatgccaagggtgtccctggcacagtaaaagtttggaagccctgccctaaagcctcacctcacctggcagctgggtgtttcattcatagcaaatgttctgtatattcaccatgtaccaaacacacatgtcactaatgatacaaacacatgtgcactgacattgacctcctcactgtcttactatagtcccatccacagccaccttatcagagtccatgggactctgacaacttgtaatgggaaaattaaccgtgcctgtaggggccgcctgggtagcgggaggtggttcatgagtaccaggaaagctggccctggggcagacctgggcagggcagagcacagcttgcaggacctagtacacagtgttgggaattgaatttgggttttgacctttgaagctgtgcataaagtctaaaacaagaagaggagtggaggctgaggttgtatttgtattttaaaatgagcatttgccacacaaagccaggagcttcagaccagcgtggttaacacagcgagaccctcctctctgtgagaaattaaaaaaaaaacaataataaaagccaggcatgttggcatgtacctgtagtcctagctgctcagggggtgaggcgggaggatcacttgactcctgggttacagtgagctctaattgccactgcacttcagcctgggccacagagtgagaccttttctcaaaataaaataaaatataaccttttgggcaggcatggaaaggggctggagagaataagaggaaacagagataagccccctccctgggagcacaagggactcatccccagacatggcaccacaggcaaacagacactgtcacaaaactagcatattatctttcctagaagtcctttgttttccccaagtgccctttcccccaaccttttgttggtttacgagctctcaattctaacctcctagtacacgaataaaaatgtctatcggggtggtggcgtgagcctgtagtcccaggtacttgagaggcagaggtgggaggatcctctgaccataagagttcctgaccagcctgtgcaatactgactccatctcaaacaaaaaacagaaagctatacaactccgtttctcttgctaatttgtcttttgtcagtttaatttgcaggccccagatgctgaatctaagagggcagaggaaaagcttttcctccctgacataaccatccaggagaaagtctggaatggagggtcagaggggtagggaatggagttaggagaagtagatagattcaggacagtctttggagaatgtacatcactgaggtcaagatgtcctagggaatggcccttctgggttcacaattctgcttccgtcggttaacagcaacttagtcccttctatgcctgtggggataatcagtcaggataggctggattatgctgctctaacaaccccaaatttctctgatctaataaaagtatactcaaagctgtatacccttcaagggtcccctggggtctctgctcattgtagttcctgccctggctacaggcataaccatgtggaaatcaaaggctttcttggcaaagagaaagagagctctagaagctttagcactggcaaataaataaatgcttggcgtataggtgatatatggctcttctggctcaggtccttggccagaattaatcacatggtctcacctcaagggaacaggtgagttaaatgcagaaaaatattcaagctgggtgaggtggctcacgcctctaatcccagcactttaggaggccgaggcgggaggatcgcttgagcccaagaagatcatggttgccgtgatccatgatcataccacggcactccagactggggaccaaagtgagaccttgtctctaaaaattaaaatatttagaatgtttcctagcataaaagatgtgctacgtgtgtattattactgttgctattgccagaaagtacaatcaacaggaactgctggtggcttgagggggagcatatggtcatagctgactcccaggtttctggcttgtattgtgactgtttctggcctgtattgtgaccatcactgccatcaggaaccctagagcaggtcgggtgtggtggctcacgcctgtaatcccagtactttgggaggctgaggtgggtggatcacttgaggccaagagttcaagaccagcctggccaacatggtgaaaccccgtctctactaaaaatacaaaaattagccagatatggtggtgggcgcctgtaatcccagctacttgggaggctgaggcacaagaattgcttgaatccgagaggtggaggttgcagtgagcagagatcaagccactgtaccccagcctgggcaacagagcaagactctgtctcgaaaaaaaaaaagaaaagaaaacctggagcaggcatggggtatacgtcatgggtcactactcttggatacaattgacgaaaaccacaatcaactggcttaagccgttttataacccagcattaggccagcctggatccaggggtcagatactgagatcaagctttgatctgctcaggattcccccctccccaaggctcctgcttccagatgaccccagtgtgcatttcgtccgccagcgtgggtcacatgtccatccctgaccagggtgctacagtgctctggttggccaagctttggccatggggtttacctcaccctacttttacgcaagagtatgtggtggcctaacacaggtgggggaccctgcttcaataccagcctttatccacagatgaccccacgccttctgctccagagcatcagggttataacacatgggacacacggggcacacatacactcccacgcaacatccacacaccccacaaaactacctgagcccacatagtcagggcagggacaggcacagaacaaagtgggtgcacagggactcgcagggaggtcgaagagctgagtctcgtcgggaggctgagggggaagagcgggcactgggctgcgagtgtgcagagctggaggtgggggactgcggtaagtacccgtcctggggtgcgggccctgctgggaagcattgggagcaagaagggttagatcctcaaaggaggataattcttccagaaggttttctttgttttgttttgttttgttgaggcaccaagattggagtgcagtggcgccatgtcagctcactgcaacctccgcctccgaggctcaagcaattctcttgcctcagcctcccgactagctgggactacaggcacctgccgccacgcccaactaatttttttaatttttagtacagatggggtttcactctgttggccaggctggtctcgaactcctgacctcgtgatccgcccacctcggcctcccagtgctgggactacaggtgtgagccaccgcgcctggcctcttccagaaggttttcgatggcagcaggtggaggggagcgagagggccatcgctcctgctgcaagggcagcccctccacgggatcccacactcctgacccgttcagtatagacggggtactcccggtgcggcctgtcaccgctctgtctggcgctggcgctcctagagaaggccatgccgacctctcccccacctcgctccagattccccttcttgagctgcttttcccacagtccccccaggcgccactgagagcctcccgtcttcgatgggcttggggcgcctggacccttccggggtcactttgccgtcttcctccagcccccctccctactccttgtcgccgcccccccgtcttttcaggaccttgcgcactcaggctggccctatgctttggggtaccccagcagtgcccccgggtctccggccacccggtgacggagggagggagaggctggcgagggggcggcgccttaggtcccagcgcgacccgcctctcagcccctcccgccggctacagccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtctcctccccacgggcggcccgcgccccgtcttccagtgacccccacatcccttgcgccccgagctggaacttcggcaggttctgccccgggccgcgcgcgctttctggggaccagggctgtggttcctgctccgcgtcgtgcctttagacaccgccgggcgttcgtcctccatccctccccccttttccccactccgcggttgacgagggccgcccccaagtggccatgtcccccggcatggacgacccctcagtgcccctgagggcccagggtctcgcccccgtcccgaggcaggccatgtttgaatttatttggagaaattcgcccagcccaggggacctctttctgcagctctggccttccagtaggagagggtccctggggctctcaggcctgacaacttggcatcactgaattctctaaccatgtctgtccatgacttgaactccttttcttttagaaagatctttgcaaaccccttgtgggcgtgcccctcccatggcccccgtgcctcttgcctgggctttgggcttgtctgaaagggctaaaagggggtgatgcctggccgggcgggtggctcacgcctgcagtcccagcactttgggaggccgaggtgggcggatcacctgaagtcaggagttcaagaccatcctggccaacatagtgaaacccatctctactaaaaatacaaaaattagcaaggcttggtggcaggcacctgtagtcccagctacttgggaggctgaggcaggagcaggagaattgcttgaacctgggaggcagaggttgcagtgagctgagatcgtgccactgcacttcagcctgggtgacagagagagactgtctcaaaaaaaaaaaaaaaaaaaaaaaaaaaagtgatgtccagtgcctggggatttttcctagggagtggtcaaggaaggccccgctgaggaggagacatttagggtgggaagttgccatgtagggcaggagtggaaagggttttggaccagagggagagccagggaaaagtcaccaggtagaatgagctggcatgattaggaagatggcaagggagggctgtggccctcccatgtgagtggaagggagtggctgcagcgcagaaggcctggaggcccccgcacagaccaggacctctgtagaggaactcatcccctgtgtcccctgtgattgtcaatctccctaaagatggcccagagcagtgcggcctgaatccctcagtggccttgtctctggctgccccagcacccacgcggacacttgactccacgccccaaagaaaagaagcgaacctgggaacaccactgccaaggcataggattatttgggaggggggaagggggaactgaggaggtggttacaacatgctgggcagcaacagacagaaccagaccacccctgtggctgccccggctggtctcctgggaccactgggcgcttggctcaggcctctcctgccctccccactcttccacctcagcccccctgcagtctctgtcctgccctgaccccccagcttacagccccaaaagcagctaaacaactcgcacacccacggggcatcgcctgggagggcagcccaaatccttccacttcagccccatttgaaagatgaggaaatgagaggctggtccatagtgggtctcgcggctcaggtgccgagccttccctgggcatgcacgccgggccctggagggtgggaaggggccagtggacgcggggagcctgcggggtgggactgcatcgggaaaggggaaggagtcagaggcgagaagggggagagtgtctgtctggctccagccgctgcacgctcttcctgctcaggggactcacggtgaccccggagccactccccagcccagcctccaggtaagaggtcactgagatgggtggcagcaggggccggggatccccctattacgacagcggtcatgggacgctgactcactgccggccagaccacctgacctccgcggcgggaggagagggccctgccagggggttcccgccgcgccttgtttacctccgggaggcctcggcctcgcgtgggggcagggcggccgctggggccgcaaggcgtgcggggaagggccagagccgggtgtccaccccagcttcccaaagactccctcttctgtgcttccttctcccctccccgccccccccccagtctcttcacatgcccctagcccccgcggaaacttcccgcgatcccaaacgggccaaatggcgagaaagcaaaggagctccttcttgggggtgagtggggcgccttgagcgcttcctcaaagctatgttcccagagccacaggccttccttgtgtccctcaccctgctcagaccgggccatagccgggggctggggcaggaaagccggccctcggcgggggccacgtggctctcaggcgcctgggctgctgagtcacgcttggccagcacctgtctgtaggccacagcctctgccagcacgcccctctgtgtcccctgcccctgtctgcaaggcagtggctccagcaggccctggggcattttccactctccaccgccggatgcagggagaggcctgaaccctctccacagggctgctctgggcagggtggaagccttgcccacttcggagccctccgggaaggatcattcacacctgtggaccagcccctgctgtgcgcacacccacacatcaccttcgcacctgactggccccatccagccactcttgcctccctctgggtttcctcccctgggaggtttctccagctcctgcaagccctgggctgaaatggcatgagttggacccagcaggttctgacctcctactcacaggaccttgcctgggaggctccagagggtgaccactcgtcctgcccctctccttgccccagttctggcggacaggttactctggtggcataaagcagtgtttcttccttcctagctgaggaggctgttggctgacccccttggctgcccacaaggccaacgggcctgagcccccacagggccatgggcattacctgctgaattgaggagcccataaggagtcacttggaccacagtgaacacttggcgaccactgacactcaggagaccttagctggtcctccagcacctctcaactccactcctactaaactgggaacttctctggtgctcaggccagagtcggggtccgtcaccgagtatgctatgcgctgcccatcaccgaggatgccatgcgctgtaagagggctgccaccgcggcaggctgaccatggcagggtcggaacagcaacctgagagccagcttgttctggccagcagtgcccactgggcgacctagcagcctcctgatatgggggctgtgtccccctctccctgcactgggtacccccaactgaggatattgctgagtcatggccaggcccaagcctgggaggggcgaggggctggacccccgccagtaccctgatcccaggtgcagaggctggagcccaggcctgtatgagtgccagggccggtttcctggggtccttggtgcaccggggcaatgaagagaggggtcagcaatgagggggccgggagacctggagcgaggggtagcggggaaggggagagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtgagcgggccggggagcggcgggggcggtgacgcaggccggacacggcctcctgccgcggggtggctgccccctcccttctcggcgacgcctggcgggccgtgagggggtctgcgctggctgctccctggatggcggtggcctgcatgggtccccagttcggccatgggagccggcctggtgactggagtggtgaccaaggccgggacccgctgctcagcgtcggccccctggggcggtggagccctgccggccgggggctcgagcctgggggcgtcagacgccccgctccaccccccgcgctgttggggattttggcaaggacgcgccggggcgaacgctctggctctccgcgggcactgggtggtcaggcgggcactcgggttacactgacaccttgctgcgccaggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcacagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcatcaccttataaacgccatacataccttttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaaggtaaggggctgctctgggggctgcctgaagccagctcagcttgtactcagttccctgctgagtaaaaaacagggctcgatgttccaccaatgaaggggtcagcaatttgagggctgtttaagacagagacataggccaggtgtggctcacgcctgtaattccagcactttgggaggccgaggcgggcaggtcacctgaggtcaggagtttaagaacagcctggccaacatggtgaaaccttgtcgctactaaaaatacaaaaattagccgggtgtggtggtacatgcttctagtcccagctactcaggaggctgagacgagaatcacttaaacctggagagcggaggttgccatgagccgaaatcacatgactgtactccagcctaggcgacaaaaaaaaaaaaaaaaaaaaaaaaaaaaaaaaaaagacattttaagtgctgtgcctgacctgagaaagaggagtccatgttcactctagggatggggtctggtgccgtggtgcttgggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacagagggggaggactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgaggtgagcaggccctctgtgcaggcctggggtgggctcagggtggcaggaaccttgacccgctcactgcctgccgctctgctaattcctcccccagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcaggtgaggcttgtgttggaacctgcttctgattggtgacagtagtcaggcagcctgtgtgcagggcccttgtgcaaagcgtgtgtgcaaggcaagaattcaggataccccccaccttcctggtgccctacaatcacacaagaaccctgcaaagtggggtgtattctctccatttcccaaatggggaaactgaggtgcctaagtgcctgaggccacaaatttacctgcacagcccttcctacctcaggaggctgccctctcaaggtaccctgaggtgcaggcagggaggcccttccagcccaggggtctttgatgcactttgttctcttttgtgatggttgtcaggaagatcagagccaaagttgctgaagtcctttgaaacatagttataagtgaaagacttaccgttagctttgtagtctagatttttggattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccgggaacacagggaccttggcaagaaggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctcaaatcaacctttagtagtgctggaccacgggcaactcaaggttgaattccctgacaaaattctcgagctttctacatggagtgaagtcgaatcagctggcatttggttgggataatcccagtgagggagggtgaccagactgtggttgcaggtcttgcctgtcacctctgactgccctcctttggatgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtggggtgggtgaaggtgccacctgaccccaggcatgagctcaggctctgagacccctccctgctgggctttagaaagtgcctgttgcgtctggctaagggtctcgggtgggtgctgcagggttaggcatgcggcagtgagaatcagtgaatgaagccaacttctagttcaagatgacggtggatctgtgatggcagatggatcgctgggacacctgcatctctcgctagacgagtgagcttgtttttgtgactgcagtggcaggctgtgtccacccagcctgtccaaaggttgtgttcagtgtctgaaagaatgctgctaggaggggcgtccgaaccatgcctgctgcctcctgtggctacagggcgtgactgccatctgctccaactttgctcattccgatttttttttttttttgagatggagtcttgctctgtcacggaggctggagtgcagtggtgccatctctgctcactgcaacctccccctcctgggttcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagggtaaacagtggaacaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggatttgtctgggaggctgcccaggtgcttggggtcacactgtctcaagacccacctgtgctggtgcagcatctcggaactgaactggacgccccacttggcacagacaggaataatcttgcagatgctcagatgtctttttttttctgagacggagtctcgctctgttgcccaggctggagtgcagtggcacgatcttggctcctgggttcacgccattctcctgtctcagcctcccgagtagctgggaccacaggcgcccaccaccacgcccggctagttttttgtatttttagtagagacggggtttcaccttgttggccaggatggtctcgatatcctgacctcgtgatccacccgcctcagcctccccaagtgctgggattacaggcgtgagccactgcacccggccctcagatgtctttgagcactaaaagctaaaggcttaaagtggatagaattgctttctccgaactagggaggagcctgaagctctacaaacaaggaatatttcagtaaaatagactgagtggtttcagctgaggagagccagtggaggagcggcttagactgttgtggaagttagggctagtttctttctttatgaggaactataagctggatgactcacaggttaactgcctagaagggactgttcccagagcagggcccaaaggggaacgaacgagtcaacagctgcctcccggtggcagtgtgtgtagggtaagcggcagctttcatgtgaagtgccaaggccttttggttggggggctgagaacctgctgagggagccacaactgagacccaggctgctcctggctgggaggctacaggccccgaagccacagggcccctcctggtcgtgggatctttgataaaccgacacgcagaggctttgtgaggcagcagggcacggagcatcgtctagtcttttttttaagtgaaagcacatttcttaagaaagtaaaggaatacaagaatggctactccgtagacaaagtagcctgtccagtcttacgacaaggcctgaaaatctcacgctttcatcaccaagttggagagatcctaattctataatttctctgatctgcttacaggcgagtctcattacccatttacaaagcatatgggtattgattgtactattctttcaacttttcaacttttctgtttgtttcaaccttttttttttcttatctttttttttttttttttttttgagacagacttttgctcttgttgtccaggctggagtgcaatggtgtgatcttggctcactacaacctctgcctcccgggttcaagcgattctcctgcctcagcctttcccagtagctgggattacaggcatgcaccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaaggaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggtggggagtccctgctgagggaggttgaatgcccccagagaagtgtcctacagctcctgcctgccagacccccaggcaccctgcagagggaaagttagtgatggcgctggccccacagaaggcttcctgtcaaccttagtgcttcagtgggatcagacccctgggtcaccagccatctgaggaaagcccccacacatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagatagtttttttatctttcctctcctcctaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaacaaaacaaaaaacaaaaatgcaagatagtttcttggcaatgaggccattatcttctagattgaaagcggccctgacaatgactgagaaagaccccacagcaaagcttatcattgtcaagtgtcagaaccctgaggataaagaaagaggggcttctaaaactctaggttattgtaaatacttgggaatacaaagagcaaacaaacatgaacagctaggagacaatggaacaactgatgactccagaaatcagttaaaaaggcttttcggcctagaattcttttgtttttgaaaccgggtctcactgtcatctgggctggagagcagtggtacagttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaagcaattttctgcctcagcctcccgagtagctgggattacaggcacccgccaccatgcctggctaatttttatatttttagtagagatggggtttcaccatcttggccaggctggtcttgaactcctgacctcatgatctacctgccttcgtctcccaaagtgctgggattacaggcatgagccactgtgcccagccccgtgcccagctattttaaaatttttttgtagagatggggtcttgccatgctgcccaggccgattttgaactcctgggctcaagagatttctcatgttgttctcccaaagtgttaggattacatgcatgagtcactgtgcctggtccagcctagaattctatacccagctaaaacgatcaagtatcagggcagaacaaagttactttctggtatacagtcttaattattttaaccttggtttgaaccacatgaagagagaaacccaaaatgaagcacagaggtattaggaaacgggggacctaacaggacagagggtgaacgtaaagggggtcacagcatcacagcgcagcctctgcccagagagctgccagtcctggctggaacaggaggctgcacagcaagcggcactctctatggaaaacaccagaaccagtggggtctctgatccacttcacccttgtagaaaactatggagatgctgtgggagaacatagggaaagttagcaaatgcaaagagaaggcaggctgggtgcagtggctcatgcctgtaatccaagcactttgggaggccaaggcaggcagatcacctgaggtcaggagttcaagaccagcctggccaacatggtgaaaccccgtctctactaaaaatataaaaattagctgggcgtggtggcacgtgcctatagtcccagctactcgggaggctgaggcaggagaatcacttgaacctggtgggcagaggctgcagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttcttttttttttttgagatggagtcttgctctgtcaccaggctggagtgcagtggcgccaacttggctcactgcaacctccgcctcccaggttcaagcgattcttctgcctcggcctcccgagtaactgagactacaggcgattgccaccacgcccagctgattttttgtatttttagtagagacggggtttcaccatattagccagggtagtctcgatctcctgatctcgtgatccgcccgcctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcgtgagctgaaagggcacagggagagtttggggagtgggatgggggcagggagtgtgcaccacagcctttggcaactggtgactctaagctgtgggtgtggagacttttgacacatttaatttcaaaaatagtgcaggtgattctcccctctgtccctggtgagtcacgtgagcctggaggtgtgcaggttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttcgactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattgcggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgccaggagccagggccatggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttaggcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagaggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaaaccaaggtccgtgtgcacaacctgctgtgggccgccgctgtgtgtcttctctgccttagggcaggggatggcgagctatggcctatgggccaagagtagttcttatttttgtttatttatttatttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttgggggtaaggtcacagatcaacaggataagaatttttcttagtacagaacaaaatgaaaagtctcccatgtctacttctttccacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcgcggccaggcagaggcgctcctcacatcccagacagggcggcggggcagaggcgctccccacatctcagacgatgggtggccgggcagagacgctcctcactttccagactgggcagccaggcagaggggctcctcacattccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggcaccattgagcactgagtgaaccagactccgtctgcaatcccggcacctcgggaggccgaggctggcggatcactcgtggttaggagctggagaccagcccggccaacacagcgaaaccccgtctccaccaaaaaaacacgaaaaccagtcagtcgtggcggcgcgcacctgcaatcgcaggcactcggcaggctgaggcaagagaatcaggcagggaggttgcagtgagccgagatggcagcagtacagtccagctttggctcggcatcagagggagaccgtggagaaagagggagagggaaagctatatcattcttatgtctttgcatcatcatagcttagcatctactcataagtgagaacatatgatatttggtatccattcctgaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaa

SEQ ID NO: 2044 - DNA, 6428 bp, Homo sapiens
  source 1..6428: mol_type = genomic DNA
ttctggtcagggttcacatttaattagctcaacaacagaaaatcttttgttttcgtagtttttggatttcaaaaaatggataagagactgtaatctgttttctgcgtttgcagtcttcatactgtgatggaaataatggttatgttacaacagaacttcagtctaacagtttctcatcttttaatactatttatggtaaatacatatatataacttacttgcaatttaaattacaaaattcatatacaaagtaagcaaaaaggcacacataagaaatccaccttgaccacagaaatgtgaaaacaccagccctaatgaccaagacaatgtttcaaagacaacaaacaccaagaaaagttgagattctacaataaatcatattaaacgcaagcactatgatgcacagacgtgagcactgaatatttactaaagcataaaacttaggaaaaatcattttacggggaatctattcatattccaaacagcattttaaaaaacattaaacttagcttagttttaaaaacaaaattcagacccaaacaatcaagaaccagaaaatgggtttcttaccttttgtttccagtaggatgtgggctgaacagcaaggtgggttattcaatctgatgttatgaaaagtaattgcttcttaaagagacttaagtttttccttggttagaaaataattataggctccctaaaatattctaaggggacataaatagggagaagagggggaaattccaagacagcttttgtagtttcaaaagggtgtaactttcttctaataattgccaatacggatagagacctaaaggtccattttctgagactataaataggagcagtccatacttcccatcacagcttttagctgtctggtcatcttaactacaaaacctatgcccctttacctaagtaaacattagatcctctctaatcttcaaattcagcctgtataacaaggaatactgtctcatttcaatgtgaggttagaattactataacttttagtagagcacatctttcaactttaaacactcaaacttgagtgaaggccatttacattttttggtcatttccaaaacattcaatgaacacaaatgaaccaaagtttacttaagtctagctcacattaaccttccaaaattatcattaatcatttattttccctttaataatctgatgaatttttaaaatgttctacacataaaacttcttagaatttcaagaatgtcatgtaaaattattcaaatttttaaacagtaaatctgccttttggccattacattgaattcttagataaaaagagctacatccttaaacttacactaagtacttagtgaaattctgcattcaacttaacatcccctcttcccaacattccacaacgttcattaaaatctaccgattggggtgaccttacacatttcttccactaccaagatttctggttttccttaggtttttaattgtcacccaaataatcaccttaaattcaacttccaactatgattagcacccaagggaaatgttaaagtctatttattttaggtcccctcccccaacctaaatagtaccaaggggctgtcagtagacaaatacaagaagtagcaggctaaaagtttttaactgctttggtagagaacaccaaagtttttggtacaaaataatcttatggttggagaagggcttataaggcaaaattctaaatgcccagctttttattaacaatgattcatccaaagaagcagttaatcttgtgcactcttccctttcaaaaaagaaatgagacttgggttaaaagttctacaggctgagcatggtggctcacacctgtaatcctaacactttgggaggccaaggcaggcagatcacttgaggccaggagttttgggaccagcctgggtaacacagagaaaccacatctctactaaaaatacaaaattagccgggcaagggtggcacacacttgtagtctcagctacttgggagactgaggcacgagaatcactcaaatccaggggtggaggttgcagtgagcctagatcacaccactgccctccagtctggagaacagagcgagactctgtctcaaaaacaaaaaacagttctaatacatctgtgctgatgttaacatttaatacttacctttttttgagatgagtttcattgagaatatcaaaagctatctccaagtgaacattagtagccatcaaccaattttgcacaaaagcctatgttgtctatgaccaccagaaaataagcagcatctatagttttttaaccactttataacaaagtagagaagcttatctttcagatgctagatccatcccccaccgtcatttaccaagttacatacacaaatgccttattctccccttttgctttcccctgaagacttttacaattaacaataaaagatggctaataccattagattgccttttaagaacttttaatttgctaacacattaacacaagagtcaaaatcttatcttacttaacaatttaaagattaactgatagacccagttagaatcttacatgaagaggaaaaaggacaaccatgcatagttttttaaaaaatgtttattttttcaaagaaaacggcaatagccaattggaaacctacttattcttcaactccaattttgttttctttaaatttagaagtgacttactgatttactattttaaacaaaccccccctttcccctttaaatgtttaccatctactcgtgctgaatccttccaaggagattgctccagcgtttatctccaggtcctcgctttgctccttttaccaaaaaacgcaaaacacaattccatcgtgcatcttaagggctccaatcgtcaaaaataggaaaaaaaaaatctttggaatagccaattaagttgaataaaaaaatccacacgaatgcggtttggttggggcaggaatccactcctatgttcctggtaatctgatcccgctccatgaatcctggtaattcatcctccctatcctatccacattatgatttgaatccaatgatccagctccaaggattgggatccagtgagccctctccaatccaaacctttataaccagcaaaaccaaaaaagaggaggcaaaatgttagatactgtaatcaaaaaaggtttctggggaatgatgagttatgtctgtcatcagtttaacagatgcacatcaataactatcaaattccccaaaacaagtttctgaatggtgttcagataaattttagaaacttaatcatcatagagactaattggaagaagcattttgtatttacagttcaactgataatgccaacacttgttactgtacagcgtattacaggtttcgtggttgcaagaagttacgtaatttaagtttactggcattgctacccacctaagtctaaaactaaatctaatgctcccatttgcaatttaatttgtaaattaaagtcttttaaacatatgaaccaattatgaatattagtttaaaggggaaggtgagacttaaaagtattcccaactagattatctacaccaatacattggaactctatattttgctttcattttgtcttaaaaaaatgaaatagcaacgctctatcagtcacacagaggacatgcagatttagcagtattgatattatactctatcttgttggatttaaaaacaccctgtacccacatgtacaccaacagcaggtcacacattaacagttgtaactaagcactgtgacaaattagccagttcttcccacattagtccctattaaaacaaaaatggggggaagggagcaaaataagttgctacaaaatgggcaatataattttgccacaattgccaaggtttaaaaagcaaagcaattgtagctaaagacaactgaataaaatgtttgcaagtgttttaaggaaaatgtatataatcatttttaacccctgccttttagtataaggtcaatactgccaatttcatctgtgacaatagcacttggagtcataccattgcctccattattgatctgatcctcctcaatcctccttttgacaatcctaaaatgattgaaatgtgctccacaatccttaatccaaagcattcttaatccatctcttcagatatgtctacagaaagacacatgaaaagcaagataaacataagaacttccccaggtaagataaccacaaacacccccaacatcccagttcacacaaaccagggcagatagacatttacacaatatcacagtctgaagagtatggagttaactaaatttaaacaatcctgtctatgacatcacttaaaatacaatttatcaaagacacgaagggaatgtagatgttaggagcaaggggatattacaagaatgcaattcaacactttagcccattctgaacaaaacagtttgaattaaaaaatgaaaagattgtactgaataaaggaaaactgtatacaacatgggttctacaaaaagtgtcaccaatcatcttatgtacgagagcgagatctgctatgacggggagaatagcgtggtgatcctctgcttctccttggggagtaactgcgactcctgctgttgcttctgctacggcttctgctacgactacggcttcgagatcgagatcttccataacttggacttctgggcccatcaactttaacccggatgtaggcagtttctccctattggatagacagaactttccattgaaagatctaagctttcatctatcttcagacatgctgaatgaatacaatgtaactaaaaccagaaatctggcaatttacttggacaaccttgcctgaatccttaccttgaaattccactgttaagaccactgtatccaattctggtcaaagaaaagaatacgtgtataacctacctcatgagatctaaacttagtgttatccagttttcgaactgcataggtcatatcttctttccgtacaaactccacgacaccagtgccatctcggtaaacatcagcataacatacatcacctgcttcacgcatgtgatcctttaaatcctgccaacttccacttggaggcagtcctgaaaaagtgattttttttttcttagtaccaattatcttaaatttcacgttaagctggtaaggtacattaggacaaagagtactttaaagtacttaataggtgtacttaagtgataccaggtaaagagagctggtaagattctggaatccagagtccaaaattatttgtaacgatcttcgtatctagtaccgcaacctaatttggtaaatcaccacagcagcaatcctcgtttattaaattcacccaaaaactaaagcaatttaagacctagcatgaaaaatttgcaattattaaacctgtcacgcaagagaaaaattttaggtagttttcgtcccttcacatcaatccacacaaccagtacactcaccagagacaaccactctgttttcagaccgcctggatggggggccatagcgacctcggggagctccgccacctccacccccgccgccgcctcggcctgttccacggccgcttcgaggaaactccacccgcagacggtacccatcgtaatcatagccgtcgcgaccatacaccgcgtcttccgcgtctctgcgggatcgcagaaagtaaaagggatgagaaacaccaggaggagaagctcgctcagttgggaaccagcaaaccccccgcacatgcgcacccaacgtggaagagcccacatgcgccgcataataggaatggcccctcccccacccagaaacacgccaggctcccaaccactacaccagccctcagcgcctcagtttcccgctccagcctgcgaatgggctccggggacgtccaaggcgaggcgccagagaagccacatcaactcagctccttactcgactcctgcatgggcgatacagtctcgccccaacctctctaagagcccccgcttccccgttctctatgttaaggccttggagccttccccaactactcggacctatttcctcaaggctgcaagccccatgccgcctcaccgcgggtcctcgaactcaacgaaggcgaagggcggtcccccgcggcgattcttgaggtcgatgtcgcggatagcgccgtatttgtagaacacgtcctcaatgtccttggttcggatgtctggaggtaagttacccacgtagatgcggcaatcgttgttccctgcggggccacgaatcacaccacctcccgacatggcggtgacgaaaagcgcggactcgagaacaggccttcccaccaagcctagcgcacggcagagcgagcccgcagcggcaccacgtctcccgcggcccctccaaaatggcgcctttatcagctcggcgcacggatatgggggggagacagaggaagagaagcggaaggaaacagcgattcgatcccaacacgcacgcgcgggagcgcaac

SEQ ID NO: 2045 - DNA, 6428 bp, Homo sapiens; identical to SEQ ID NO: 2044
  source 1..6428: mol_type = genomic DNA

SEQ ID NO: 2046 - DNA, 6428 bp, Homo sapiens; identical to SEQ ID NO: 2044
  source 1..6428: mol_type = genomic DNA

SEQ ID NO: 2047 - DNA, 45215 bp, Homo sapiens
  source 1..45215: mol_type = genomic DNA
gaattttagaattttaatacttcttaaaagtaaagtctcttggctagtgcagtaaaatgaaaccatgccgaattcccaaagggcaaaaagaactgacagctaaacctcagcaattagaaacaatattgttttaatgttgtcttctttgttttttagtcatttcaattgtaaaatcaactgaaacttaggttctcgccatctatataaaaactgagagaggaggcctcagattgtatgcagtgccacggaaagcactgtgtgcatattatatttaatgcaatacagatactttagctttaattttaaaacaaaactcaagaaatctttatctccaccaaagaagaatacagcatttgcatgataatatagttgtggtagcagtagtggaaaaacaagatacagccacatagacagcagtatgtaaaagggaagaaccttgtcaaacccatctcttaatctactttttgtgtcagtgataaggaaggaaaaaggtaaaaatacagtatacttcacgaaacatcatccactcaaaaaagtgtctggaaaaagtacaggagagagaatggaaccattcgcaaatgtgaaaaacacatatatcagcgaaacatatgcagttctcaatgcagttacataggaaatgagttttgaaatgatctgattctcatattatctctggtgtattattcaagttgtcagttactgctttttctactcctttcccaattttgtggctaatagactaaataccaccctaataacaaaaaggacaaagtagcccatttaagaaacatgaattaaatttctgagtttatctacatctatggttaatttcaacttttgaatgagtggttgtgaatagcctaactcccttgggagaactgtaaaaataattgtatgtgaccaagatgaaagcagaatgtattcagctttggatatcaaacacaacttgtgaatttggaaatgtacatccttctattgatattagctagtgtcattaagccataacaaacagtaaagctaatattctcttctcaagaaacagaatttgtctttgtctttaaatagccaatgtgaaagatgtaataaaatacacattttccccctaccagatccatgatggctacctttgaaagaggactgatataattgtatataaacttggctttgaactatttcacaggtaaaccaatggaaaactgccagttacacttaaagcaaagaaaacatgtaagaattctcccacagaaatttaccgttcctacgtcaagcagttccctaaataaccactgatttatccaacaacctataacagttgggcactgactttatgcataacatttgctagatgttgcttaacttctcctttcccaaaggaccctcattctcgtcctgatactttgggtgtatctggatgtttttcacttgtgaaacccactcttcagagaatgcctttcaattttaccttcagtaagatgcatgatgcccttcagagtaactgatgtttctgagttagagaaaaattcacttgctatcaacaggttgcagcgaatttgctggcctttctttcatttccctagaaacacaggatgtgaaggaacagagtagcaggagggaatcacagatgagaaggaaaactgtcgccagagaagatgaaaaaaattcatgctctatactgtgttcatctgtaaaaagacaaaatgtggttaagtttattacactgatcttgtgaaatgcagactcatacattaaacattgcttgtctattctagaatgaagtagtaggaagatacttgcaatggcaaataaataccgtggaataagagggccttcagcatgtactatgtattatcctgggctaatcaagaccttttatatcacctaagctgacggattattactctgctgcccactggcttaattttgtgaatccatccagactgcataaagctttttgctgttatgcaagtctggggacagagcaacgtgtcaaatctgctcatgtgaaacgggtgaggaaatgctgagccatatgccagagggagagaggaaggagagggaaatgatacacttcccctaaaggccactcagtgggtaaaatcaatgactgtgtttcaggtacagactaaagaagcagaattactaagaaccccttcaccttccccaccagtgccttctgcccagctgccttgaccaggacaacttatagtaagtaaactgttcatccaaaggatactagcctgccagtgacttcctgtctgacttccacactggtctttccccttagaccagatgctttcaatcgaggatgattctgtcccctggcaatggctgaagacattgctgattgtcccatctggctgtgagggtgcatgtgcttactggtatctatttggtagaagccagaggtgttgctgaacctcctacgaagcacaggaaagctccccaccccaccaatccccaacaaataattctgaagccccgaataccagtagcaccaagactgagacacatggcactagactggaaagcctctggagaacttttttttaatcccaagtgctcaatagtgtgtggtacatagtgggctcttaggaaaattattttggattgaaaagcacagtgaaagtgttgcccctatgtttcagtctagcttatgtttctcttttctttttctttctttttttttttcaaattggagacggagtcttcctctgttgcccagactggagtgcagtggcaccatcttggctcactgcaacctccaccttccaggttcaagcgatcctcctgcctcagcccccctagtagctgggattacaggcacacaccaccatggctggctaatttttgtatttttagtagagatggggtttcaccgtgttggccaggctggtctcaaactcctgatcgcaggtgatccacctgccccggcctcccaaaatgttgagattacaggcgtgagccaccgcgcccggcctggctgatgtttcaaatgtgtgcttaatagggtggaccgtgggggtaaagagagggagggagggggagatagatagatagaggaagagaggaagcccagattcagatcctgtcactgcgtgaccagggcaagtggcttaacctctctaaatctcaaagtcttcatctatcaaaaggggattaatagtacctagcagataggcttgttaaattagatggcatacgtaaaatgtttagtatagtagacagaaagtagtagacaattaatagctagtcctatcattatgagctttggctaaaggcctcttggagagtagactggttctattacagtcccagaggaaaacactgattacacaggaaatccagactaaacaaatgcccaagtcatactgcagagaacactggtgctctggctctcttggacaatttcctcaggagcctatggtcctgttgctcctgaggctgcaccaggcgttggcccctggtaccaccctctttcagagctgcaacctccagacttggcagaagacagccagcttggggagagctgcttctgtttcagagtatacactctgattctaagagtagatgctggatggaagtcatggccaaggggcaggacagcaaaccattgtgaagtcaacccaatttagagactgattcaaccgttgtctaaccagtgccgtgcctatattatgaactctttttcttttcttttctttttttttttttatattatagcctcttttagctctttaagtcttctatgggtttaatgggaggctttagtggtgtatagagggtgtgtgtgtgtgtgtgtgtgtgtgtgtgtgtgtgtgaaatggatttattttattctacaaatgaaatgaataaaatcacctgaaatggaacggaatggctacagcgagtgtccaaagaccacaaaactgtttcctgacatgtgcttagcatatttaaattgttctcacagtatcatcctgagagcagagagagcagtccaactgctccacaggactgcagagagggaaccaatccatctattttctcaataatggtgatgacagagatggaatgctgattgccaaatcccaaacacatacgggcctctcacccaaaggccatgatgcctttgtcttaataacagaataaacccaatcctgtacaaacagcttcttcagggtgcatgttttgaatggggcaaagattagctttttgtgggaggctttccaggataccggacaaaagcatgcactagagactcactaggtagattcaaatattctttctaccatttactaactgcttgatcttagtcaagttacataaaaggggctgtgtggggaggaggggctctgttcccacatctgtcaaagtaggaataacaataacacctaactcagaaggtggctgtgaggactgaatgagttactacctgtgaagtacatggtatactgtaggtgcttaatgtcacctattaatggtggtggtgatgatgatgtaatttgctcaggaacaacaaaggaggtataaaaaatccccccattttacagttcctgtgatgtaacatattttctgaatagggctttatatttattccatttttgtgccaggcctatagcagtgttgggagcgaaactctagcaggatccttcttacatgcagaaaaggttcattttacacttgccaataggaatgaaactatttcgctgccacaatagctaactgtttttctaaatggcctatttcgtcaacaacaatcaggaaagtgtaggaaggtacaatctctaatgattgtagcccgtgcttaaggtgaggaaaaaagtcaaaaaattacacatgagaaacctgaatccaggcagatcttactgaggccttatcatcgcattccccaaatgtctgaagagtgacgccctctcattctcgctcacctttcccctccctgccttcctctctttgttgagcacctactttttgccaggcaccgggtatacagtaaggaagaaaggccagtaataactcaggatattttttggaagcattaaataaatttttaaaaatgagctggaatagctccatgtggaaaagagcttaaaattaaacagcatcagcaaaaatccagccaagcaagcacaatctttaagaggaaggattttaggctgaaaggcaaacaatactagttgatatactaaaaaagcaccctccaaaaggaagatgttcccttttgtggacaatcatattcccatttctatcacgaatctcattaactatttcactccttgaaccttttactcttggcaagcccttcacagccccaggagctacttgtacaaattagctctcaaatataaggcagatgaagtaatctcattgctgctaaagtataattctctctaattactgtaactaccaagcgttagtccctccctttctaaaaataacactccctcccctagacacagtgatgaaatcgcattccgaagaaaaacatttgcttatcaaagaaatcttagttccttaatatatgaaatttctacatggacaactttaaaggggagaggaggaaacctgaatattagaaatgtcacttgttttttggaaggtgctgaatgcgaggaataaaaatcccactgatgatgtaggtggtttaaatccagcagctccaacttgtcatggctcatctgagcactgcactctccttggctccgccagggctccctcccgcagacaggcccgggatctgccatggtgcgctccctgcctctgagcacacacacttattgagagctacacacaggccagccgtggtactcaccatactgtcgaattctacagagcccactatccgagacacctcgtcaaactcctcaggagacatggggagcaggttgtctgtggtctgaagtctagaagggtgactaaaatggggaaaaagaaaagagcaatgtcaacatctgagtgatgaaagcactagtgcatacttacacactttatcttttgtctgtaattgaattatcacgttatatttttattttgggtaagtgcatacacttgtaaaatacatttgcaaaagtacagctcatgggaggctcatgtccccagcccagccccttgggaaatgtttcacactccagggatgtgataagcaatagccagactggaatctgtgccgcttctgcctgggtaagcctaggtgtgagcatgtgcggtgcactaccctgagatgacaatgcctcgtggcttaccctggacagaaaagcaccagagaaatgtctggggagtccctcatccctaccttgaggtttgaatgcagataaagctgctccacacagtgtttttacatgaaggctacatccattcaccccaagacagtgctgcaggccaaataactgacaatgacatttccaaaattttttctaccttttataaaatgaaacaacaaaatcaaagcaagtggagacagtgtatctcaatcattactttggccttttctagattgaaaagaactactttcccactctgatcaacttttgctcattttatttatactttttcaaagggtatcagttttgggaaaatttatataccttaaatacaaatttggtttttggctttttttttttttttaaagtagtaaaatgctgataggcagtaacacggggatctcaacaagttcagctgtgatggcgatagcaattacaatggaaaagtaaaatacaagcatcttcaacaggccccagccaggagcaaggctggcttgaggtttgtaaacatgtcactcttctgtgttcacttacacttcagacacagaaatcaactcagtcttgatatatccagttcctttagggccatcaagttccattggctctggtgctagaaataaacacattgtgtacgctttccatcaaccgaaattccatcagaatacaacatcaacttttcggggggattaaagttctactgtgtttctagacagcttagcctcctaaaactttaaggagctataacctccctgcctgagtcacctaaaattctagtgggaatgcagaaacaacgagaagaaggatctgaattcagtctggaaataagctagtgttcagcaggacactagctaggagctttctctttacacaacttgaaatcttacaagaagtctgagcccaaaatatgcaaagttctatccagtttattggcattagcctggctaatgaatattcacagctgtcaaggtaagctggggacatcttcattccaaagtaattgtcctaatattgagatttctgattctgaaaaacagctttgttggtgtgttccaaacaaaacaggtctaattcgaaccttctcaaatgcaattcattgacaactgagaagcaagagacctgtgttctcagatgaggcctcctcttaataattatctaataaaaataggatctagtaagtaattgggccaccctaaatgaaccacttcacttctcccaggcctcagtttcctcaactttaacgtgagcaagatgccttctgttggtttaccacagttccttatttaaacccttttcatgtggaaacagtgatagtaacaaatacacaagaccagcaatggacttttccaacattcctaaaataggaaattgtccattcatttcttactagctgtatcaggccaaataatgcattatgtttcacctgcactgagtttatgccatcttttgaaagcctactcttaccaattcgaaagcaaaacactgcatgggtggagtttcagaataatcaccccctcatcaggaaagactgtgccacgctgttaccacctgcttgccccacttaccttcctttggcctggagtaatactttccaaaggcatggtctttgtcaatatttggatacagatacttcaggggattctcaggaatattctcagcagccatgactttgtaattgcgaatgatgtcagggaaagtaacagcagaaagttctttcttcgtgtagggttcaaccgcatggaagtcaggttctaaaaaggagaaaagctaagtaaatcccatagaacatcccaaaatgaaagaggacagagaaataaaacactgcagagttgatggatttgagtgaacctcataagaactaatcacaatctaagcattataacatatacagtagactgctttatttctaaataaattataatactgtctcagggaaaataaagggaggtattattctcaataacattctatttgccattatttgcttagatttataaatctgggcaaaaaagatttattaaaaacctttaaaagcctgcatcttcaatgatgtgctgcccataggcacataaataacttactactaagtggatcatcttggcttaagccacagatttaaattactagagataaactcactttgtttttcttttcatattgaaaaatctaattttttattaaaataaattatgatatatagaaaacaacatttcaaattaaaaatgatcctatttgctacatttccctgtaacccttaacgtaataaaccatggtttaatttactcccgttcttattcccagactgaattcagatccttcttcctagctgatacagaatctccctttgggtgtcgaccttccagaggccacggttcaggtgttctggggagcctgctgtggaacatgagactatgctgccatcctaacccttcctggctggtagtgtcctgcttgacctttcctggttgccaagggttttcttcatctctgcttggtctactatatctgtctctcagctggttcaggaagggaacaggataagaggaaaagggcaggttctaatgactactgcccacgccagactctcatctcagcctccctgctttttcctcagaagaaaaatagaacaagaaaagtattccagaaaaacaaatagaacaagaagagtattcctgaaaaataaacagaacaagaaagaataccgttccagaaaaaaaaaatagaagagtattccagaaaaacaaacagaacaagaagagtatggcagaaaaacaaatagaataagagtattccagaaaaacaggagaagaggaatatttcagaaaaataaatagaacaagaagagtattccattttgtgtctacccactgaaagtataaaaattactaaaacaaatcagtttttcctcctgcccttcaaacagaccaaactctaaacaacagtgaaaagtaatcagttggtctttatgattttttcatttacgctgttgagcttcaccctcagaaacctgcttcataacaccaaggtttctggagtcttttagccatggactcatttgattaaatagaaaccccatatatgataaagataaatttgcagctgctctgtttgaaggcagggtagaggctgccactcgtcccaacaggtcctgcatcaactccctggctgatgatgtgtatgaagtcttctcccgaagcctgtctcatctgcacactctactctgggatgaccctaagagaatgtggatgcttactcctgtgggaaatgtgattccttccaagaacgggttgcagattacattgactcacatccttgatctgcagataacaaacctgatgcaaaggaaagaattggcattgtcttttcaaaaccatcatttccacaatatgttccagagagtgaaccacaaccacaaacatttgtggtggtttattaaatcctatcgggggctcatttggggtaagtataagatctgcaatttcatgtcccaaacgcactatctgtatgagctgactggcggcgatgaagagggacttcacacacatggaatggtgggactatgtgctcaaactcccactcaccgcctccgttctgggaccgctccacccatgtgaatgtgatggccccttcccgggagctctcactgaaccgcagcaggaaggtccccggctgctggtccttcaacagggcacgctctcgctccttgctgatgaagcccatgatgcacctggatatcgaagagatggacggatgggcttttagttcaatcatgatttccattttcatgctaacttacaaaccaagaaaatggctggaatgtgagaaaaaaaacctacggtaaaaaacgtagactattttaaaatctgttcagttgacacttaaggaagcatttcacttatacatgtatatactaaggttttaaaaaaagcgatatgaacatggtgtcagtaggatgctacagatgctcaataacacgtgtgggattaatgagccttttattgttcctttattattttaaaggccataacaatgtctgaatgtatacatcttttttactggagaggaagacctaggcaatatattttcatattttagcccttctgatcaagttaaagcttctgttgaaatatcagccgatcctggcaataagtcaagatagaaatgatttacccagttaaaagggtttttcttccttcctaggggccacatagtaggtgctcaaaaaatttttgttgagtgaatgaatgcatgaatggcactcaagagttgttttttttttttaatttagctttgccaatacatatacttgtactaagaaagtgtaaggttaatgttatgaggttctactcttctgaagccctgaaggggcagcctataaatgcgcactcctgtgagattcacacacgcctagtcaaatactgaagctggactcaggccttgtctcaacctcgcagcactaaaaatatgtttcaaaatacatctatcggtggcccttacccatcattccagagagggagcaggtgttttttaatgagttctaggatgctttcaatccaaagccagaagggaaaatttttatcatttatattttcctgaaagtatacaaatgcagacattatgaacaaaaatctaaaacaatgacttaccatggcccctcccaccatcatttgcaaagactccccaggtgccaaggatggaactgtcccattcagcacagcaatgggatccctcccctggcagggaatatcaagttccctccccgctcttatcagcattcagaccaggagctctccagagctctccacttccctgggccgggctctgcttccctttccaaacagtagcaagctagcctgggggtgacctccagcgtgactcacggaaacacaagctgccccacactagcaaaatccagcagtgcaagctggtccgcactgtctggtgactccagcagaatctaaatgttccccgcagtgggcccctctgctcgagcaggccgttaaactcgtctggctggtcaggctgcgccacccagcccacaacatacatttcacacagaaatggctaaaacactgctgggcaggggtccagcgtgagtgaacagaagcctcatttcagatatgaaagaatgttatcactcaggcaggtgcttcctgtcagactcctgctcggagaccaacctcctgcactgaagaaaagtaaacaacttgcccgaggggctccttggccagagaagaacacgccaaaataagcaaacagttaagtaactatcacagcaagaaacatgagaacctcaaccaagagcaaaaaggacttagagagcataaaacccagacagtcctcaccttacaaaacctcgtccacggaatgagaccatcggggctggcgttaggacctaaacaaataaaaaccagatttttcagcaaacagaaactgattctaaagctttggttggacggatggctcttgtatttgctctcaaggaaaagagccaaacacccaacaaagattgtatgtacacagttgacattttcggataccttaatgccaaattaactgagcaattataatacgtgctgtaagagggcggaatttaaatggtctaaaatatgtatatgttggtttgagtttaatggcagaaaggaatggatggcagattcctgggcaccacgatatgagagtttttagggaaagcggaaacatcacaaagccttaccatctgctctctccctccccagccccccttttccctccctcctctaaagagaggacagtccttttaatgcctcttcatgttacacttccttccaagaccatcagctgactttgccttttgcactaaatcaaaggtgttctgctgggcctcctagagaagcctccctatccagtgcctcttcccactgccttcctctgctgctcagcagagccccctctcccaaggatcctacagaatttttttcaaagttcaacctaggtgcccaagatcacccctagatcttcaatgtaactgatacttgactttacaagtttattttagacattatttatgcatttccctcagctttcctccaaataggacatgggctcaggcagtctgatgcaaatcaaaaaccaagtgagagaaacgagaggaagaagcccggggttattagctacacaaattaaagcagcctgggcgagaagaggcggtaagcccattatcggtcttcaaagagaactacaaatgagccattacagctagaaaagatatccttcttaactctcaccaaataaagaaatggaataaggggattttgtacttgtattaaacagcacaagaccaccactgtgacagctgcatatccaagagaagaaggcactgttgaaagtcactgagttaggaagagcctactgctgtttggagtaaatgcagtgctgctctacagaaagcaaatctggatacaagttgtccacggatttttaaagaaatagttcagatagcctcactcactgaaagatctgaccttgagactagtggatctttgatttgtttagtatgaaggactaataaatgcactgacattaaccactgaaagggaattatctaccactgtctagactctgtccaatcaggcaaaactgcagatcaaaagaggcatcctcttgtggggacggcatcctctgctacctgggccccacctgaggcaagggccctgggtttatgctgcagtgggcaagccccaggactttatttctcatcatgtcagggacttccttttttctccccaaggttaatggttaataggccttcatctttctcatccaggaacttatttcagccacaaataatatattttacataattcataaaactttcccttgggaattcatctcagaaatcttaatatgagacaatgaggaacggattcatttaaatgttatcaggtctatatttctttctaaggtgacatatgattctcacttagctataataaactatagcttgaaaagctgacagattttagtacttttttacctttaacaaaatagcagaggggaaaagagcaattagagagatatttttatgaatttcaatttttataaacataacaagttaatatgcatataccaagaagcttctctcccaacatgttcagctggtccacattgagacctcttttggtgacagaagaaaactgccaactcagcacttctgaaagctgagcccatcgtgcacatggtggagtcaggaagaaggacagattctagagagaaaacacccaaaatctaagggttactacagagacaccagtcacaagtgtggcactaaaacatatgtccatcccaaagttcaattctagtttatatgacacacaggtgctttcacagtaggggaagagaaatacagtcaattttcattatttacagatgcacatttgtgaacttgtttactcactaaaatttacttgtaactccaaaatctaaatacatggcatctttggggtcatttgaagacacacccgtgcacacacagcagcacacagcagcaaagaattcgagtctcttaacacgcttccaactgaagccaaacaaaatgacactcgcttcctgtttcacctctcataagaaaaacgtgtcctttttgaagcctatttagcgccatgttttttgcattttgtgactgctgttggtgatccctgtttaaaatggtgcccgagcatagtaccacagtgtggtctactgttcctaagcatgggaaggctgggatgtgccttatggagaaaatacatgtgtgaggcaagcttcactcaggcatgagttacagtgatcctagctataggtgtaatgttaatgcctcaacaagtgtattagataaggtgtctttaaacagaaacacacataaacaatgttatgcattgatgggttgacaaaaatgttgtgaccagaggcttgaaggaacctagcctcgtagttcccttaggagcaacaattcattatttgctagttaagtgttcctggtgactttaaaaaacataagtactttgaataattataaatgactgtaattaattaacagtgagtatccacactctaagaatggagcatgcttgtttagtagatgtatacattttaaaaataataacaataaagtggtatggaatcactgactgccctagcttacccacatgggagaaaaaacgtaattctcatttcaaatacatatccatgcttcatattcccagatttactcaaaagccttagaaataccacaggagctttgtcacttctcccttaacaactggccattggggctatttcagagatgcagcagtgagagcgtggggtctctgcttaaccctgggaccaaagcaaatgtgttttccataccctgggttccgccaccagcatgttgtaccaaaggatggaggcccaaccgctcgggagctggctgacgttggagatcaccacaacgggcagagaggtcgtctaaaggatgacaaagaccttgaaatcatctgaatcacagaaatgtcaccttcagataactgcttagcctcaactaaaagcaggggattatttgtaaatttgtacatatttaatacttgaaaatgagaagtgttaagttctgttcttctgtccagtttaacttgtctttgatgtatctttcagttaagaaataagtccctaaaaataataatagctacaataattaattaagggatatgcaatatgagaagatgaaaactgtcacaatgaaaacataaaatgtggggggagggcagagcaaaataaataagtcccaatgcttaatgtaaaaaaaaaaaattaacatcagcgatctcaactggaacttttaagttattgaatttgaaggttaattcaattgtctagctttctggaccataaattaaggttaagatagtattagctgaaaaagatcattttaaaacaattaggtaaatacctccagaacaaacactgagaaataaaaatacatgtaacaattaaaagtaaaaataatgaagttttccaactcgggaccataaaagtcttacctcgaggtcaattaccaaaccaggctggcacaattgggtttcaaaactaagggagtgaagctcttcagtaacgatgagaggacccttggaagagaaaaggaaagaagaaaagaatataattattcacagatcctaaaactttcaaaagcccaattaacattgcaacaggccacagagatcctgggcccaatcagtggcaagtctgaagactcaatattcaatctctcccagatttaatgattcttagtatctcagtgtgctctgaaagataagtgtctgaagttacggcaagggttatagattcagagcaatgattgtcaatggggaaagagcaactaatggctttgtgacctaaggcttctcgaccctcagctctgtctgcctgcccagtgtggctgcacatctcaatgcagatgggtggggagaaggtgagaggactgggagtaagtgcatacttgtgattgtctactgcctaccggaagggctgactcacatcaacttggcaggtcacaagttgtcttggtttcggtagaaatggatagatttcaaagtgccttcataagcattacctcatgtgagcctcacaacttagaactagagaggtgcaacagctagacccagggaggtcaaaacatagttcaggcgcacaccagggctagaaggcatctttgcactgcctgggcctgtgtttgtcccgctgctccatgtgacctccactggtcctggtgtggaaggactgcacactgtgtgtgcataaatgacgaaagtgttctcaaccaaaacaactccagatatttcatcctttgtccatagttcatttctgaatgcatcacaaacccaactccttaaggatcacgctgtaggaaggaaactgatgcaaaggcaatgcttttggtaggggatgcaatggccgaaaagccctcttggcacacagcaaggcagtcatcaaagtggcctctcgttccaactctgacagtaactctgtgcacccttagctaaatcctgcaaacttctgtgagtcaatttcttcacccgtaagatgcgaagaatacaaaagcccacaacagctactccactgagttgtccatgagtgtctaatgaatttgtgtgcaaaatcgtttgacaatagtaaagcacaaatgtggtgtttttactgttgtcacagatataccaaatacccagctcctttgctgctcttccctgatgggtctgaactcctctgtgaggtgtccccagccaccaactgacctgtccttgctagacagacctgcctgatttgggcccattcacaacataaagggactctcacctcattcgttctggtgccagcatttttctgttctttcaattgctataaaacaaataatcatcttagtaaacaccatggtaatggtcaaagttgctatcttcatttacaaatgagaacaaagttaggactagaaagaatgacagacgtgactttatctttagaatgcagaacatgggacaaattggccctcgttcagggtccatgagcagaagcacgtttcctcagtggcctcatggtgcggacaccagtctggagggatctcttggaatcacaacccgctcctctcctgtgttcaaactttccctgaatgtttccccatgcaccttcgttaactgtttcatgccctgaggctcgggacagcttctccctcccctttccctcagcagagtcctccaggctgggcccagtgactccaggtccacctgccctcaagtggacgtcaatctctgagctgtcaatccctgagctgacgagggagcaggctggggccctgagggcggctctgaataccctcaggcacctgagttgggctaagctttcgagttaggtagagcttcctagctacgaggcttgctggatcacaaagtggtctctagtgaaaaaggatgcctttaacctcctgcaggttctgggcccagggaaagcttcggactcagcacccacagagcctcacagcaactggcagcccccatgttcacagaggaggaaagatggtgcacccacacagagcatcctgctgggtctccactgcctggggaatgagccctactgccctggagaaaaggtggtagagtcaggctggcgtggaggcaggggctgtgggcagggccaccaggaaggggaacacgggggctgaggagtgaaccctggtgtacaggaccacacttggatcacagtcaggacacgggagccataacctttgagaaaactgcaagcgtaggtgagtgaccgtggggatcatgcaggcagcaagtgcaaatcatttacgtaaacacaggcttaggaaatatttttactgcaagtgatacagcccagaaaacagagtgaacagtcgtgggataaggaggagaaaccaaaatgccccaagtactggcgacaggaagacaccagccacaaagtctacaaaccccagcaggggggcgtcctccacatggcaatgtgccaaaaagggctgctctattgtcaaaagtcctaagaaaccagagacaacatagagaggaaactgatgtccctaccaggtgccgaaattcagccgccagactgccattggtggactcctccatgttcatcacttttgtgtgcgtgcccaaaatgttgaacttcctaaatctatacaatataggaaagaaatgctgaaaagtcttccaactattaaataaataaaaatatagcacagtatagcgtaaagtacgtcacgtacccttttactgtatttctctcattcacatctctgcaaaaaaaatatatataatcacatatgcgtatttaaaatttgaaataagctttaacaaaattataagagtataagagcataagagtgtaagtgaatgatgaataaaaaataaatctacacctatggatttgcagcctttcattcactccctgcttccatctacccatactaggtctggcaagtatcactgaatgacctttggcaaataaatggtctgggccttacattgttcatttgcacaacatactaacagtgccaacatataggacatcatgaggaataaactagttaattcctcaccagtacaccctcaataaatgtaagcaccagcaccagtacaccctcaataaatgtttaagctatcgttattgtttattgagcagctacttggtgcaaggccctgcactaagcactggggatccagccaacagcactgcccagtagtcacaaagctcagaggactgccaatgtgaccatttaattctcatttttattctctatgatctttaatgctctcatgaaagtaccaggaaagtcagttatctggggaaagtggcaagtttaagttttaagtctgaggttaaaattttgaaagaccttgcacttctatatccagtgattactttgtcatgttctggccaaataatgtatccgtgagcgtcctagatgtagactagaaatcatgggctcactcacagatctattagttccccttcctttccaatctcaaccagaagttcaatgcttttgtgaatgacaatcaccattagctatggaagggacctattttcccgtttggaaaaaaaaagaatttaaaataaaagggatagtatgataaaagctgacttgtcaaagctaagaagaccgtcagagctggaaccgacagaaaagacacaagggcccgaagcagctgagaggagctgagctgacgcagaagatggtaaactgcaatggcaacacaactcttgtgcttcctccgtttaggaagtaggatatacttccccatcccccgaatctcagctggccttgatttgcttttagcaacaggatggaagggagtgatgctatagatgttccaaggctagcactcacaggccttgttcacttggaacactgtcaccatgggaaaagcccaggctagcctttttgaggtgcatgaagaaggacctggttatcccagctgagtcccagtcatgtaataaggccttgctagagcacctggctccaaccacactagctcagaccaggacaacctacaactcacagaatatgagaaataatgagtttttgagtttttagccactaagtttttgtttgtttgtttttagacagagtctcactctgtcacccaggctggagtgcagtggcatgatctcagctcactgcaacctctgcctcccaggttcaagcgattctcgtgcctcggcctcccaagtagctgtgattaccggtgcacaccaccacacctggctaattttttgtatttttcgtagagacggggtttcgccatgttggccaggccggtctcaaactctggcttcatgtgatctgcctgccttggcctcccaaagtgctgggattacaggtgtgagccactgcacctggcctagccactaagttttgggagtggtttgttaggaagcaaaagctaaccgatataccaaagatgatggcagggaagacaaggcacagaccatgctatgaggaagaatattcttataggagtgggaaaaagcaaaaagccagaggaaaatgatctgaatgatcataaatcatttttgaaacttgccaaaacagtatgtgacacaagctaacaaaaacattaaatatgggaggggtggggggggagccatcttgttccttaatgagagtggccaagttagtgccagtccaggtctagggtctcagggcaaaataggatgaggctgctccacctggacccccaagagagatgcccattcctgggttcccactgcccagaagagacaagagtgaatcccacaggctccacacagtctccccaagatgctgctgacctcgctccagaaaaaaacccccaaatgaccacagaatcatggcagcctggacgttcagcctcgggttggatcaggggcctctcctttggggctgacctagaaggagggggtggcatgccaagtccagccactttgagacttgctgattacaatctcatatgcacaaagagacactcactcttttgttcatttatagtctaaaaaggcacaggaatgttgataccagctccaggggaagctcccaacatccaccaagggagctgctgatttaaatctgctggggtcatttgtgatggccctggtggatctgactagaagtctctgctcatgcgcagcattgtcaggactctgggttcagccctggggccctagggaggcaaacttccacccagtatagacccttccacagctagaaatctgcttatttagtggaggaatctgtgcttgagtaacaaaatcaacatttcaatagtacatgtatgttatataatgttaaagatatcttacttatcaaataagactttgactttcaaattataattcagctcttgcaatttcaccaacagtctggaaagaaaaataaaagccattacttaaaaaaaattatctgttacaatttatttattatgccaattccctattaacgtttagataaactactccccctccagttttagggtattaccaacaaaaaaactgacagttttgtagatctacttaaatttttgtaagtgtatttgtaagaataaattcctagctgtggaaccgcttaggaaaaattgtaacactaattctgacaggatgccgccctgattttacattgccaccaaaagttaatgagggtagctgtttacctctataaccttgccaatattcagtttcatcacaatttcgacctttggccaatttatatgggtaaaatagcaaacattactttctattaaaacttgtatctaatctttgtcctgttgggagacaataaaaactattgcccataagcagaaaaaatagcgtcccatctatagtcaccccagggtagcatggaaagatggagggcaggtgagagggtgtacctctgctccactgagctggagactttgagaaggagaccccggggctctgtctgctccgttcagtggagcaggtggatgggatcagatttctactgtcccttccagctgctgagttctaaaattccacgagggcttcagtgtgacattgtacctaccagccagggagggttaaccacagacttaaatcagcaacaccccagaaaaaggacccgggccaactatgaaggccagtccagttcttcagcgtctagctactcatcataagaagaatgcttaaagcaatgcagccattcaatggaagaaagtaaagccacatattcctggaaacacttctacaattagtatcgaggagaaagactacaaaacaatgtatgtagcctactccgagtttttaaaaaagaaatatgtcatatttgtgtgtgtgtgtgtctctatatgaaatatttgtgtagacatggaatcctaattttttaaaaaggaaacattatgtcatgtttgtgcgtgtgtgtttccgtatgaaatatatatttgtgtagacatggacaaaatcctgggaggacagacactaggccatttactgtggtggtccacagatatttatatcacggactgctttgagaaactgatgaaagctataaatccatccatcagaaaaatgtacatgttataaatccacattcatacagcttctggggttcataaggctcaggttatgagcctatgcccaagaggggtgaggcagccaggaacttttactctctattacacacatttctgcaatttggaattctgttttcctgtgaacacgcattacatttatgattggaaaaaaaccaggagtgtgtacatatatgtatatcagttacatttctactatgaatatattaataaaagactctcagatattctcagtaagagttcatattaaagtgccccctgaaaaattatttcctcaaaagcaccctatataacagtttttataaaaggaaactaggggtacaaactacgtgacaggtgatgtatgggatgccatctttcccttgttacctcaacttcacagtgaactggacccctgtcttcaagaccagcggcctctgagggtgcgttggcatgcagggctgtctttccaccacaaacgagctgcaaatacccagcaaaggatagataagttagcatttccattaaggttgaggcaatcacaatgattttcctgaaagaaaaaagggggttagagagtacgatctaaaaaatcatttgaaagattctgacaagttggatgaacaaagtgatattttctaattagtaaagaaatcccaaaacctaatagggacttaacagaaacagaataactgtaatgatctgtgaaactattacattgaaacaaacatacaatgaaggctaggcacagtggcccatgtctgtaatcccagcactttaagaggctgaggtgtgaagattgcttgagcccaggagttcaagaccagctcaggcaacatagtgagaccgtatctttacaatttgtttttttttttttaattagccaggcgtggctaattagtcccaactactggagggttgaagtgggaagatcacttgagcccaggaggttgaggctgaagtgagccatgatcacaccactgcactccagtctggatgacagagtgaggccctgtctcaaaaatccaaaataaaaaataaaaaccccgtatttaattatgttcatttacatgtcagaattaagaataaaatgtgcactcaaagtacaagtaatgtttttaaattttaaaaaacccaacatacaggacttcttgtttgaacattagccatagggaaccaagtacatttttttaaatattacttccaataagtacgatatttattaaacatatcttcagttgttttgttacatagtatgcaacaaattacaatattctgcagccacaaattatatgcagagtatgaagaagctattaatcagacagtgtaatctttccatttataactctacaaggaagaactagcaaatcagatcttacatataacatctcactaaactttacgcatggaaagtgacagacactgcttgtgctgtttgatataaaatggctgaacttcatcttcagaagactatacctgacatctaaacacaccaatataaacatcaaaacaaaatatattctaaccaaccacgagaaaacagtctgatatcaggaaaatacattattttataaaccagcacacaaaggtttaagacagttctgaaaatgaagttagctgtcttgagtcaagagaataaaaaaaaaaagtcagtattgaccatttacaatctctgacctctgtggatatggtaagaatctgttgtagtgcagctacatacagtacaattcaggcaattttgtttcttcacttgggttcagattgcaaatttattactgtgagaaaaggatggaggcaaattttagcaggaacctccacctgactgcttgaccagagtgctctgaattttaacactggacttctcagcaccaccagctgttgctccaggacccattagcttcttaatctcagctgccatcatcatggaacacagttctacattcattgcattctttcttttttttttttttgagacagagtcttgctccgtctcctaggctggagagcaatggcgcaatctcggctcactgcaacctccgccacctgggttcgagcaattctcctgcctcagcctcccaagtagctgggattacaggcgcccgccaccatgcctggctaatttttgtatttttagtagggatggggtttcatcatgttggccaggctgctctcgaactcctgacctcaggtgatccacccacctcggcctcccaaagtgctgggattacaggcatgagccaccgtgccgggccttgttgcattcctagcactagtttccaaaaacagaattccaagggaatcagcaaattccttggctgttgtgtagtctactactttctctgtggtcagatcacacttgttccctaccaacaatttgttgacgttttcactgggataatgatctattttctgcagtcactgtttaatattattgaaggactcctgatctgtcacatcatacaccactaggatgccattggctcctctgtaataactggagatgactgttcgaaacctttcctgttctgctgtgttccatatttgaagcttgattgttttcccgtctaactctatagttcttattttgaaatccataccaattgtgctgatgtagctttctgtatatgttatcatctgcaaacctaagaaggaggcaagactttccaaccccagagtcgccaatcagaagtaatttgaataaataatcaatttgggattcatgctggacatgtcactgtagctgccaccgctgccacggccacccttgctgctacagctgctgccctgactctctgcaccacgggtaactgaaggaaaggaatgagataggctgttctgggagagtaaatgtcttccccgactctgccccctggaacgcaatcagcagccgctgccactcagctattgcttccacccaaaatcaagtacatttttatcatgtcaagtttgcattaaaaaaaaaaaaacttgcaatatgaacccttcttttccactcagtgacatttatctatctactaagtgtgtctagagagcctactgttcacaaggcactgcgctaggtcctgctgggggaaaagggtgacaaaggcatgtctctgccttccagaactttatgatattcaagaaatataaagaaatacataacaactatataacaaaaggcagagtaggaaaggaacgaagggtgactgtaggccacgaagggagataacatctgtttgggaaatctgggaagattaaatgatgagatacaaggtgaagctttcgggatgatacaattttgaaagcaggtacatgaaaagaaggctctgaggaagaggaagtatcctcaggagagccacagaaaagcaagtatgcggcatggcccctataggaatcagcaagaggtcaagtttgcctagaaaggggcgtgtgtggacgtgaagcgtggagtgttcagctaggtccaggctgcagaaggggggccgtgaatgcccagctgggcattcacttggatcagcaggtgatgaggaaccagaatggaactctgctctgggacagcactggtcacagggaggaaggactgggaaggaggactggtggggaggctggggaagagtccagaaaggaggatttgagagcctgagacatgaggaggggagaggaggaggtgaggcatgttagggtcacggcggagactcagccaaaggggaaggaggagtggaaggttactatagcttccagcctagctggccacaagagtgaagaaccactggtataaccaaataattcaggaagagtcattgtcattaaaaaatttgaggccaggcacagtggctcacgcctgtaatcccagcactttgggaggccgaggagggcagatcacctgagttcaggagttggagaccagcctggccaacatggcgaaacccagtctctactaaaaaaaattagccaggtggggtggcatgcgcctgtagtcccagctacttgggaggctgaggcaggaggattgcttgaacttgggaggtggaggttgcagtgagccaagatcacgccactgcactctagcctgggtgataggtgagactctatctcaaaaaaaaaaaaaatatatatatatatatatatatatatatataaaaaacacctattaaacccttgtaaatcatctgaattaacggtaaaatgttcctctgtatagaccgattacagaaggtacaaataaatgtcccttgagttacctctgaatgagctgctggaaaagactgaaggtgcggtcccataacacttgtttgttttttgtgatagggtcatgttcgtaggtgtatttctgttccaattcctccaactttttaagctgctgccgaacttgctgcagactctccgcaactatagtgaacctgggaagacacaagacacagatgtctctatgagaaacagtccagaagcagcctggattaaagggaatcatggtatattagtccattctcatgctgctaataaagacatactcgagactggagaatttataaaggaaagaggtttaattgacacatagttccacatggctgaggaggccccacaatcatggcagaaggcaaatgaggagcaaagtcacatcttacatggtggcaggcaagagagtttgtggagggaaattcccacttataaaaccatcagatctcgtgagacttactcactaccatgagaacagtattgggggaaccacccccatgattcaattatctccacctggccctgcccttgacacatggggattattacaattcaaggtgagatttgggtggggacacggccaaaccatatggcatggaaaccaacaagtggttatatgcaacacaaaatgtcacctaggatgccatgctctgccctctagggaaaaacaaagggaacgaggcttgtgccagcagtagaagctttgttatttgaggagtacaactaacatgcactgaatgattacagcctacatcaaaaacttctacacaccactgaggcctatgtgaggagagatgggtggaggcagggcttctaggtgatctgtgactggtgcagggcaaagaggaggccagaggcagggaaaacagcaaagcaggtgcttccaggtgatgcaagaggcagcaaagagccactgcaggttctgtcaagagagtggcatcagcaagcagtgtctcggcaggaccagtcagagatgtggggcagaggggcaggaggagagacagagatgggagacaaggccggggacaggaagagaggaaggaatgatgattctggtttcactcaactgaaaggagaaggcagtatgctcagtctagaccctaaacataaaaagccaatgagtaaacccagtgattgctcttagtcttccttccttgcagtcaactgctaacagcaacacaggctggggaaacgctgttttattcacttgcagtaatgacagaagaaaaccttttaaaagtgtcttcttccctgggaaaagtatctacttcactttctgattttgctcgattccagttcaaagccctgggacagcagcccttcgtcaggaaaggagaaggcaggataacggctggctgagttccagcggagaagctaaaccagtgtccccaactctgcttgcacacagagaaaatgacagcacagtgggaaaactagagggcatgtgtgtccctacaagaggctcctgtggtctaggaggaccactagggggctctaaacaccccagggcctccctggccacctgaagggctttagggttgtatgtatccctcaaggcacatggggtgcactgggctcagaagctctgctctaacccacaagaaatctggggtacctacaggcaattcacagaacaaaaataaatggctgaatattaattgtgatttttttaaaaactggcaatatagaaaataacctcgtgagatctctggtccttggacccttagcaattgtcccaggccaccttccctcatgttcactctgtgattccaagttcagctcctgttgcccctcacctggaccacactaatatgctaatagtattccaactggtctttctgtctctatcctatcctccaggctgtggccagagtgccctttctaaatcaaagatcagagaaatacatctcctgcttaagaaaaaagcctgccttggctcagcagtacagctgcgtacatcccccattcccagcatggtgctgagaacctgcaccatcaggctccagcatctcccaccgggtccactttccttcccatctccctggacaccccactctccagccacccaatacagcccctgcagtctcccacatgtgtgcctttgcacacgctgtgctctgtgctggaaagcacttccccttgatctacgtggagtaatcctagtgacttttgagtcagcacaaggccacttcctctatgaaaccttccctggagatgctttcctttgtcctccacagaattctgatggccttttgctagagcacctggatacttttaccacacgaattattaccatgtctacatccccccctccacactgagaactccttgttggcaagggccaagaatcactcatccttgtgtgcccaggtcctacagtgcccggcacacagtaggcatttaataagtattactggatggatgactgaatgtttcctaaaaaactattctgtaagcctagaaaaatgcctcaagctatcttgtttttaaggaaacattaagagtcaagtcattaaatgtgttctataacgaccatgtcactgatgttttgtacagtcaaacgacaccccatggtacaggagtgctccaaaccaagcagacgtggctgaacgtggcgagagtcatgaataacactgtgctttccaagggagtgtttccagggtaagcagaagctggactatgtcaaactctatactaatgttttgacagggtccattcaactaacacagctcaaaggtacatttatgtgtttatgtggttagccagtcagctgccagttttctgctttggagaatcttaccagttctgcagctgatccaagcaagcattgggcggccccccaatacaggcgctctgctgtctccgcttccactccactagttcatcattaatcagggcattctgggtaagttcagtgacattcagcaactctattattttgtgaactacttcctaaaggcaatagaagaaacaaagtgaaataaattcatttttaatcactgaattttaaaatattttttaaaagaaaagcaaatatcatttcattctcaactggggctctaagccaggtggctataatttttcctctcttctaaactttgagtccattatttacagtgtataacaaaagtggcatgctattctggaaagtaaataactacctttctcttattgtcaagcattaaatacatcttcttgagtaacagctgttcttgtttctgatcactctttgccacaccattggtctcgtgttctataaattgagagacagccagtaaatatataaagaagacaaaaccaacaaaagccaagattcatataaatttaggataaatatgacacaaatgctgcctagtgacaggtcaaagtttggctttcttcgatctttaatgaacatgaaaaaaagtcctaagtataacaactagacacactgaaacaaaatacttgttttcaaaaattagccgggcgcagtggcagacgcctgtagtcccagctactcgggaggctgaggcaggagaacagcatgaacccgggaggcggagcttggagtgagccgagatctcgccactgcactctagcctgggcgacagagcgagactccgtctccaaaaaaaaacaaaaaaaacaaaaaaaaaacaaaaaaaacttgttttcagtgacccatgtaaatcagacatagtagtatctgccacttaagacactgtcaggtaattacctaaataaatgtaaataacattaataataatgttattattattataaaaataaatgtaaataataaaatgttttatctgaacagaattcagataaaaaatgtatacaaagcatagctgtagctttcaaagagaagtagatgagtaggaagtggtagttgaagttgctgtctcttatactttctacccaaatcatactgataatctctgcctatgaaccatggtataccccagatgatgaatagagtaacagcagtaccctacgtgtcctacacaatgtacattcttgagatcttttctgttgctactctcattaaaaacacgcaacagtaagaaaatacagtaaaactgctttaaaacatgagaaaaatactgagcttatctgctgtgtatacacgtggccctgcaacgtttgaagaaacctgagatattagggcaggggaactccacatatctatcgctctgtgtcagtcagtgggctaggcgcaataaatatggtgagtaacacataaccagtggttatcaagtaggggtcactgacccctaggggacttttggcaatctctggagacagttttggttgtcactagtgagggctcctgggtagtgctactggcatctggtgggtaaaagtcggggatgctgttaaacacgctacaatgccaggacagccccaacaacaaattagcccgaaatgtcaataatattggatgttgagaagccctggcctgggttatcaaggaagaattcagagtcataaaatactcggcaaatagaaaggagtaatcatcttcgttatctagtgtgaacagaaaaaattgcagccaacgggcaccacttcagttgtgaacccttacctctgttctgcaaggttttgcatttgaagtcatattcatcttgtaaatcttccaggctcttgatttcatgctctatacactacaaacaaagatgtaaacatgttttctactgatcagcaacttccaaagactttaggcaacagagtattgcttctatggaacccagagaaacacgaaaacaattccatctcccccaaaaagagatctgacttggacagttctaatcatatacatgaaataatttcggtttcattaataagtatgtcataacatttttaaaaaagcaaacgtacaataattctcaaactgatttgtatgtccttaacctggttccagcgcctaaattttgattcttcctcatcatttttgagactacctctgagatatgatttaagaactccactgtgaagcccacagcaggcggggaaaaagctcacagaaaatttcctcattccttccaagtaagaaaagtgaccatacatccctgctttaccgggatagacctggtttcatacttgctgtaattataaacagtgccctcttggcggctcaaatgcatctccatctggacaataaattgtatgttcattctacaaataagcctcatttgtttgggatttggtcacatttccacatattcttctctggatttccatggctatttctggactgggctcactcggtttctactttaatgaaatgtttccctaggagaccgcaagatgaagttgctccaaagaatgtggagtttggaaagatgctgtctgaagcatgtaagtcaaggccatactgctattacccagagatccacagaggaccaaacccctaagctggaaggccttttccacaaacacaggcctctgtgaaaaagaactcctcaaaccctccccacaccagccctaacagtggagaggagtaaatgcgcaccatcgaggacgccagagcagccctctgcttccataaattgacttggaagttgtatcctaaaattgctgtggatgtcttaatcagaaatgtatccaaatttctttcaataaaatgtatttttgttcctcttccaagtcttaggataaaacagatgactgggaaggatgggccatgtttatcctggggcactgtgatttgagaggtgtggacataaaggcccatttagagcagcaacatctcatttactgggtactgggcaaagtcaacatttactgcatgatctttcagggaagaaaaagctaaactcaatgtttggcagttataagaggccattcaaaaagtctatctggtcattgattttgccaatttgtttacttatagcttgagacttctgcaaaatttttcttcccaactacttaaaagactgaactcagttacgaggtttacaccccaagcaattgaaaccttttttcccctacagaaagtttcagaataaatgcatgtgtttactcaatactcaccataaccttgtccttcacatttctgactttactgtcaagctctttctgtttgtctaacatcactgtgctctgaatattccccgactgagcctgtaatgggaagggcatgattatagccatcgttttcttcagggtgtgtacttgctggttacactccaaagtcaagtccccacttgccttccagatcttctgacatgtactacaggcttcctgcttatgtgtcaatatgaaatttttcccaaggccctggaaaatgctggcaaactgttaacaaggttacaaaaaaactaggctcaattcatgtctaaaataaacagtatttctgggagtttccattaattcatacagttgcatggtaccacgctggaatttagttcacggtttctcagatactatacacaagattactctcattaactcagtccttatttatcttaaagctttctgattcaaagtgtggtcctcagaccagcagcatctcaccacctaggatcttgttggaaaatctcaagggctaatatgattaggcaatcagaaaaccctattttaacacaattccgggtgatccagaggtatactgaaatatgaaatcactccattaaggccatcaatgaaaatctgctactataaagtcaataatgaatataaacccagacttgcctgggagtattcagtcctatttttgataatcagaacactcagaagtgacagggtctctacttgcttcatacaccagatgtaccctgcacatactaggtactaagtaaatgtcaggcaatgctctaggctcgggtgttagagtggtaaccagtgatccctgttctcatagagattaaattctagaaagatgttatttttttagagttaaatcccccacacagcaaaaactgtgcttgtcaacctttcttacacagtgccctatacagcacagattctacgggggtgtttttatatgtgcaattgtatcatcttttcttcatgtctggaattttccttatattagaaagcctttccctattgacattacatcattcactcatttccctagcacttgcaaggtttcctttttttctttttaacttttagatcgctgatatatttgtttattctcatgatcagagtgaagtatgggtccactttttgctttcactttttttccagttagctttccatttgtcttaacagcatttactgaaaagtccattattttccccagtgctctgagctgccaactttatcacatgaatttccatatgcacacgggtttccttctagatttttctcttctttcccattggcctttttattcataagcctgaacccttgaaggatgtttgactatagaggatttatagtctgtctagtagggccagtcccatttcattgctctacttgttcagaagttgcctcgctactcttgcatgtttatttttcataaatttcagaacaaatttgtgtagctccagaaaacaacttgttggtatttttattggaataacattaaaattacaagttaactcagggagagctaacatctttatgatgttgtttttaattcttatgcttctaatggttttctcttgtctaattgcattggccaataccaccaatacgatgctaaatagcagtggaaacacagcatccttgctgtgtttctgacttactggagttttcccagttaggtaagatactgtctctagaatggagatatatatatttttttgtgttaaagaggtacccatcaattcctatcttattcaatgtttttatgaggaatgagtattgaattctgttagatcttttcagcttctgtggaaggaagtaaatgcttttttctccttgtagctattaatttagtgaattgcattaataggttgcccagtcatggactacccttgtaacctataataaatcatatttggtcatgtcctttcttaatgtagtatttaattctgatccctaatatcttattgaggacttttatattgatactcataagtaaaattggtccataattttttgttttatctttatcaggcatacgtcatcaaagttattctctcttcataggaagttttccttcatgttacatattctccaacagcagaagttcaaagcatgtgaattgtatcagctgtaaagtgtgtattagaaatacatgaatgttactggtatcctctgtaagtccaaggtgccacatatcactcagtgacaaaaggggtttctctgggcggttggaataagttgtcactttgaggagttccatacagctttctgcctgtgcagggaaatctttgctgttgtctaattctgacatggtttggatctgtgtccccacccaaatctcatgaattgtaatccccattgttggaggtggggcctggtggaaggtgactggatcacggggacagtttctcatgaatagtttagcaccatcctcttggtactatccttgtgatcacgagttctcacaagatctggttaagtgtggagcacctctcccctgcttcctcctgctctggccatgtgatatgtgtgcttccccttcacctgctgctatgactgtaagtttcctgaggcctccccagaaactgagcagatgccagcaccatgcttcctgtaacagcctgcagaaccataagtcaattaaacctcttttcttataaattacccagtctcaggtatttctttatagccatgcaagaacagactaatacaacttctaagccagcaggatgtgggcacggtgtcctgtgggctttgtaacagctgggacactacacctagagagagggaccaggccactggagaattctgacttcccaggcctcctcccaaatgaccaaggctcggtttagagaacagggatataaacaatggctgtaaaacagcagctacatccccagcttctacatcccctttctactgacttgctgggagatgcttggtggaaaaacctggtgactgtggcagggcctaagaaatctcctgcttccaacttgggcagtagtccctccaagtcactcaaacccttggtgctctcttaccccttccactcatccctccctgcttccctccaccctgcccccatctgctaagcagatgcttggctgctcctgtacactttagtactgataccactttcacagtgagtccttaactttttaactttctaagaaaccaggagtactgaaaccacgggaatttcaaacactgaagttggaagggacttcggctgtcattgactcttactttctcgtttcactactgtacctctagagaccttgtttggatgggaacttggttactccagaccccagagcaaagaaaagtcttctgctcaggaagggggtcctttccaatggagtgagcagttgtccaagtaagggaataggcactccatgggtgtgagaagttccagccagaaagccctcatatcccatcccacagattagaaaactgaaaagtgacttctccagtgaactagttttagagttggacaatactgggtttaaattccaaacctacttctcattagctctgtggctctgagtgaagtacctgacctctaaaccttagttttctcatctttaaaatggggataagaatacctaacttcagtgatagtttcgaaagtatttactcaaatgaaataatgtttataaagtgcttagcacagggcctgaaacatgataagcactcagcatatggtaaccattagtccttaagaacacaaagatggaacagcaaaggaagcttagaatccacctcatgtctttccctcccacctgaaagaaattctccccatcccttcagaccctatggacctaaatttttgtctagacatgcaactagctttttcaccacaaagaaaaaaagaaagaaaaaaacttagtgtgctgtaagacagcacacgaaacatttatagtctactacagtgtgtatagcataatattctcttaaatgtattttctaaaagctcttatattaaaaaacaatgggaacaataatttcccatctcggcatgtctatagaattttgtggtctctaaatgatctgaactaactcggaattttgcatgtttttaacttgttgaatctgttgaatccccatgtacctatcacagtttcaacaattagcattcatggatggccttgtttcatccctattctccttactcttctagtccccaaatgggattatttgaagcaaataccagacatcacaccattccatacacatatactttagcatgaatagaatatacacagtcatgtaccacataacaatggttcagtcaacgatggaccgcgtatatgacagtggccccataagattagaatggagctttatgggggtaccaccttttatcttttacacactatctgtactgtaccttttctatgtttagatacacaaataacattgtgttacaattgcccatagcgttcagtacaacttcatattgtacaggtttgtagcctaggagcaataggctttaccatatagtgtaggtgtatggtaggttataccacctgggtttgtgtaagtgcactctataatgtttgcacaaaaacgcgatcacctagtggtgcatttctcagaatgtatctgtgtcattaagtgatgcatgtctgtattaataaaataaagttacttcaacaaggggggaaatggtgaagaaatgtttctgacctacctagccaatagttggctggataactttggaaaggaggcacctattgtgccttttccctttccctgacatccccagacacccagaaacttccctcacaccccaagaaggctttgcaaaggtgttcacggactcaggtgtcctctgagaggctcaaaacaatccccagattacctacatttttaatggggagggagctcaaaagctggtaaaccttcaagatccaaagccaggggatgaggttcatgtgggagagcaggggtcacctactctgctgccaatgccatctctgggccaaggggccaaatgtgaggatgacatgcttgcagctgggggaaacaggttgtccttctgcccatctttgctcctggctgtcctttcaagtctattagaaatacagaggaggcccacgcatactacttttaggatggaagccccatataatcaaaactgccggctgaaaatctcccaggtatatgccaggttagagacaggcacacctctttcagaggagacaacctggccagcttctcctccagcgttgatatacacctttgttccctaggctgggtaccagatgagctagccagcttgagtttagaataagcaatatgtatctttacatgctcagttcagcaagatgctatcagtgtgacaagaagatgggaactatacgcctagggaagtgacaggattacaaggactgggacaaatgctcaggcagtgtgtggagaatggcatcctccaccacacctaaactccctccctctccactgtcacacagttcacttcggtagttatttgttggtgaaatgcacacaggatgcatactgtgtcctctggcatccatatagcaatgggctcctccagaacaatccataacatggtggcttcacactgcctgcctgttggcttgttgtcaccaccccagtgctcaagaaaggaatactaaatgccatagcaaattcaaaactctgctgaaccctgacaactaggaaggtttgtattaggattaataaaacaatgatcaaaaatcttgatactagtacaactctgactcatttactgtttgatgccttgaatatttaataggtatcttgatgttgctcaaaacaaagcccttgattttcccatcagcctccttttctctccacaaacctattgagtcctacaaaactcctgcccctgccccctccttgccttcccagctccgtgtacagcattaccatttttcaaggggttctagtagctgctgtagagccatccttgactttctgctctcactcctgcatctaatccttcaacataaggatccttctatattggtatcacatccaaagcataacctgaatctgtccacctcttcctacctccactgattctactgagcgcaagcttccactgcctctaccttggacagctgcaagaaccctctatctgcctgcttccattcctgtgccagcaactcagaggcctttcctgaccctgatctaaaggaacaaccccactcccagccactccatgaattcagcatgttatcttctcagcactttatgctacccagaagtatcttgtttatatgttctctctcctcgttagaacttaattccattagattaggatctttcttaaagcctggttctataaaatctctaaatctgattctcccacttcttggggctataaaattagagagatattcatcattgctttgacatgggccctaatagtatttgatgaatgaatacatttttattttattacagtttatgtgttcaatgagaaaaaagtacctgattaaatctctgggcgttttccagaattttcctttcttccttcagacagctgtaaatgatcatagacatctggattgggtcttcctgaaaattatcctagatttgagtggttagaacaaaaataaattaaaatgcagaatgtttactttattgtgtattgtaagttgatatgaatttgtttatattctccgggaaacctcatctctcatctattaaattctatataagctatgtttgttaaaatcaaaatatttctttcacgaattatgacaaaaattgctttaactttctaagtgcaggtacctaacgtactttttgatttaaaaacaagtattttcacatatggttcacataatatttttactttaatatctttccatatttcttaaggccaattatctttggttaggatcccgagacaatgcaaatgatataaaaactatacatgacattcctcaatgaatgcatctgttggtctaagctttgaactagaccaaagatattcatctagggttttctgttgccattgtcaaagctagtttgcaaaacactaccaatagcaataatggctctttatacaggtacattcatgcaaggtctgtatgagaacaaatttctgtaaagttaatttgatttccccactcgtaaataaaatcataaatacattcacaaaggaaaaaaaacaacttccaattacctaagctgaaaagttcagttgtattgtatgaaagaagaaaatgatagctttcacctccattaaaacagaaaagttctgttattacacaacataaatatgatagccaccccaagggcatgctgggagtacatctgaagaacccctaaaactctatagcatgttctctcatgtctggatctttctttgactttctcttccaggagaggccaactccaccagaagcaaggcaaggtggagtctagttcctgaagtcacctgacttccttaggtgaaagtcaaacctttcctgttttattcctcatttgcatagcaaggacctgaacctaaccactaatgttccctggagctttaatgtattactatagatcattgctcttaaaatgtagccccttttctttggtttaaatattgacaatttttagtaaaacaaaattatagcatcacatttttctcaggattactgatacctaagaggtgatacatttaaccctaaaaattccttctgtgtttataaaataaattggtatcttattttacttatgctatatttactgatgctgtagaaaacataaatggagttagtctctattacttctctaaataccaataagtgtgtgctcaattgtatttgctgaatgaagaaaactgccttccataaacatgagaacatttcaactaaaatacaaaaaccaggtcatacctgaagattacgcttgcttttccttatgttatgctgtagcaagaagttattctccaaagaaaagcgactatattgatcatccagctgtgacaggaggtcatgaaaacggatggtggcaaatgaaacatcattggcagcgtgctccctaggagatttaacatttacacatttcattctagaactaaatgtctatgtaaaacagacaaaacaaatgttggtttccttattgaaattattaaaaataatttaagtattttcttaggtttattttcttcttttgaaactgacattgcttttagcagcagtttatgtggtatttctcttatgtgcaattagcacaaaaaattctaaactctaagagattgtgcatgacagtgttcatggtgactatctctgaagggggaaaagtcaacaggggacccttcactttctatgtcaaatactttcaggacgtttttaaattagcaaataataaattttaaagtagaacacctatcagttaaaaaaaatccccttaattttactaccttcttcatatttctaatcaatgtttaaccattaatttggctttatttcttttaaattacttctttctatagtctggatcctaagttggaaaataatcggtgtcagtattccgtaacttgtccaaagcatttaggaatatctatcataaattaaatttggcaaaactgtataaaagtgcttaatgactaatatacttaactttgttgagacactttttggctcaactttgttgagtcattttttaaatcaacaaacttttctacaacaaataattccagtggccattgatggaattcatcttccagtaaacatggccccaagtcacttaatcaaccagtacttttaaggtgtaaacttcttcttctgtctagtgaattttccttaccagtcttgcttttctaaccactgtgccaggtactgtctgatttccatgggaaaactgtcatcataaagctggtgaacctgctccaggaattttgagtcaagctgctgaagttcgtaccactgagacatcctatagggaaaaagaatatacattctttctatgtatatggaaaccatagctccaaagaaagccttcctagcatcaggttgtactcttaaatatcttgcttaatccaaaacatagtttgtcccaggaatattttatttaaatggcatttatagtctaaagcctgtttttaattgagtttggggatgaactttttttctcctccacgaaacacatcttcatgtctttgcttattgtcaacatatcagggcagccttctctggcctcttttatttaaactgcaaccacctcccaccctggaaacatgctctctcttttccctggtttatttttcttcatagtacttacaccaccatctgacctaccacatattttattttcattattgtctgttttcaccacttgaagggatggatgttggtggaggattctgtgcactggtgtatccctagaacaatgtcaaccacatagtaggtatccaataaatatgcctttaaaatgagtttgtgattttatcaaataaatacatgaaaaacattattttaattagacttgctttaagacaaatcacaagactctcccaaaattgctctcctacaaatcacagtacatttgtaatttaactcaaatattttcaaacttctgttttatatttatgattcatatggtaaaattcattatttttcttatacacatttaaaaagatatattttcttctttgcctactacaaacaataaatctggcataaagaagtaatgatttttaaagattaaaacatcattaaatgtaatttaaaaggataaagtaacacttagctttttggataactgttaagtccatttttacatagtgatcctaaagattcaaaatcacaacaaaaacttgatataagcaagtcctaaaattcattaggaaaacggagagtctcccatgaccatcatgtaacttaggatttatatcagcacacaggtggcaatatgcagagcagacacaagtgaatcttgtcctgccagacctctggggaaggagtctggattttcaagtagggcatggaagagtgtgtatgcatacttgtagccgagcacatgtatgcaggcatgaggtcacgcctactccacaaatgtccttccaaaggagtgtgaggaaatgtctggcctataaagctagttatcctcatatataccagtagaaacggacccaagcccagccccttggcactcctgctgaagcaatttgatttttcagttcagttttattttacctgagtggaaaaatctgtggctgtctccctccctgcttggtaactaataaggatctacctaaagcagatatgctggaccgtcaggcaatgggagctgcaacgcctcttattagccaagcgaacccaggtaacttactcccctatcaacaaggtgtgtgtgtgtgtgtttagtagacaggaacttgctctgtcatccaggttggagcgcagtggcagtggagcgcagttcactgcagcctccaacccctggactagagcaatcctcccacctcagcctcccaaggagctcagactgcaagtgatatggtttggctctatgcccccacccaaatcttacctcgaattgtaatataattcccatgtgttaagggcgggaccagtggaggtaactgaatcatgggggcagtctcccccatgctgttctcgtgataatgagtgagcctcatgacatctgatggttttataagccactggcatttcccctgcttgcatctattctctctcctgctgccccgtgaagagatgccttctgccatgcagaactgtgagtcaattaaacctcttcactttataaattacctagtctcgggcagttctttatagcagcatgagaacagactaatacaataaacacgagccaagaagcctggctaatttttaaattttctgtagagacagcctctcgttatgtttctgaggctggtctcaaacacctgacctcaggcaatccttccacctcagcctcccaaagtgctgggattacaggcgtgagcttccgcaccctgccacagttggttcttaaggctggttgagctagtacatatgtagcacctggcacagaagaggtgaattaataagctcatgtttgggctggccaggtggctcacgcctgtaatcccagcactttcggaggccaaggtgggcggattgcctgagctccggagttcaagaccagcctgggcaacatggtgaaaccttgtctctactaaaatacaaaaaaaaattagcagggcatggtggtgtgcacctgtagtcccaactactcgtgaggctgaggcaggggaattgcttgaacccaggaggcggaggttgcagtgagctgagatcgcgccactgtactccagcctgggagacagagagagactctgtctctaaaaaaaaaaaacaatgaataaataagctcatgttcacaaatctggagtcagtctcatctactcacaaaacctgttaccaactcagggagtggcatggccatctcccagtcactgagctcaaatctcagatttagggttgattccttccactccatcccaagacctgctccttcctgtctccaacattctaccttcccagtccagcctctgctgcccacagattggaccacatcaatctcctgtgcaaaaatcctatgatctgtccattcctaggcagatttccaccccaccccatcttcatccatcaacaaagcaacccagtcaccaaatcatttactgtttttcaactgtgcccaacatttctgctttgctccagctactcgcccttggaaacagcctctccacaaatttttgcgtctctaaatcctatagcattcaaagctatgtacaaaagccccttctttcataaagttgtctgagacttactcacaattaagctttctttgacttgcgtctcactgaattctgtacctctattagagcatcggttccagttttccttgtaaagctctgtgatgcctccagagtccccggcgggggaaggtgggtggggagggggtagagtagtggggtattttgctttttaacatcttatggaccttggacagtgccctgcatatactatgtgctcgaaacagtttgttgaattgaaattatgtatatttcagacggaattagaaagtaaaaagcaaaccatattatgatctcacaagtgtgagtccagcatcctcattaagcaatggttgcacaatggactgtgctggaggctcaagtcctgtttctgttctatgaaaataactccttatctatacaaacaacattcaaagcacaatcaaccacacctctgcatacctaccacagaactcttcagtaccggccagaaatttttttaagactatattattttggggtggggggtctgcaaaaactaaacatcacttttaaactctaggaagacattaagcccttccatctttgaacatagaaacataattaagattccgaagtcatgtactcattcatctgattccatgaacatttactgacctgccaccttgtgccccaacaagggcctggggattcaaccaaaggagcagctacgcacagcacgttaggtgccaagactgtcgaggttatatacacagagtgcgaacgttaacctagacagctctcgaggatggcatacagcaaatgaaactttctgcgaaaagaagaaaacgtgactgatggaaaggggtggaaacgggagaaagtgacggtaaatgggaaggtgcagtgccttctagaggaaaattatatttcacaagtcctcttcactgccagagcacgactggcaaggacaatcgtgctgagcagtgccatctccgagaacaggtggcactgctcgcacttggaatactcaggacgcgttcttcctctgggatcactattcgcgggtcagcacagacggcccgtcctcgcccggcgtccaactgcacggcccgaggactctgtccctgcgcgtcccacccccggcacccggaacctcacggccactcactctgcgcgcaggatccggaagggctaggcgggggcgcggcggtgcagcctctcccgagcgcgctgggtcgcctctgctcggtctggggtctgccaggcgcgatccccccggtgcagccgagcccctccgcagactctgcgcaggaaagcgaaactacccggcaggagaaaaggcagcgctggcgcccggcccccttccgcccccaccaatcaccgggcggctccgcgctcagc

SEQ ID NO: 2048 - DNA, 38714 bp, Homo sapiens
  source 1..38714: mol_type = genomic DNA
atcaacttttgctcattttatttatactttttcaaagggtatcagttttgggaaaatttatataccttaaatacaaatttggtttttggctttttttttttttttaaagtagtaaaatgctgataggcagtaacacggggatctcaacaagttcagctgtgatggcgatagcaattacaatggaaaagtaaaatacaagcatcttcaacaggccccagccaggagcaaggctggcttgaggtttgtaaacatgtcactcttctgtgttcacttacacttcagacacagaaatcaactcagtcttgatatatccagttcctttagggccatcaagttccattggctctggtgctagaaataaacacattgtgtacgctttccatcaaccgaaattccatcagaatacaacatcaacttttcggggggattaaagttctactgtgtttctagacagcttagcctcctaaaactttaaggagctataacctccctgcctgagtcacctaaaattctagtgggaatgcagaaacaacgagaagaaggatctgaattcagtctggaaataagctagtgttcagcaggacactagctaggagctttctctttacacaacttgaaatcttacaagaagtctgagcccaaaatatgcaaagttctatccagtttattggcattagcctggctaatgaatattcacagctgtcaaggtaagctggggacatcttcattccaaagtaattgtcctaatattgagatttctgattctgaaaaacagctttgttggtgtgttccaaacaaaacaggtctaattcgaaccttctcaaatgcaattcattgacaactgagaagcaagagacctgtgttctcagatgaggcctcctcttaataattatctaataaaaataggatctagtaagtaattgggccaccctaaatgaaccacttcacttctcccaggcctcagtttcctcaactttaacgtgagcaagatgccttctgttggtttaccacagttccttatttaaacccttttcatgtggaaacagtgatagtaacaaatacacaagaccagcaatggacttttccaacattcctaaaataggaaattgtccattcatttcttactagctgtatcaggccaaataatgcattatgtttcacctgcactgagtttatgccatcttttgaaagcctactcttaccaattcgaaagcaaaacactgcatgggtggagtttcagaataatcaccccctcatcaggaaagactgtgccacgctgttaccacctgcttgccccacttaccttcctttggcctggagtaatactttccaaaggcatggtctttgtcaatatttggatacagatacttcaggggattctcaggaatattctcagcagccatgactttgtaattgcgaatgatgtcagggaaagtaacagcagaaagttctttcttcgtgtagggttcaaccgcatggaagtcaggttctaaaaaggagaaaagctaagtaaatcccatagaacatcccaaaatgaaagaggacagagaaataaaacactgcagagttgatggatttgagtgaacctcataagaactaatcacaatctaagcattataacatatacagtagactgctttatttctaaataaattataatactgtctcagggaaaataaagggaggtattattctcaataacattctatttgccattatttgcttagatttataaatctgggcaaaaaagatttattaaaaacctttaaaagcctgcatcttcaatgatgtgctgcccataggcacataaataacttactactaagtggatcatcttggcttaagccacagatttaaattactagagataaactcactttgtttttcttttcatattgaaaaatctaattttttattaaaataaattatgatatatagaaaacaacatttcaaattaaaaatgatcctatttgctacatttccctgtaacccttaacgtaataaaccatggtttaatttactcccgttcttattcccagactgaattcagatccttcttcctagctgatacagaatctccctttgggtgtcgaccttccagaggccacggttcaggtgttctggggagcctgctgtggaacatgagactatgctgccatcctaacccttcctggctggtagtgtcctgcttgacctttcctggttgccaagggttttcttcatctctgcttggtctactatatctgtctctcagctggttcaggaagggaacaggataagaggaaaagggcaggttctaatgactactgcccacgccagactctcatctcagcctccctgctttttcctcagaagaaaaatagaacaagaaaagtattccagaaaaacaaatagaacaagaagagtattcctgaaaaataaacagaacaagaaagaataccgttccagaaaaaaaaaatagaagagtattccagaaaaacaaacagaacaagaagagtatggcagaaaaacaaatagaataagagtattccagaaaaacaggagaagaggaatatttcagaaaaataaatagaacaagaagagtattccattttgtgtctacccactgaaagtataaaaattactaaaacaaatcagtttttcctcctgcccttcaaacagaccaaactctaaacaacagtgaaaagtaatcagttggtctttatgattttttcatttacgctgttgagcttcaccctcagaaacctgcttcataacaccaaggtttctggagtcttttagccatggactcatttgattaaatagaaaccccatatatgataaagataaatttgcagctgctctgtttgaaggcagggtagaggctgccactcgtcccaacaggtcctgcatcaactccctggctgatgatgtgtatgaagtcttctcccgaagcctgtctcatctgcacactctactctgggatgaccctaagagaatgtggatgcttactcctgtgggaaatgtgattccttccaagaacgggttgcagattacattgactcacatccttgatctgcagataacaaacctgatgcaaaggaaagaattggcattgtcttttcaaaaccatcatttccacaatatgttccagagagtgaaccacaaccacaaacatttgtggtggtttattaaatcctatcgggggctcatttggggtaagtataagatctgcaatttcatgtcccaaacgcactatctgtatgagctgactggcggcgatgaagagggacttcacacacatggaatggtgggactatgtgctcaaactcccactcaccgcctccgttctgggaccgctccacccatgtgaatgtgatggccccttcccgggagctctcactgaaccgcagcaggaaggtccccggctgctggtccttcaacagggcacgctctcgctccttgctgatgaagcccatgatgcacctggatatcgaagagatggacggatgggcttttagttcaatcatgatttccattttcatgctaacttacaaaccaagaaaatggctggaatgtgagaaaaaaaacctacggtaaaaaacgtagactattttaaaatctgttcagttgacacttaaggaagcatttcacttatacatgtatatactaaggttttaaaaaaagcgatatgaacatggtgtcagtaggatgctacagatgctcaataacacgtgtgggattaatgagccttttattgttcctttattattttaaaggccataacaatgtctgaatgtatacatcttttttactggagaggaagacctaggcaatatattttcatattttagcccttctgatcaagttaaagcttctgttgaaatatcagccgatcctggcaataagtcaagatagaaatgatttacccagttaaaagggtttttcttccttcctaggggccacatagtaggtgctcaaaaaatttttgttgagtgaatgaatgcatgaatggcactcaagagttgttttttttttttaatttagctttgccaatacatatacttgtactaagaaagtgtaaggttaatgttatgaggttctactcttctgaagccctgaaggggcagcctataaatgcgcactcctgtgagattcacacacgcctagtcaaatactgaagctggactcaggccttgtctcaacctcgcagcactaaaaatatgtttcaaaatacatctatcggtggcccttacccatcattccagagagggagcaggtgttttttaatgagttctaggatgctttcaatccaaagccagaagggaaaatttttatcatttatattttcctgaaagtatacaaatgcagacattatgaacaaaaatctaaaacaatgacttaccatggcccctcccaccatcatttgcaaagactccccaggtgccaaggatggaactgtcccattcagcacagcaatgggatccctcccctggcagggaatatcaagttccctccccgctcttatcagcattcagaccaggagctctccagagctctccacttccctgggccgggctctgcttccctttccaaacagtagcaagctagcctgggggtgacctccagcgtgactcacggaaacacaagctgccccacactagcaaaatccagcagtgcaagctggtccgcactgtctggtgactccagcagaatctaaatgttccccgcagtgggcccctctgctcgagcaggccgttaaactcgtctggctggtcaggctgcgccacccagcccacaacatacatttcacacagaaatggctaaaacactgctgggcaggggtccagcgtgagtgaacagaagcctcatttcagatatgaaagaatgttatcactcaggcaggtgcttcctgtcagactcctgctcggagaccaacctcctgcactgaagaaaagtaaacaacttgcccgaggggctccttggccagagaagaacacgccaaaataagcaaacagttaagtaactatcacagcaagaaacatgagaacctcaaccaagagcaaaaaggacttagagagcataaaacccagacagtcctcaccttacaaaacctcgtccacggaatgagaccatcggggctggcgttaggacctaaacaaataaaaaccagatttttcagcaaacagaaactgattctaaagctttggttggacggatggctcttgtatttgctctcaaggaaaagagccaaacacccaacaaagattgtatgtacacagttgacattttcggataccttaatgccaaattaactgagcaattataatacgtgctgtaagagggcggaatttaaatggtctaaaatatgtatatgttggtttgagtttaatggcagaaaggaatggatggcagattcctgggcaccacgatatgagagtttttagggaaagcggaaacatcacaaagccttaccatctgctctctccctccccagccccccttttccctccctcctctaaagagaggacagtccttttaatgcctcttcatgttacacttccttccaagaccatcagctgactttgccttttgcactaaatcaaaggtgttctgctgggcctcctagagaagcctccctatccagtgcctcttcccactgccttcctctgctgctcagcagagccccctctcccaaggatcctacagaatttttttcaaagttcaacctaggtgcccaagatcacccctagatcttcaatgtaactgatacttgactttacaagtttattttagacattatttatgcatttccctcagctttcctccaaataggacatgggctcaggcagtctgatgcaaatcaaaaaccaagtgagagaaacgagaggaagaagcccggggttattagctacacaaattaaagcagcctgggcgagaagaggcggtaagcccattatcggtcttcaaagagaactacaaatgagccattacagctagaaaagatatccttcttaactctcaccaaataaagaaatggaataaggggattttgtacttgtattaaacagcacaagaccaccactgtgacagctgcatatccaagagaagaaggcactgttgaaagtcactgagttaggaagagcctactgctgtttggagtaaatgcagtgctgctctacagaaagcaaatctggatacaagttgtccacggatttttaaagaaatagttcagatagcctcactcactgaaagatctgaccttgagactagtggatctttgatttgtttagtatgaaggactaataaatgcactgacattaaccactgaaagggaattatctaccactgtctagactctgtccaatcaggcaaaactgcagatcaaaagaggcatcctcttgtggggacggcatcctctgctacctgggccccacctgaggcaagggccctgggtttatgctgcagtgggcaagccccaggactttatttctcatcatgtcagggacttccttttttctccccaaggttaatggttaataggccttcatctttctcatccaggaacttatttcagccacaaataatatattttacataattcataaaactttcccttgggaattcatctcagaaatcttaatatgagacaatgaggaacggattcatttaaatgttatcaggtctatatttctttctaaggtgacatatgattctcacttagctataataaactatagcttgaaaagctgacagattttagtacttttttacctttaacaaaatagcagaggggaaaagagcaattagagagatatttttatgaatttcaatttttataaacataacaagttaatatgcatataccaagaagcttctctcccaacatgttcagctggtccacattgagacctcttttggtgacagaagaaaactgccaactcagcacttctgaaagctgagcccatcgtgcacatggtggagtcaggaagaaggacagattctagagagaaaacacccaaaatctaagggttactacagagacaccagtcacaagtgtggcactaaaacatatgtccatcccaaagttcaattctagtttatatgacacacaggtgctttcacagtaggggaagagaaatacagtcaattttcattatttacagatgcacatttgtgaacttgtttactcactaaaatttacttgtaactccaaaatctaaatacatggcatctttggggtcatttgaagacacacccgtgcacacacagcagcacacagcagcaaagaattcgagtctcttaacacgcttccaactgaagccaaacaaaatgacactcgcttcctgtttcacctctcataagaaaaacgtgtcctttttgaagcctatttagcgccatgttttttgcattttgtgactgctgttggtgatccctgtttaaaatggtgcccgagcatagtaccacagtgtggtctactgttcctaagcatgggaaggctgggatgtgccttatggagaaaatacatgtgtgaggcaagcttcactcaggcatgagttacagtgatcctagctataggtgtaatgttaatgcctcaacaagtgtattagataaggtgtctttaaacagaaacacacataaacaatgttatgcattgatgggttgacaaaaatgttgtgaccagaggcttgaaggaacctagcctcgtagttcccttaggagcaacaattcattatttgctagttaagtgttcctggtgactttaaaaaacataagtactttgaataattataaatgactgtaattaattaacagtgagtatccacactctaagaatggagcatgcttgtttagtagatgtatacattttaaaaataataacaataaagtggtatggaatcactgactgccctagcttacccacatgggagaaaaaacgtaattctcatttcaaatacatatccatgcttcatattcccagatttactcaaaagccttagaaataccacaggagctttgtcacttctcccttaacaactggccattggggctatttcagagatgcagcagtgagagcgtggggtctctgcttaaccctgggaccaaagcaaatgtgttttccataccctgggttccgccaccagcatgttgtaccaaaggatggaggcccaaccgctcgggagctggctgacgttggagatcaccacaacgggcagagaggtcgtctaaaggatgacaaagaccttgaaatcatctgaatcacagaaatgtcaccttcagataactgcttagcctcaactaaaagcaggggattatttgtaaatttgtacatatttaatacttgaaaatgagaagtgttaagttctgttcttctgtccagtttaacttgtctttgatgtatctttcagttaagaaataagtccctaaaaataataatagctacaataattaattaagggatatgcaatatgagaagatgaaaactgtcacaatgaaaacataaaatgtggggggagggcagagcaaaataaataagtcccaatgcttaatgtaaaaaaaaaaaattaacatcagcgatctcaactggaacttttaagttattgaatttgaaggttaattcaattgtctagctttctggaccataaattaaggttaagatagtattagctgaaaaagatcattttaaaacaattaggtaaatacctccagaacaaacactgagaaataaaaatacatgtaacaattaaaagtaaaaataatgaagttttccaactcgggaccataaaagtcttacctcgaggtcaattaccaaaccaggctggcacaattgggtttcaaaactaagggagtgaagctcttcagtaacgatgagaggacccttggaagagaaaaggaaagaagaaaagaatataattattcacagatcctaaaactttcaaaagcccaattaacattgcaacaggccacagagatcctgggcccaatcagtggcaagtctgaagactcaatattcaatctctcccagatttaatgattcttagtatctcagtgtgctctgaaagataagtgtctgaagttacggcaagggttatagattcagagcaatgattgtcaatggggaaagagcaactaatggctttgtgacctaaggcttctcgaccctcagctctgtctgcctgcccagtgtggctgcacatctcaatgcagatgggtggggagaaggtgagaggactgggagtaagtgcatacttgtgattgtctactgcctaccggaagggctgactcacatcaacttggcaggtcacaagttgtcttggtttcggtagaaatggatagatttcaaagtgccttcataagcattacctcatgtgagcctcacaacttagaactagagaggtgcaacagctagacccagggaggtcaaaacatagttcaggcgcacaccagggctagaaggcatctttgcactgcctgggcctgtgtttgtcccgctgctccatgtgacctccactggtcctggtgtggaaggactgcacactgtgtgtgcataaatgacgaaagtgttctcaaccaaaacaactccagatatttcatcctttgtccatagttcatttctgaatgcatcacaaacccaactccttaaggatcacgctgtaggaaggaaactgatgcaaaggcaatgcttttggtaggggatgcaatggccgaaaagccctcttggcacacagcaaggcagtcatcaaagtggcctctcgttccaactctgacagtaactctgtgcacccttagctaaatcctgcaaacttctgtgagtcaatttcttcacccgtaagatgcgaagaatacaaaagcccacaacagctactccactgagttgtccatgagtgtctaatgaatttgtgtgcaaaatcgtttgacaatagtaaagcacaaatgtggtgtttttactgttgtcacagatataccaaatacccagctcctttgctgctcttccctgatgggtctgaactcctctgtgaggtgtccccagccaccaactgacctgtccttgctagacagacctgcctgatttgggcccattcacaacataaagggactctcacctcattcgttctggtgccagcatttttctgttctttcaattgctataaaacaaataatcatcttagtaaacaccatggtaatggtcaaagttgctatcttcatttacaaatgagaacaaagttaggactagaaagaatgacagacgtgactttatctttagaatgcagaacatgggacaaattggccctcgttcagggtccatgagcagaagcacgtttcctcagtggcctcatggtgcggacaccagtctggagggatctcttggaatcacaacccgctcctctcctgtgttcaaactttccctgaatgtttccccatgcaccttcgttaactgtttcatgccctgaggctcgggacagcttctccctcccctttccctcagcagagtcctccaggctgggcccagtgactccaggtccacctgccctcaagtggacgtcaatctctgagctgtcaatccctgagctgacgagggagcaggctggggccctgagggcggctctgaataccctcaggcacctgagttgggctaagctttcgagttaggtagagcttcctagctacgaggcttgctggatcacaaagtggtctctagtgaaaaaggatgcctttaacctcctgcaggttctgggcccagggaaagcttcggactcagcacccacagagcctcacagcaactggcagcccccatgttcacagaggaggaaagatggtgcacccacacagagcatcctgctgggtctccactgcctggggaatgagccctactgccctggagaaaaggtggtagagtcaggctggcgtggaggcaggggctgtgggcagggccaccaggaaggggaacacgggggctgaggagtgaaccctggtgtacaggaccacacttggatcacagtcaggacacgggagccataacctttgagaaaactgcaagcgtaggtgagtgaccgtggggatcatgcaggcagcaagtgcaaatcatttacgtaaacacaggcttaggaaatatttttactgcaagtgatacagcccagaaaacagagtgaacagtcgtgggataaggaggagaaaccaaaatgccccaagtactggcgacaggaagacaccagccacaaagtctacaaaccccagcaggggggcgtcctccacatggcaatgtgccaaaaagggctgctctattgtcaaaagtcctaagaaaccagagacaacatagagaggaaactgatgtccctaccaggtgccgaaattcagccgccagactgccattggtggactcctccatgttcatcacttttgtgtgcgtgcccaaaatgttgaacttcctaaatctatacaatataggaaagaaatgctgaaaagtcttccaactattaaataaataaaaatatagcacagtatagcgtaaagtacgtcacgtacccttttactgtatttctctcattcacatctctgcaaaaaaaatatatataatcacatatgcgtatttaaaatttgaaataagctttaacaaaattataagagtataagagcataagagtgtaagtgaatgatgaataaaaaataaatctacacctatggatttgcagcctttcattcactccctgcttccatctacccatactaggtctggcaagtatcactgaatgacctttggcaaataaatggtctgggccttacattgttcatttgcacaacatactaacagtgccaacatataggacatcatgaggaataaactagttaattcctcaccagtacaccctcaataaatgtaagcaccagcaccagtacaccctcaataaatgtttaagctatcgttattgtttattgagcagctacttggtgcaaggccctgcactaagcactggggatccagccaacagcactgcccagtagtcacaaagctcagaggactgccaatgtgaccatttaattctcatttttattctctatgatctttaatgctctcatgaaagtaccaggaaagtcagttatctggggaaagtggcaagtttaagttttaagtctgaggttaaaattttgaaagaccttgcacttctatatccagtgattactttgtcatgttctggccaaataatgtatccgtgagcgtcctagatgtagactagaaatcatgggctcactcacagatctattagttccccttcctttccaatctcaaccagaagttcaatgcttttgtgaatgacaatcaccattagctatggaagggacctattttcccgtttggaaaaaaaaagaatttaaaataaaagggatagtatgataaaagctgacttgtcaaagctaagaagaccgtcagagctggaaccgacagaaaagacacaagggcccgaagcagctgagaggagctgagctgacgcagaagatggtaaactgcaatggcaacacaactcttgtgcttcctccgtttaggaagtaggatatacttccccatcccccgaatctcagctggccttgatttgcttttagcaacaggatggaagggagtgatgctatagatgttccaaggctagcactcacaggccttgttcacttggaacactgtcaccatgggaaaagcccaggctagcctttttgaggtgcatgaagaaggacctggttatcccagctgagtcccagtcatgtaataaggccttgctagagcacctggctccaaccacactagctcagaccaggacaacctacaactcacagaatatgagaaataatgagtttttgagtttttagccactaagtttttgtttgtttgtttttagacagagtctcactctgtcacccaggctggagtgcagtggcatgatctcagctcactgcaacctctgcctcccaggttcaagcgattctcgtgcctcggcctcccaagtagctgtgattaccggtgcacaccaccacacctggctaattttttgtatttttcgtagagacggggtttcgccatgttggccaggccggtctcaaactctggcttcatgtgatctgcctgccttggcctcccaaagtgctgggattacaggtgtgagccactgcacctggcctagccactaagttttgggagtggtttgttaggaagcaaaagctaaccgatataccaaagatgatggcagggaagacaaggcacagaccatgctatgaggaagaatattcttataggagtgggaaaaagcaaaaagccagaggaaaatgatctgaatgatcataaatcatttttgaaacttgccaaaacagtatgtgacacaagctaacaaaaacattaaatatgggaggggtggggggggagccatcttgttccttaatgagagtggccaagttagtgccagtccaggtctagggtctcagggcaaaataggatgaggctgctccacctggacccccaagagagatgcccattcctgggttcccactgcccagaagagacaagagtgaatcccacaggctccacacagtctccccaagatgctgctgacctcgctccagaaaaaaacccccaaatgaccacagaatcatggcagcctggacgttcagcctcgggttggatcaggggcctctcctttggggctgacctagaaggagggggtggcatgccaagtccagccactttgagacttgctgattacaatctcatatgcacaaagagacactcactcttttgttcatttatagtctaaaaaggcacaggaatgttgataccagctccaggggaagctcccaacatccaccaagggagctgctgatttaaatctgctggggtcatttgtgatggccctggtggatctgactagaagtctctgctcatgcgcagcattgtcaggactctgggttcagccctggggccctagggaggcaaacttccacccagtatagacccttccacagctagaaatctgcttatttagtggaggaatctgtgcttgagtaacaaaatcaacatttcaatagtacatgtatgttatataatgttaaagatatcttacttatcaaataagactttgactttcaaattataattcagctcttgcaatttcaccaacagtctggaaagaaaaataaaagccattacttaaaaaaaattatctgttacaatttatttattatgccaattccctattaacgtttagataaactactccccctccagttttagggtattaccaacaaaaaaactgacagttttgtagatctacttaaatttttgtaagtgtatttgtaagaataaattcctagctgtggaaccgcttaggaaaaattgtaacactaattctgacaggatgccgccctgattttacattgccaccaaaagttaatgagggtagctgtttacctctataaccttgccaatattcagtttcatcacaatttcgacctttggccaatttatatgggtaaaatagcaaacattactttctattaaaacttgtatctaatctttgtcctgttgggagacaataaaaactattgcccataagcagaaaaaatagcgtcccatctatagtcaccccagggtagcatggaaagatggagggcaggtgagagggtgtacctctgctccactgagctggagactttgagaaggagaccccggggctctgtctgctccgttcagtggagcaggtggatgggatcagatttctactgtcccttccagctgctgagttctaaaattccacgagggcttcagtgtgacattgtacctaccagccagggagggttaaccacagacttaaatcagcaacaccccagaaaaaggacccgggccaactatgaaggccagtccagttcttcagcgtctagctactcatcataagaagaatgcttaaagcaatgcagccattcaatggaagaaagtaaagccacatattcctggaaacacttctacaattagtatcgaggagaaagactacaaaacaatgtatgtagcctactccgagtttttaaaaaagaaatatgtcatatttgtgtgtgtgtgtgtctctatatgaaatatttgtgtagacatggaatcctaattttttaaaaaggaaacattatgtcatgtttgtgcgtgtgtgtttccgtatgaaatatatatttgtgtagacatggacaaaatcctgggaggacagacactaggccatttactgtggtggtccacagatatttatatcacggactgctttgagaaactgatgaaagctataaatccatccatcagaaaaatgtacatgttataaatccacattcatacagcttctggggttcataaggctcaggttatgagcctatgcccaagaggggtgaggcagccaggaacttttactctctattacacacatttctgcaatttggaattctgttttcctgtgaacacgcattacatttatgattggaaaaaaaccaggagtgtgtacatatatgtatatcagttacatttctactatgaatatattaataaaagactctcagatattctcagtaagagttcatattaaagtgccccctgaaaaattatttcctcaaaagcaccctatataacagtttttataaaaggaaactaggggtacaaactacgtgacaggtgatgtatgggatgccatctttcccttgttacctcaacttcacagtgaactggacccctgtcttcaagaccagcggcctctgagggtgcgttggcatgcagggctgtctttccaccacaaacgagctgcaaatacccagcaaaggatagataagttagcatttccattaaggttgaggcaatcacaatgattttcctgaaagaaaaaagggggttagagagtacgatctaaaaaatcatttgaaagattctgacaagttggatgaacaaagtgatattttctaattagtaaagaaatcccaaaacctaatagggacttaacagaaacagaataactgtaatgatctgtgaaactattacattgaaacaaacatacaatgaaggctaggcacagtggcccatgtctgtaatcccagcactttaagaggctgaggtgtgaagattgcttgagcccaggagttcaagaccagctcaggcaacatagtgagaccgtatctttacaatttgtttttttttttttaattagccaggcgtggctaattagtcccaactactggagggttgaagtgggaagatcacttgagcccaggaggttgaggctgaagtgagccatgatcacaccactgcactccagtctggatgacagagtgaggccctgtctcaaaaatccaaaataaaaaataaaaaccccgtatttaattatgttcatttacatgtcagaattaagaataaaatgtgcactcaaagtacaagtaatgtttttaaattttaaaaaacccaacatacaggacttcttgtttgaacattagccatagggaaccaagtacatttttttaaatattacttccaataagtacgatatttattaaacatatcttcagttgttttgttacatagtatgcaacaaattacaatattctgcagccacaaattatatgcagagtatgaagaagctattaatcagacagtgtaatctttccatttataactctacaaggaagaactagcaaatcagatcttacatataacatctcactaaactttacgcatggaaagtgacagacactgcttgtgctgtttgatataaaatggctgaacttcatcttcagaagactatacctgacatctaaacacaccaatataaacatcaaaacaaaatatattctaaccaaccacgagaaaacagtctgatatcaggaaaatacattattttataaaccagcacacaaaggtttaagacagttctgaaaatgaagttagctgtcttgagtcaagagaataaaaaaaaaaagtcagtattgaccatttacaatctctgacctctgtggatatggtaagaatctgttgtagtgcagctacatacagtacaattcaggcaattttgtttcttcacttgggttcagattgcaaatttattactgtgagaaaaggatggaggcaaattttagcaggaacctccacctgactgcttgaccagagtgctctgaattttaacactggacttctcagcaccaccagctgttgctccaggacccattagcttcttaatctcagctgccatcatcatggaacacagttctacattcattgcattctttcttttttttttttttgagacagagtcttgctccgtctcctaggctggagagcaatggcgcaatctcggctcactgcaacctccgccacctgggttcgagcaattctcctgcctcagcctcccaagtagctgggattacaggcgcccgccaccatgcctggctaatttttgtatttttagtagggatggggtttcatcatgttggccaggctgctctcgaactcctgacctcaggtgatccacccacctcggcctcccaaagtgctgggattacaggcatgagccaccgtgccgggccttgttgcattcctagcactagtttccaaaaacagaattccaagggaatcagcaaattccttggctgttgtgtagtctactactttctctgtggtcagatcacacttgttccctaccaacaatttgttgacgttttcactgggataatgatctattttctgcagtcactgtttaatattattgaaggactcctgatctgtcacatcatacaccactaggatgccattggctcctctgtaataactggagatgactgttcgaaacctttcctgttctgctgtgttccatatttgaagcttgattgttttcccgtctaactctatagttcttattttgaaatccataccaattgtgctgatgtagctttctgtatatgttatcatctgcaaacctaagaaggaggcaagactttccaaccccagagtcgccaatcagaagtaatttgaataaataatcaatttgggattcatgctggacatgtcactgtagctgccaccgctgccacggccacccttgctgctacagctgctgccctgactctctgcaccacgggtaactgaaggaaaggaatgagataggctgttctgggagagtaaatgtcttccccgactctgccccctggaacgcaatcagcagccgctgccactcagctattgcttccacccaaaatcaagtacatttttatcatgtcaagtttgcattaaaaaaaaaaaaacttgcaatatgaacccttcttttccactcagtgacatttatctatctactaagtgtgtctagagagcctactgttcacaaggcactgcgctaggtcctgctgggggaaaagggtgacaaaggcatgtctctgccttccagaactttatgatattcaagaaatataaagaaatacataacaactatataacaaaaggcagagtaggaaaggaacgaagggtgactgtaggccacgaagggagataacatctgtttgggaaatctgggaagattaaatgatgagatacaaggtgaagctttcgggatgatacaattttgaaagcaggtacatgaaaagaaggctctgaggaagaggaagtatcctcaggagagccacagaaaagcaagtatgcggcatggcccctataggaatcagcaagaggtcaagtttgcctagaaaggggcgtgtgtggacgtgaagcgtggagtgttcagctaggtccaggctgcagaaggggggccgtgaatgcccagctgggcattcacttggatcagcaggtgatgaggaaccagaatggaactctgctctgggacagcactggtcacagggaggaaggactgggaaggaggactggtggggaggctggggaagagtccagaaaggaggatttgagagcctgagacatgaggaggggagaggaggaggtgaggcatgttagggtcacggcggagactcagccaaaggggaaggaggagtggaaggttactatagcttccagcctagctggccacaagagtgaagaaccactggtataaccaaataattcaggaagagtcattgtcattaaaaaatttgaggccaggcacagtggctcacgcctgtaatcccagcactttgggaggccgaggagggcagatcacctgagttcaggagttggagaccagcctggccaacatggcgaaacccagtctctactaaaaaaaattagccaggtggggtggcatgcgcctgtagtcccagctacttgggaggctgaggcaggaggattgcttgaacttgggaggtggaggttgcagtgagccaagatcacgccactgcactctagcctgggtgataggtgagactctatctcaaaaaaaaaaaaaatatatatatatatatatatatatatatataaaaaacacctattaaacccttgtaaatcatctgaattaacggtaaaatgttcctctgtatagaccgattacagaaggtacaaataaatgtcccttgagttacctctgaatgagctgctggaaaagactgaaggtgcggtcccataacacttgtttgttttttgtgatagggtcatgttcgtaggtgtatttctgttccaattcctccaactttttaagctgctgccgaacttgctgcagactctccgcaactatagtgaacctgggaagacacaagacacagatgtctctatgagaaacagtccagaagcagcctggattaaagggaatcatggtatattagtccattctcatgctgctaataaagacatactcgagactggagaatttataaaggaaagaggtttaattgacacatagttccacatggctgaggaggccccacaatcatggcagaaggcaaatgaggagcaaagtcacatcttacatggtggcaggcaagagagtttgtggagggaaattcccacttataaaaccatcagatctcgtgagacttactcactaccatgagaacagtattgggggaaccacccccatgattcaattatctccacctggccctgcccttgacacatggggattattacaattcaaggtgagatttgggtggggacacggccaaaccatatggcatggaaaccaacaagtggttatatgcaacacaaaatgtcacctaggatgccatgctctgccctctagggaaaaacaaagggaacgaggcttgtgccagcagtagaagctttgttatttgaggagtacaactaacatgcactgaatgattacagcctacatcaaaaacttctacacaccactgaggcctatgtgaggagagatgggtggaggcagggcttctaggtgatctgtgactggtgcagggcaaagaggaggccagaggcagggaaaacagcaaagcaggtgcttccaggtgatgcaagaggcagcaaagagccactgcaggttctgtcaagagagtggcatcagcaagcagtgtctcggcaggaccagtcagagatgtggggcagaggggcaggaggagagacagagatgggagacaaggccggggacaggaagagaggaaggaatgatgattctggtttcactcaactgaaaggagaaggcagtatgctcagtctagaccctaaacataaaaagccaatgagtaaacccagtgattgctcttagtcttccttccttgcagtcaactgctaacagcaacacaggctggggaaacgctgttttattcacttgcagtaatgacagaagaaaaccttttaaaagtgtcttcttccctgggaaaagtatctacttcactttctgattttgctcgattccagttcaaagccctgggacagcagcccttcgtcaggaaaggagaaggcaggataacggctggctgagttccagcggagaagctaaaccagtgtccccaactctgcttgcacacagagaaaatgacagcacagtgggaaaactagagggcatgtgtgtccctacaagaggctcctgtggtctaggaggaccactagggggctctaaacaccccagggcctccctggccacctgaagggctttagggttgtatgtatccctcaaggcacatggggtgcactgggctcagaagctctgctctaacccacaagaaatctggggtacctacaggcaattcacagaacaaaaataaatggctgaatattaattgtgatttttttaaaaactggcaatatagaaaataacctcgtgagatctctggtccttggacccttagcaattgtcccaggccaccttccctcatgttcactctgtgattccaagttcagctcctgttgcccctcacctggaccacactaatatgctaatagtattccaactggtctttctgtctctatcctatcctccaggctgtggccagagtgccctttctaaatcaaagatcagagaaatacatctcctgcttaagaaaaaagcctgccttggctcagcagtacagctgcgtacatcccccattcccagcatggtgctgagaacctgcaccatcaggctccagcatctcccaccgggtccactttccttcccatctccctggacaccccactctccagccacccaatacagcccctgcagtctcccacatgtgtgcctttgcacacgctgtgctctgtgctggaaagcacttccccttgatctacgtggagtaatcctagtgacttttgagtcagcacaaggccacttcctctatgaaaccttccctggagatgctttcctttgtcctccacagaattctgatggccttttgctagagcacctggatacttttaccacacgaattattaccatgtctacatccccccctccacactgagaactccttgttggcaagggccaagaatcactcatccttgtgtgcccaggtcctacagtgcccggcacacagtaggcatttaataagtattactggatggatgactgaatgtttcctaaaaaactattctgtaagcctagaaaaatgcctcaagctatcttgtttttaaggaaacattaagagtcaagtcattaaatgtgttctataacgaccatgtcactgatgttttgtacagtcaaacgacaccccatggtacaggagtgctccaaaccaagcagacgtggctgaacgtggcgagagtcatgaataacactgtgctttccaagggagtgtttccagggtaagcagaagctggactatgtcaaactctatactaatgttttgacagggtccattcaactaacacagctcaaaggtacatttatgtgtttatgtggttagccagtcagctgccagttttctgctttggagaatcttaccagttctgcagctgatccaagcaagcattgggcggccccccaatacaggcgctctgctgtctccgcttccactccactagttcatcattaatcagggcattctgggtaagttcagtgacattcagcaactctattattttgtgaactacttcctaaaggcaatagaagaaacaaagtgaaataaattcatttttaatcactgaattttaaaatattttttaaaagaaaagcaaatatcatttcattctcaactggggctctaagccaggtggctataatttttcctctcttctaaactttgagtccattatttacagtgtataacaaaagtggcatgctattctggaaagtaaataactacctttctcttattgtcaagcattaaatacatcttcttgagtaacagctgttcttgtttctgatcactctttgccacaccattggtctcgtgttctataaattgagagacagccagtaaatatataaagaagacaaaaccaacaaaagccaagattcatataaatttaggataaatatgacacaaatgctgcctagtgacaggtcaaagtttggctttcttcgatctttaatgaacatgaaaaaaagtcctaagtataacaactagacacactgaaacaaaatacttgttttcaaaaattagccgggcgcagtggcagacgcctgtagtcccagctactcgggaggctgaggcaggagaacagcatgaacccgggaggcggagcttggagtgagccgagatctcgccactgcactctagcctgggcgacagagcgagactccgtctccaaaaaaaaacaaaaaaaacaaaaaaaaaacaaaaaaaacttgttttcagtgacccatgtaaatcagacatagtagtatctgccacttaagacactgtcaggtaattacctaaataaatgtaaataacattaataataatgttattattattataaaaataaatgtaaataataaaatgttttatctgaacagaattcagataaaaaatgtatacaaagcatagctgtagctttcaaagagaagtagatgagtaggaagtggtagttgaagttgctgtctcttatactttctacccaaatcatactgataatctctgcctatgaaccatggtataccccagatgatgaatagagtaacagcagtaccctacgtgtcctacacaatgtacattcttgagatcttttctgttgctactctcattaaaaacacgcaacagtaagaaaatacagtaaaactgctttaaaacatgagaaaaatactgagcttatctgctgtgtatacacgtggccctgcaacgtttgaagaaacctgagatattagggcaggggaactccacatatctatcgctctgtgtcagtcagtgggctaggcgcaataaatatggtgagtaacacataaccagtggttatcaagtaggggtcactgacccctaggggacttttggcaatctctggagacagttttggttgtcactagtgagggctcctgggtagtgctactggcatctggtgggtaaaagtcggggatgctgttaaacacgctacaatgccaggacagccccaacaacaaattagcccgaaatgtcaataatattggatgttgagaagccctggcctgggttatcaaggaagaattcagagtcataaaatactcggcaaatagaaaggagtaatcatcttcgttatctagtgtgaacagaaaaaattgcagccaacgggcaccacttcagttgtgaacccttacctctgttctgcaaggttttgcatttgaagtcatattcatcttgtaaatcttccaggctcttgatttcatgctctatacactacaaacaaagatgtaaacatgttttctactgatcagcaacttccaaagactttaggcaacagagtattgcttctatggaacccagagaaacacgaaaacaattccatctcccccaaaaagagatctgacttggacagttctaatcatatacatgaaataatttcggtttcattaataagtatgtcataacatttttaaaaaagcaaacgtacaataattctcaaactgatttgtatgtccttaacctggttccagcgcctaaattttgattcttcctcatcatttttgagactacctctgagatatgatttaagaactccactgtgaagcccacagcaggcggggaaaaagctcacagaaaatttcctcattccttccaagtaagaaaagtgaccatacatccctgctttaccgggatagacctggtttcatacttgctgtaattataaacagtgccctcttggcggctcaaatgcatctccatctggacaataaattgtatgttcattctacaaataagcctcatttgtttgggatttggtcacatttccacatattcttctctggatttccatggctatttctggactgggctcactcggtttctactttaatgaaatgtttccctaggagaccgcaagatgaagttgctccaaagaatgtggagtttggaaagatgctgtctgaagcatgtaagtcaaggccatactgctattacccagagatccacagaggaccaaacccctaagctggaaggccttttccacaaacacaggcctctgtgaaaaagaactcctcaaaccctccccacaccagccctaacagtggagaggagtaaatgcgcaccatcgaggacgccagagcagccctctgcttccataaattgacttggaagttgtatcctaaaattgctgtggatgtcttaatcagaaatgtatccaaatttctttcaataaaatgtatttttgttcctcttccaagtcttaggataaaacagatgactgggaaggatgggccatgtttatcctggggcactgtgatttgagaggtgtggacataaaggcccatttagagcagcaacatctcatttactgggtactgggcaaagtcaacatttactgcatgatctttcagggaagaaaaagctaaactcaatgtttggcagttataagaggccattcaaaaagtctatctggtcattgattttgccaatttgtttacttatagcttgagacttctgcaaaatttttcttcccaactacttaaaagactgaactcagttacgaggtttacaccccaagcaattgaaaccttttttcccctacagaaagtttcagaataaatgcatgtgtttactcaatactcaccataaccttgtccttcacatttctgactttactgtcaagctctttctgtttgtctaacatcactgtgctctgaatattccccgactgagcctgtaatgggaagggcatgattatagccatcgttttcttcagggtgtgtacttgctggttacactccaaagtcaagtccccacttgccttccagatcttctgacatgtactacaggcttcctgcttatgtgtcaatatgaaatttttcccaaggccctggaaaatgctggcaaactgttaacaaggttacaaaaaaactaggctcaattcatgtctaaaataaacagtatttctgggagtttccattaattcatacagttgcatggtaccacgctggaatttagttcacggtttctcagatactatacacaagattactctcattaactcagtccttatttatcttaaagctttctgattcaaagtgtggtcctcagaccagcagcatctcaccacctaggatcttgttggaaaatctcaagggctaatatgattaggcaatcagaaaaccctattttaacacaattccgggtgatccagaggtatactgaaatatgaaatcactccattaaggccatcaatgaaaatctgctactataaagtcaataatgaatataaacccagacttgcctgggagtattcagtcctatttttgataatcagaacactcagaagtgacagggtctctacttgcttcatacaccagatgtaccctgcacatactaggtactaagtaaatgtcaggcaatgctctaggctcgggtgttagagtggtaaccagtgatccctgttctcatagagattaaattctagaaagatgttatttttttagagttaaatcccccacacagcaaaaactgtgcttgtcaacctttcttacacagtgccctatacagcacagattctacgggggtgtttttatatgtgcaattgtatcatcttttcttcatgtctggaattttccttatattagaaagcctttccctattgacattacatcattcactcatttccctagcacttgcaaggtttcctttttttctttttaacttttagatcgctgatatatttgtttattctcatgatcagagtgaagtatgggtccactttttgctttcactttttttccagttagctttccatttgtcttaacagcatttactgaaaagtccattattttccccagtgctctgagctgccaactttatcacatgaatttccatatgcacacgggtttccttctagatttttctcttctttcccattggcctttttattcataagcctgaacccttgaaggatgtttgactatagaggatttatagtctgtctagtagggccagtcccatttcattgctctacttgttcagaagttgcctcgctactcttgcatgtttatttttcataaatttcagaacaaatttgtgtagctccagaaaacaacttgttggtatttttattggaataacattaaaattacaagttaactcagggagagctaacatctttatgatgttgtttttaattcttatgcttctaatggttttctcttgtctaattgcattggccaataccaccaatacgatgctaaatagcagtggaaacacagcatccttgctgtgtttctgacttactggagttttcccagttaggtaagatactgtctctagaatggagatatatatatttttttgtgttaaagaggtacccatcaattcctatcttattcaatgtttttatgaggaatgagtattgaattctgttagatcttttcagcttctgtggaaggaagtaaatgcttttttctccttgtagctattaatttagtgaattgcattaataggttgcccagtcatggactacccttgtaacctataataaatcatatttggtcatgtcctttcttaatgtagtatttaattctgatccctaatatcttattgaggacttttatattgatactcataagtaaaattggtccataattttttgttttatctttatcaggcatacgtcatcaaagttattctctcttcataggaagttttccttcatgttacatattctccaacagcagaagttcaaagcatgtgaattgtatcagctgtaaagtgtgtattagaaatacatgaatgttactggtatcctctgtaagtccaaggtgccacatatcactcagtgacaaaaggggtttctctgggcggttggaataagttgtcactttgaggagttccatacagctttctgcctgtgcagggaaatctttgctgttgtctaattctgacatggtttggatctgtgtccccacccaaatctcatgaattgtaatccccattgttggaggtggggcctggtggaaggtgactggatcacggggacagtttctcatgaatagtttagcaccatcctcttggtactatccttgtgatcacgagttctcacaagatctggttaagtgtggagcacctctcccctgcttcctcctgctctggccatgtgatatgtgtgcttccccttcacctgctgctatgactgtaagtttcctgaggcctccccagaaactgagcagatgccagcaccatgcttcctgtaacagcctgcagaaccataagtcaattaaacctcttttcttataaattacccagtctcaggtatttctttatagccatgcaagaacagactaatacaacttctaagccagcaggatgtgggcacggtgtcctgtgggctttgtaacagctgggacactacacctagagagagggaccaggccactggagaattctgacttcccaggcctcctcccaaatgaccaaggctcggtttagagaacagggatataaacaatggctgtaaaacagcagctacatccccagcttctacatcccctttctactgacttgctgggagatgcttggtggaaaaacctggtgactgtggcagggcctaagaaatctcctgcttccaacttgggcagtagtccctccaagtcactcaaacccttggtgctctcttaccccttccactcatccctccctgcttccctccaccctgcccccatctgctaagcagatgcttggctgctcctgtacactttagtactgataccactttcacagtgagtccttaactttttaactttctaagaaaccaggagtactgaaaccacgggaatttcaaacactgaagttggaagggacttcggctgtcattgactcttactttctcgtttcactactgtacctctagagaccttgtttggatgggaacttggttactccagaccccagagcaaagaaaagtcttctgctcaggaagggggtcctttccaatggagtgagcagttgtccaagtaagggaataggcactccatgggtgtgagaagttccagccagaaagccctcatatcccatcccacagattagaaaactgaaaagtgacttctccagtgaactagttttagagttggacaatactgggtttaaattccaaacctacttctcattagctctgtggctctgagtgaagtacctgacctctaaaccttagttttctcatctttaaaatggggataagaatacctaacttcagtgatagtttcgaaagtatttactcaaatgaaataatgtttataaagtgcttagcacagggcctgaaacatgataagcactcagcatatggtaaccattagtccttaagaacacaaagatggaacagcaaaggaagcttagaatccacctcatgtctttccctcccacctgaaagaaattctccccatcccttcagaccctatggacctaaatttttgtctagacatgcaactagctttttcaccacaaagaaaaaaagaaagaaaaaaacttagtgtgctgtaagacagcacacgaaacatttatagtctactacagtgtgtatagcataatattctcttaaatgtattttctaaaagctcttatattaaaaaacaatgggaacaataatttcccatctcggcatgtctatagaattttgtggtctctaaatgatctgaactaactcggaattttgcatgtttttaacttgttgaatctgttgaatccccatgtacctatcacagtttcaacaattagcattcatggatggccttgtttcatccctattctccttactcttctagtccccaaatgggattatttgaagcaaataccagacatcacaccattccatacacatatactttagcatgaatagaatatacacagtcatgtaccacataacaatggttcagtcaacgatggaccgcgtatatgacagtggccccataagattagaatggagctttatgggggtaccaccttttatcttttacacactatctgtactgtaccttttctatgtttagatacacaaataacattgtgttacaattgcccatagcgttcagtacaacttcatattgtacaggtttgtagcctaggagcaataggctttaccatatagtgtaggtgtatggtaggttataccacctgggtttgtgtaagtgcactctataatgtttgcacaaaaacgcgatcacctagtggtgcatttctcagaatgtatctgtgtcattaagtgatgcatgtctgtattaataaaataaagttacttcaacaaggggggaaatggtgaagaaatgtttctgacctacctagccaatagttggctggataactttggaaaggaggcacctattgtgccttttccctttccctgacatccccagacacccagaaacttccctcacaccccaagaaggctttgcaaaggtgttcacggactcaggtgtcctctgagaggctcaaaacaatccccagattacctacatttttaatggggagggagctcaaaagctggtaaaccttcaagatccaaagccaggggatgaggttcatgtgggagagcaggggtcacctactctgctgccaatgccatctctgggccaaggggccaaatgtgaggatgacatgcttgcagctgggggaaacaggttgtccttctgcccatctttgctcctggctgtcctttcaagtctattagaaatacagaggaggcccacgcatactacttttaggatggaagccccatataatcaaaactgccggctgaaaatctcccaggtatatgccaggttagagacaggcacacctctttcagaggagacaacctggccagcttctcctccagcgttgatatacacctttgttccctaggctgggtaccagatgagctagccagcttgagtttagaataagcaatatgtatctttacatgctcagttcagcaagatgctatcagtgtgacaagaagatgggaactatacgcctagggaagtgacaggattacaaggactgggacaaatgctcaggcagtgtgtggagaatggcatcctccaccacacctaaactccctccctctccactgtcacacagttcacttcggtagttatttgttggtgaaatgcacacaggatgcatactgtgtcctctggcatccatatagcaatgggctcctccagaacaatccataacatggtggcttcacactgcctgcctgttggcttgttgtcaccaccccagtgctcaagaaaggaatactaaatgccatagcaaattcaaaactctgctgaaccctgacaactaggaaggtttgtattaggattaataaaacaatgatcaaaaatcttgatactagtacaactctgactcatttactgtttgatgccttgaatatttaataggtatcttgatgttgctcaaaacaaagcccttgattttcccatcagcctccttttctctccacaaacctattgagtcctacaaaactcctgcccctgccccctccttgccttcccagctccgtgtacagcattaccatttttcaaggggttctagtagctgctgtagagccatccttgactttctgctctcactcctgcatctaatccttcaacataaggatccttctatattggtatcacatccaaagcataacctgaatctgtccacctcttcctacctccactgattctactgagcgcaagcttccactgcctctaccttggacagctgcaagaaccctctatctgcctgcttccattcctgtgccagcaactcagaggcctttcctgaccctgatctaaaggaacaaccccactcccagccactccatgaattcagcatgttatcttctcagcactttatgctacccagaagtatcttgtttatatgttctctctcctcgttagaacttaattccattagattaggatctttcttaaagcctggttctataaaatctctaaatctgattctcccacttcttggggctataaaattagagagatattcatcattgctttgacatgggccctaatagtatttgatgaatgaatacatttttattttattacagtttatgtgttcaatgagaaaaaagtacctgattaaatctctgggcgttttccagaattttcctttcttccttcagacagctgtaaatgatcatagacatctggattgggtcttcctgaaaattatcctagatttgagtggttagaacaaaaataaattaaaatgcagaatgtttactttattgtgtattgtaagttgatatgaatttgtttatattctccgggaaacctcatctctcatctattaaattctatataagctatgtttgttaaaatcaaaatatttctttcacgaattatgacaaaaattgctttaactttctaagtgcaggtacctaacgtactttttgatttaaaaacaagtattttcacatatggttcacataatatttttactttaatatctttccatatttcttaaggccaattatctttggttaggatcccgagacaatgcaaatgatataaaaactatacatgacattcctcaatgaatgcatctgttggtctaagctttgaactagaccaaagatattcatctagggttttctgttgccattgtcaaagctagtttgcaaaacactaccaatagcaataatggctctttatacaggtacattcatgcaaggtctgtatgagaacaaatttctgtaaagttaatttgatttccccactcgtaaataaaatcataaatacattcacaaaggaaaaaaaacaacttccaattacctaagctgaaaagttcagttgtattgtatgaaagaagaaaatgatagctttcacctccattaaaacagaaaagttctgttattacacaacataaatatgatagccaccccaagggcatgctgggagtacatctgaagaacccctaaaactctatagcatgttctctcatgtctggatctttctttgactttctcttccaggagaggccaactccaccagaagcaaggcaaggtggagtctagttcctgaagtcacctgacttccttaggtgaaagtcaaacctttcctgttttattcctcatttgcatagcaaggacctgaacctaaccactaatgttccctggagctttaatgtattactatagatcattgctcttaaaatgtagccccttttctttggtttaaatattgacaatttttagtaaaacaaaattatagcatcacatttttctcaggattactgatacctaagaggtgatacatttaaccctaaaaattccttctgtgtttataaaataaattggtatcttattttacttatgctatatttactgatgctgtagaaaacataaatggagttagtctctattacttctctaaataccaataagtgtgtgctcaattgtatttgctgaatgaagaaaactgccttccataaacatgagaacatttcaactaaaatacaaaaaccaggtcatacctgaagattacgcttgcttttccttatgttatgctgtagcaagaagttattctccaaagaaaagcgactatattgatcatccagctgtgacaggaggtcatgaaaacggatggtggcaaatgaaacatcattggcagcgtgctccctaggagatttaacatttacacatttcattctagaactaaatgtctatgtaaaacagacaaaacaaatgttggtttccttattgaaattattaaaaataatttaagtattttcttaggtttattttcttcttttgaaactgacattgcttttagcagcagtttatgtggtatttctcttatgtgcaattagcacaaaaaattctaaactctaagagattgtgcatgacagtgttcatggtgactatctctgaagggggaaaagtcaacaggggacccttcactttctatgtcaaatactttcaggacgtttttaaattagcaaataataaattttaaagtagaacacctatcagttaaaaaaaatccccttaattttactaccttcttcatatttctaatcaatgtttaaccattaatttggctttatttcttttaaattacttctttctatagtctggatcctaagttggaaaataatcggtgtcagtattccgtaacttgtccaaagcatttaggaatatctatcataaattaaatttggcaaaactgtataaaagtgcttaatgactaatatacttaactttgttgagacactttttggctcaactttgttgagtcattttttaaatcaacaaacttttctacaacaaataattccagtggccattgatggaattcatcttccagtaaacatggccccaagtcacttaatcaaccagtacttttaaggtgtaaacttcttcttctgtctagtgaattttccttaccagtcttgcttttctaaccactgtgccaggtactgtctgatttccatgggaaaactgtcatcataaagctggtgaacctgctccaggaattttgagtcaagctgctgaagttcgtaccactgagacatcctatagggaaaaagaatatacattctttctatgtatatggaaaccatagctccaaagaaagccttcctagcatcaggttgtactcttaaatatcttgcttaatccaaaacatagtttgtcccaggaatattttatttaaatggcatttatagtctaaagcctgtttttaattgagtttggggatgaactttttttctcctccacgaaacacatcttcatgtctttgcttattgtcaacatatcagggcagccttctctggcctcttttatttaaactgcaaccacctcccaccctggaaacatgctctctcttttccctggtttatttttcttcatagtacttacaccaccatctgacctaccacatattttattttcattattgtctgttttcaccacttgaagggatggatgttggtggaggattctgtgcactggtgtatccctagaacaatgtcaaccacatagtaggtatccaataaatatgcctttaaaatgagtttgtgattttatcaaataaatacatgaaaaacattattttaattagacttgctttaagacaaatcacaagactctcccaaaattgctctcctacaaatcacagtacatttgtaatttaactcaaatattttcaaacttctgttttatatttatgattcatatggtaaaattcattatttttcttatacacatttaaaaagatatattttcttctttgcctactacaaacaataaatctggcataaagaagtaatgatttttaaagattaaaacatcattaaatgtaatttaaaaggataaagtaacacttagctttttggataactgttaagtccatttttacatagtgatcctaaagattcaaaatcacaacaaaaacttgatataagcaagtcctaaaattcattaggaaaacggagagtctcccatgaccatcatgtaacttaggatttatatcagcacacaggtggcaatatgcagagcagacacaagtgaatcttgtcctgccagacctctggggaaggagtctggattttcaagtagggcatggaagagtgtgtatgcatacttgtagccgagcacatgtatgcaggcatgaggtcacgcctactccacaaatgtccttccaaaggagtgtgaggaaatgtctggcctataaagctagttatcctcatatataccagtagaaacggacccaagcccagccccttggcactcctgctgaagcaatttgatttttcagttcagttttattttacctgagtggaaaaatctgtggctgtctccctccctgcttggtaactaataaggatctacctaaagcagatatgctggaccgtcaggcaatgggagctgcaacgcctcttattagccaagcgaacccaggtaacttactcccctatcaacaaggtgtgtgtgtgtgtgtttagtagacaggaacttgctctgtcatccaggttggagcgcagtggcagtggagcgcagttcactgcagcctccaacccctggactagagcaatcctcccacctcagcctcccaaggagctcagactgcaagtgatatggtttggctctatgcccccacccaaatcttacctcgaattgtaatataattcccatgtgttaagggcgggaccagtggaggtaactgaatcatgggggcagtctcccccatgctgttctcgtgataatgagtgagcctcatgacatctgatggttttataagccactggcatttcccctgcttgcatctattctctctcctgctgccccgtgaagagatgccttctgccatgcagaactgtgagtcaattaaacctcttcactttataaattacctagtctcgggcagttctttatagcagcatgagaacagactaatacaataaacacgagccaagaagcctggctaatttttaaattttctgtagagacagcctctcgttatgtttctgaggctggtctcaaacacctgacctcaggcaatccttccacctcagcctcccaaagtgctgggattacaggcgtgagcttccgcaccctgccacagttggttcttaaggctggttgagctagtacatatgtagcacctggcacagaagaggtgaattaataagctcatgtttgggctggccaggtggctcacgcctgtaatcccagcactttcggaggccaaggtgggcggattgcctgagctccggagttcaagaccagcctgggcaacatggtgaaaccttgtctctactaaaatacaaaaaaaaattagcagggcatggtggtgtgcacctgtagtcccaactactcgtgaggctgaggcaggggaattgcttgaacccaggaggcggaggttgcagtgagctgagatcgcgccactgtactccagcctgggagacagagagagactctgtctctaaaaaaaaaaaacaatgaataaataagctcatgttcacaaatctggagtcagtctcatctactcacaaaacctgttaccaactcagggagtggcatggccatctcccagtcactgagctcaaatctcagatttagggttgattccttccactccatcccaagacctgctccttcctgtctccaacattctaccttcccagtccagcctctgctgcccacagattggaccacatcaatctcctgtgcaaaaatcctatgatctgtccattcctaggcagatttccaccccaccccatcttcatccatcaacaaagcaacccagtcaccaaatcatttactgtttttcaactgtgcccaacatttctgctttgctccagctactcgcccttggaaacagcctctccacaaatttttgcgtctctaaatcctatagcattcaaagctatgtacaaaagccccttctttcataaagttgtctgagacttactcacaattaagctttctttgacttgcgtctcactgaattctgtacctctattagagcatcggttccagttttccttgtaaagctctgtgatgcctccagagtccccggcgggggaaggtgggtggggagggggtagagtagtggggtattttgctttttaacatcttatggaccttggacagtgccctgcatatactatgtgctcgaaacagtttgttgaattgaaattatgtatatttcagacggaattagaaagtaaaaagcaaaccatattatgatctcacaagtgtgagtccagcatcctcattaagcaatggttgcacaatggactgtgctggaggctcaagtcctgtttctgttctatgaaaataactccttatctatacaaacaacattcaaagcacaatcaaccacacctctgcatacctaccacagaactcttcagtaccggccagaaatttttttaagactatattattttggggtggggggtctgcaaaaactaaacatcacttttaaactctaggaagacattaagcccttccatctttgaacatagaaacataattaagattccgaagtcatgtactcattcatctgattccatgaacatttactgacctgccaccttgtgccccaacaagggcctggggattcaaccaaaggagcagctacgcacagcacgttaggtgccaagactgtcgaggttatatacacagagtgcgaacgttaacctagacagctctcgaggatggcatacagcaaatgaaactttctgcgaaaagaagaaaacgtgactgatggaaaggggtggaaacgggagaaagtgacggtaaatgggaaggtgcagtgccttctagaggaaaattatatttcacaagtcctcttcactgccagagcacgactggcaaggacaatcgtgctgagcagtgccatctccgagaacaggtggcactgctcgcacttggaatactcaggacgcgttcttcctctgggatcactattcgcgggtcagcacagacggcccgtcctcgcccggcgtccaactgcacggcccgaggactctgtccctgcgcgtcccacccccggcacccggaacctcacggccactcactctgcgcgcaggatccggaagggctaggcgggggcgcggcggtgcagcctctcccgagcgcgctgggtcgcctctgctcggtctggggtctgccaggcgcgatccccccggtgcagccgagcccctccgcagactctgcgcaggaaagcgaaactacccggcaggagaaaaggcagcgctggcgcccggcccccttccgcccccaccaatcaccgggcggctccgcgctcagc

SEQ ID NO: 2049 - DNA, 18656 bp, Homo sapiens
  source 1..18656: mol_type = genomic DNA
ttccagatcagcacaaagtttattagccatttctgctcagaagagcccctttctgaacaggactgttcctctgacataacagacaagaaacagccacctgtgcagggcctttcctttatatctcaagctacatcaggagaacatcttggagcaatgtcagttgccccctggggttccctgggaatagctaaggtgtgagattgtccagagtcctatgacagaccttcaaggttttaagttccacagacttggactttgtccaggtccacaaccaacgaatagaaaccttcctttcaggtaaacaacatattgtacaaaaaagggaggatgataacataatagagaaagagctaagacccattgcttctcctctgtaaaaacaccaaactttatccaatactataaaaaagaaattcctgctgggaacagtggctcacgcctgtaatcccagcactctgggaggccgaggtggacagatcacttgaggtcaggagttcgagaccagcctgaccaacatggagaaaccccgtctctactaaaaatacaaaattagctgggcatggtggtgcagatctgtaatcccagctactggggaggctgaggcaggagagtcacttgaacccggaaggcggaggttgcagtgagccgagatcacaccattgcactccagcctggacaacaagagagaaactccatctcaaaaaaaaaaaaaaaaaaatcctggccaagcacagtggctcatgcctataatcccagcactttgggaggccaaggcgtgaggatcacttgagcccagttcaagaccagcctgggcaatatagcaagaccctgtctttaaaaaaaaaaaatagggcatggtggcgcatgccatggtgctagctacccaggaggctgaggtaggaggattgcttgaacccaggaggttgaggctgcagtgagctgtgattgcaccattgcactctagcctgggcaacagagtgagaccctgtttaaaaaaaaaaaaatccccagcaatcctaccatccccagcctccaggagtgatctgtctcctaagcattgagaaagtggagactaggtagcataaactagtgtgcaaagcttcacactcacattagattggcaggatcattttatgggggaggaacaggtacagccagcttaggggcagagtaggggaggagactggtaagaaaaagaggtctacttcctatccatccctttcttcagggtagagtttcacatggtaggctaaggcagaaagctctcaacccctgcaggaaaagaagaaattcagggcttgagccaggagtaaaggaaagaagaaagcaagttatcctagacatgaaggaatggaagaaagaaatggagtcctatcctgtgtctgtgctccccaccaagggccaatgccagtatgcaccagtttagcctaaccaactattaaaatgttgaaatccttccatactggaaagaagccactgccctgagccctccaagtacctgtcaactgccctggcctgcccccaggacccctatacctcccagcacagcaggcagcctccaggatcctatttagacctatggctcagcatctgttctgattcattgttgtcccctctgtacccatgttatgctttcacctctcaccccaatggagtcacacaggcctgagtttgaacagttaacacagcttggaagggacacatgcctgattcccatccttggagaacaatatcatgctatgaggagtaggaagggcaagagatatgaaaagaacagaggaaatgtggttcctagaagtcagaaggcatcaagggtccatcagtgtagaagtggctggggcgggagacgtaaacctcatccacggtgttctggccagccaacagtgggtcaccattcggcatgatttcttcaatctttacacagtttctgaagactaggtaatccagagagaaaagtgaggccccgatcttagttaggagttcccaacccagcagggaaagggagggaggatggcaggaaaggcctgggaagagcctgagtgggaacttgtgggatgaaagagcagggaggtgggggaaggcatgtgtaattcctaaaaaaaggaatcacagaatggacctctctccaatgaggagcttggagttcagctttttctgtaatgggagagggagaagaggtaggaaagggaatgtgtgccatcttccatagctccatctcatcacttactttccattggctcagtgttcaaatgtctcagatcacagggcaaatctggctctggcactggctgtgatacaggtccttggtctggctctggcactgtttgtgataccatgcatagtgtgggctctatcacaggctccagagtggactccagcacagactctagctctggccccagatccagccctgccttcagcagtggctctaagtccaggctgagctctggctctggcaccagccctagttccagctctaatgactccagctctggctctggcttaagctccagcggttgttgcagttcatccacctgtctggatacccaaagacagacaaaggggcagggctcagtggttcaaatgaaatcaggaatggtagaataagcagaagctagtctaagaaggcagtagggcggagggctaaagagcatgggtttggaatcaggcctcctggagtttgaatcctggctgggggaccttaggcaagtggcctaacttttctgagcctcagatttatcatctataaatgagaacaatacctagtaattcttgagaggcagtagggtggttaaaatcagggctacggaatctaacagacctgtatcattagccacgtaccttaggtacaaaacttgactactctaaatccagttccttagctgaaaacagtaacagtgtttacttcacaggactattttgtagattcaataaaatgagaaaataaatgcaaaccatttagcctagtgcctggcgcataataaactctcaggccaggcatggtggctcacacctgtaatccaagcactttgggaggctgaggcgggcagatcacttgaggccaggagctcatgaccagcctggccaacatggtgaaaccctgtttctactaaaaatacaaaagttaggccgggtgcagaggctcacgcctgtaatcccagcactttgggaggccaaggtgggcggatcatgaggtcaggagtttgagaccagcctggccaatatggtaaaaccctgtctctactaaaaatacaaaaattagccaggtgtggtggttgtgcgcgcttgtagtcccagctactcaggaggctgaggcaggagaattgcttgagcctgggaggcagaggttgcagtgagctgagatcgtgccactgcactccagcctgggcaacagggcgagactctgtctcaaaaaaaaaacaaaaattaaccaggcatgggtggcgctcgcctgtaatcccagctactcagtaggctgaggcaggagaattgcttgagcctgggaggcagaggttgcagtgagctgaaattgcaccactgcactccagcccgggcaatgagagtgagactgtctcaaaaaaaaaaaaaaaaaaaaaaaaaattctatccccagccaagtgccatggctcattcctacaatcccggcaatttgggaggccaaggcaggagactgcttgaggccaggagttcaagaccagcctgggcaacacagtgataccccatccctacaaaaaatttaaaaaattagctgagtgtgattgagtgtgatggcgtgtgcctgtagtctcagctacttgggaggctgaggcaggagcattgcttcaacccctaggtcaaggctgcagtgagtcatgattataccactgcactccagcctggataacagagaccctgtctcaaaaaaaaaaaaaaaaaaaaaaaaaaaaaatatatatatatgcggggtgtggtggctcacgcctgtaatccctgcattttgggaggccaaggtgggtggattgcttgagtccaggagttcaagaacagcctgggcaacatggtaagaccccatctctacaaaaaatacaaaaaaaattagctgagtttggtgatgcatgcctgtattgcttgagctcaggaggtcgaggctgcagtgagccaggatcacaccactgcactccagcctgggcgacagaacaaaaccctgtctggaaaaaaaaaaagctccatgcttgcatcaagtaggtacccattaacaccagtgattatgatcattattatccagaaacccctgtggagacaacctaaggatggcagcagaaaaatatgagataggagagactagaaccagaaaaaactagagtgggctaggagggagggaaggctggggagactggaatagggcagcttaggagaaggcagaaaggagaggctgtgggaatggcagggcagagcagctgaccatcatcctggtgctccacccaggagaaggtaatgcccccttttgacgattcactgaagcagagccaaaaaggattagggaggatgaatgaagagttcatatctcacctattagagaccacaatgagcctgtgtttcaggtatttcctccgttcctggagattaactgtgaggaacatatacaagaagcagagaagatcagtgggccagacatatagcctgaggttcccctagtgcagatggtcctggcagtctcatccccatagtaaccagcagtatcccatggacgaatcccttaattcctctagatatcagttttcccatgctttaaaggaaggagtgggatctatggatgtctggtagatctctgcaatctagcaatgaagtatgtcaacgattcccacctttctcctggtagtagcacccaaaagcttcatcccgggggattcggggatagaggaagcgcagtgggttttcaggtatattctcctcagtgagcaactggtaatggcggatgatttcagtcagcgggagtgactgcagcacctccttcgtgtacggttgcacagagtagatgagcaccttgtctggagagtgaatgcaggaacaggcgggcttgagggaagaggccgggccttggagctctctgctctggctgcccagtcccaaaccagctgagggattcagttcagagccagggaagccaagggcaggcagaggggcaagaggggagccaggcagaaaggagaggctgtgggaatggcagggcagagcagctgaccatcatcctggtgctccacccaggagcaggtaatgcccccttctgacgattcactgaagcgcagtagaaaggtgccagacatggtcttcttcagcagccggcgctcctggctccgactcacaaagcccatgatgcgtctggagcacagagagcagctgtgagacaccgcccaacaccctgccccaccaggcccctgcctccctgctccccttgtatggagaaacagcccaggtttggaatccaggctttggaccaagccctgccacttagcttttttttatcttttacaagtcacttcactttgctgacaatagccaccttccgagggtttgaagtacgaagattcagtgagatcacacagatgaacagcacttttttttttttctgggagacagggtgtcattctgtcacccaggctggagaatagtggcatgatcacagctcactgccacctcgacctcccgggctcaagcaatcttcccacctctcagcctccagagtagctgggaccacaggtgcacaccaccatgcctggctaacttttgtatttttcgtagagacggggtttcaccacgtggcccagggtagttttgaactcctgggctcaagtgatctgtactcctcagcctcccaaaatgctaggattacaggcatgagcaaccacgcctggccacaaatagcacttttttttggttttgttttgagacagagtcttgctctgtcacccaggctggagtgcaatggcacgatcttggctcactgtaaccttctctcctgggttcaagcgattctcctgcctcagcctcctgagtagctgggattacaggcgcccaccaccacacccggctaatttttgtatttttaatagagatggggtttcgccatgttggccaggctggtctcaaactcctgacctcaggtgatccacccacctcggcctcccaaaatgctgggattacaggcgtgagccatcgtgcctggtcatgaatagcacttttaaaagccaaatgctacacaagttggtaggcagtgtggtggaaagagcatgggcttggagtcacataggcctggatttgaatatcaactgtgtcccttgggtaagttctttaacttctctgaaactcagtttcctcacatgaaatgaagctggcaaaacccaccactcagcatggttgtaaggatgagatgagagaattaatgaagagcacccatcaagctctggaatgtaggagatgcttcacaaacactgtttatggctattattggttgtttttttttttttttttttgagacggagtcttgctcgtcacccaggctggagggcagtgacgcaatctcggctcactgcaagctccatctcccaggttcacgccattttcctgcctcagcctcctgagtagctgggactacaggtgtctgccaccacgcccggctaattttttgtatttttagtagagacggggtttcaccgtgttagccaggatggtctcgatctcctgacctcatgatccgcccgcctcggcctcccaaagtgctgggattacaggtgtgagccaccacacccggccttattattgttaacaaatgtgaggagacgtggcctgcacctgtctttgctctctctccctgcttgccacgtgagggtgcagagactccactctcaagcccggaaagcacaagcccatgagggaagggtgaccaaggccttacccatcattccagagatccttcaggtggtcatgtaccaactccagaattttgtccagccatgtccagaatggtaacttgccaggagggctctctcgctggaggaggaatggaaaggtagcaaaagctgaggagttgcctctggtgtagggaaggagggacgtgggaaggccagtatttggaatgtgggctagatccagcagctccacaggattcagggagttaccttagtgaagtcagcccaggacaataatggatcctcagtcctacagttctgccctgtgggacagatagccacagacagatgatgagggaagccaggggtcctgggatagataggacagagggacagaaaagactaaggctggggaaaggctgagagaaaaggaaatctgtaccgaacagcttgtttctcagcatgctcagctggtctgagttgaggcctcggccaacataggaggagaactgccaactgagagcagggcccagcaagctccagggggccttgggggggttggagaagaactgctggttctgcaggggtgggagcagtgtaggctggctcagaagcaacctatcacaccaagcttccacacccctcctctcgcgccttgacctgtcggccccactcccctacctgaaggtttgggctgagcaaattgaaccagagaactgaagcccaggcaattgagagctggttcatgttggaaataatcaccacagggagggtgtccgtctggggagaagacaggagtcacagagagggatgtgatgtttctagctgcaggtatttgttagaggaaaggagtgctaacccaccccaagaggcttctgtttatccccttcttatgccttcttccaaagctgctttctctctccttgccctccattttcactcactttcagctcctgcttcagaccctggtaggtatatttgaccgtgaagctgatgatgtgcagttcctctgtcacacctagtggcccctgggacagccaaagacatagtcatcagaaggctctttggcaagctccccctgcctcgagtcctctgtccagatctcaccttattgctgccctttcctgaaccacctgaacgttgctccaccagagtctgtgaattgaagggaaggagagaaaatgccagagtgggcaccctagtgtccctggaacccctgtttggcttcaagacctctcaagccctgggaacttcccccaacccctgttcctttggactaaaagcaggccagctatggtggctcatgcctgtgatcccagcactttgggaggctgaggcgggtggatcacctgaggtcaggagttcgagaccagcccgaccaatatggtgaaaccctatctctactaaaaatacaaaaattagccgggcatggtggtgtgtgcctatagtctcagctactcaggaggctgagacagaagaattgcttgaacccgggaggcggaggttgctgtgagccaagatggcaccactgcactccagcctgggggacagagtgagactccgtctcaaaaaaataaaaatagtaataaaagcataggtcacaaactattcttaccaggtaaccaaagtcccaaatcaaaccctgactctgccccttctcgggggtcaaagttttctggtttgaagtcagaatgttgaacttccggaagctgttccaggaggaagatacatggagacaaggaatggaattattctaaaaactcagcagaaaaaaaaaaacagaagttccacttcatttcagatctcgccatctccctttgtccatatcccaaatccccctcttccttgtttgtgccaccagggctgccgaatgtggttctgcaggtcatacactgtacagatgtttgcagtgtccttgtcaagcacctacccttgtaattgaggaggattcctgaaaagaaataaatttaaaaaaatcattgggcaaaagagtatggaagttaggagtttcgtctttgggatcagacagacctcggttcaaacccgacttgagctcactagctatgtggccttgagaagagatgtaatcagtctctctaagcctgtatctttgtttgtacagtgcactggtaatagtttattcatggggttggtgtgacaattaaatgagtagctgacatgctgcatgtcacaaagtaagtgttcaacaaaagaaatgaattataatttctgtgaggtaggattggaaggaggaaggagatagccctagggccctgttgtgaagagtgagtatctcctccaccccagcagcccgtgtcctggccacccttcacctgctccaatttacctgtcaatggagacttccacagtcagtgactcattgccttcctggagtctcaccagcagcctgggggaaggaagggggataggggaaagtggtcaacctcaaccttccggatagactagatgtttgaaaaagagaagagggattataagaggtagggagattgcagggaaagagaagaaaaagccaagagtgggaagagctgtaaagccagaaaatacacagtggcagggttggaaaaaggaagtgggaatgagttctggaatgccaaccttgttcggacggtgaacttgctgccagtcttgaggatgaggggtcgatggggagtttggggcatgcagggctgggtttctaccacaaaggctctgaggagagagaggtgtggagagaatatatagctcagtatctgtaagaatggcttcccttgttccttctttcccccagggttcctgcctggcctctagacctgtggagcagacgctgtagcaactctgtgacctgggcgttgcgtaggtccacccctttggtcagagggtcatcctgatagctaaccaggcaactcagtcccttcagctccttcagcagctgcctcaggtgaaacaacagctttgctccagctgtgaacctgggtgataaaattcaggaagaaggaatccatgagtttcctggattcccccatccaggttccaagatctctctgtaaatatgtgaagagtcagaaactgactggggggaagaaaaaaaaagaatccaggaagcatataaaggattattcaacatgattcataatccaagaaatgaaaatcaaagctattttcacatataaaactgctaatagatttaacataacagttttcatatgctatgtacaacttatattaagccctttccacatattaatgcatttaatcctcaaaacaaccctctgaggcaggtactattattttccccacattacagatgataaaactgaggcacagaaaggttaagtgacttgcttaaggtcatacaactagtaagggatgaagcttgtatgtgatcccaggcagtctcattgtacaactcacactttgttttttttttttagacagtctcactctcttgtcatccaggctggagtgcaatggtgtgatcttggctcactgcaacctccacctcctggattcaagagattctcctgccttggcctcccgagtagctgggattacaggtatgtgccaccacgcccggctaacttatatatatatatttttagtagagacggggttttgccatgttggccaagctggtcttgaactcctgacctcaggtgatccgcccaccttggcctcccaaagtgctgggattacaggtgtgagccactgcacccagccccaactcacatttttaactactgtactttactgtctctataattaaaaataataataatcagcaatgtggtgacaggaaaacaaccatacactacacatgagaaaatagattcgattgggacaactattctgggaaacatttgtaactatcttttttttttttttttttttttggtgggggtgggggtgggggtggtttctggcaaaaacctgaaagcctgctagacaaatcctaaaagagctgtaacacttggaactatcttttaaaaagcctcgccagctgacatggtggctcacacctgtaatctcagcactttgggaagcaaaggtgggcagatcacttaaggccaggcactccagcctgggagacagagagagaccctgtctcaatcaatcaatcaatcaatcaatcaatgcatgcatgcatgcatgctggtcctgtaccataagtactatatgcctgtttttcaatctacctgagcaattgtggtatttttttaatctactttttttttttttaagaggtgagggtcttgctatattgctcaggctgacatcaaactcctggactcaagcactctttctgcctcagcctcctcagtagctgggtattatggtatgtgtacatatatacttttagagacagggtctcgttctgttgtccaggctggactacagtggtataatcatggctcactgcagcctccaacacctgggctcaagcaatcctcccacctcagcctcctgagtagctagggactacaggcgtgtgccaccatgcctaatcttttttttttttttttgagacggagtctcgctctgtcacccaggctggagtacagtggcatgatcacagctcactgcaacctctgcctcccgagttcaagtgattttcctgccttagcctcctgagtagctgggaatacaggcatgcgccaccacacctggcaaatttttgtatttttagtagagatggggtttcaccacattggccaggctggtcttgaactcctgacctcaagtgatccacccaccttggcctcccacagtgctggccacatgtgtgagccactgtgtccggacatgcctaattaaaaaacaaattttttttttttgtagagatggggtcttgttatgtttcccgggctggtctcaaaccccaagactgaagtgatcctcctgcctcagccttccaaagtactaggataacaggcatgagacgccatgcctggcctggtatatttctaaaagactaaattataataaatttttaaatgagaaaatattgaaaacagtaggtatttttcaagtatgttggaggacacactagtgatttttctacaacacaatataattaccataaaatatagcgtttcctggaaaaaggtaacaagaaattgaaaataacctaaatagctgaaaataggagttcattaattaaattatgttaccaccatataggggactgttgtgtggacataagaaataacatggataaatataatatactgttggccgggcatggtggctcacgcctgtaatcccagcactttgggagcccaagttgggtggatcacctgaagtcaggagtttgagaccagcctggccaacatggagaaacatcgtctctactaaaaatacaaaaaaactagccaggcatggtggtgtgtgcctgtaatcccagcaactcgggaggctgagacaggagaattgcttgaacctgggagttggaagttgcagtgagctgagatcgtgccactgcgctccagcctgggcaacagagagagactccgtctcaaaaaaaaaaaaaaaaaaaaaatatatatatatatatatatatataaaaaatactgttaagcttaaaaaaaaccccatggatttcaaaatagtatggacaatatgattccatttttgtttaataagctaggtaataggtaattttctcttcctccttccttccttcctttcttgtcattgtattcgttgcagtaaaaaaaaaaatacatatatatatatttctgggtgattaaaaaagaaggaaaaaccagattgtgggttaattcattcctttccctgaaggagactgggctctgggctccctgcgtggtgaggatgaggagcagaatagagctgcagtcagcagggagcagggctcattctggggagcagagacaaatagagaacagtatctcttgctatatgcagggcactgcaacttacaaatcacagcgcatggcgaggacgagggttggggtggtacctctcaccatgtctccagctgttccaacccgtggtcaatgggagctctgatgcaggctttttgctgctgggccttccactcctccaactttggcagcagtagctcgattagggtagttaatcggcctagcagtgctttggaggcatccagcacctcctgggaaagagataatgtgagtgttgagcatctctccctttcaccctccaccacccaactggggatgaagaaacaaagaagccagcgctagaggaccagggtccccacatccctcatttttccaggtccttgttgcccacatgttctgtcctctgtctcccacctttctccttttgtccagttcattgagagtttcctgcagaatcttctgctctttggtctgatgggggtccagagagggtgtcttccctggatggtgggaacaggagtcagtccaggggttctttcctctccttcctgactggggtctcagtcagagtcaggaaggaggaattttgtggaggaagaaagggaaaccaagcaaagcacaggcacctgtgggaccctcaggcaaattctgaatggtcatgcttggaccagacaccccctcaaataaaacactgttagttttccatgcatttcctcaacatttactgtctctcagctgcacctccagctcagcctccacaaagcacttccagctttgcacggcagcaggactgtagtcagtggggtgtgtctgacagtgactactgctcatcggagctttctcctgttcacttccagctccggcttctcagcaggcacttatctttctccagcccctcaatgtgcttcctacctttggcctggatcttatatcggaagcagaagacatcctgctggtctttcagttggctgatggattttaccagcttctgcagaggggagaggaccccgatgaggctgcttctcagggaggtgttaggctgaacgctgtcaaccctaactcctaccacatctactaacctccatcatagcccttaaatccaggatccgggattcaatctcatgttgctggctctccacaggtgtttcgagaactggctctccttgttcctgaaaaaagaggctctgagcacgttttaactctggcctttcatgccttaagttcaggcctgaaattataccacaggatgtcggggggatcctgttctgagacaactccctgagtcctttccatggttcctctctacttcaggagtttccaacattaccactgaattgtcctcaccaattgggccctctgagcctggatcaaaattcttttttcttccagaaggaggttaaagatcatctcagccaactgggtaggatcctgggaaaagggctagaataggtaaacagaaaggattgatccaattcaaccactctcaatgacctattgccctagaccctccccaccaatgtccacagtatttcctcctccttcggggttcttagccctttgtcttttcaccatagcatcctcccaacagtgtcacgtatatgcaacccttctctctgctagtgattccccaagtccagactctgtcctcctttccccacatttgttcccgtctccctttccacctccaggtactattctattctccaaaccttactcctctatgctcagctcccagtgctaccccatcactcccaaccgttccaagtacctgaatgtcccggcagaatttccgcaaattgtgctgcagcaacaaggactctgggtcctggctgcaacggccacactcatagttcagctgatccaagaagtggaagaatagcatggtagccttggaatcatcactcccaagtgcagcttcctgcctgggcaccaggaataagaagtattagtgtctctgcagtgttactgtagtcctgaggctttccaaccccttcctgccattaatgattccaggatcccgggggcccagaagtaaggaaccacctttttcattcccccaacttcctgaaggcctcaccagttctggtcttcaatccagacagccaagtactgtcgaatgtccacaggcaggaggctgtgcgagtaaagctggtgcagctgatcctgaaaggggctgtcaagattctgcagcatttcccactgcgccatttgggctctgcgtcagaaggatgagggttcccaattggatattttgctggactaaatcatccatagtttcatgattgttcattattactaatttaaaatgtttaaattatacaagtaataaaaatacagaaaacattaaaatatatgttgatcctactgctaatcttggttctttcccctcctctccagaagtaaccactgctatcagtttggtgcatattcttccagggagtgctaccagttgagtatctgctattccaagcattttggatttcagatttgtccagattttggaatatctgcattacttaccagtcgagcatccctaatccaaaactctgaaatctgaaatggtccaaaatctaactttttgagcacccacatgacactcaaaggaaatgctcactggagcattttggagccaaatttttcagattaggaatgcctaatctgtattttttttttttttttttttttttttttaagatggactctcactcttttgcctgggccggagtgaagtggcatgatcttggctcattgcaaccaccatccccctggttcaagtgattcttctgcctcagcctcctgagtagctgggattacaggcacccaccaccacgcccagctaatttttgtatattttttagtagagatggggttttgccatgttggccaggctggtctcaaactcctgacctcaggtgatccacctacttcggactcccaaagtactaggattacaggcatgagccactgtggtcccaacctgtattttttttttcttcagatggagtctcgatctgttgcccaggctggagtgcagtggtgtgattttggctcactgcaagctccgcctcccgggctcatgccattctcctgcctcagcctcccgagtagctgggactataggctcccgccaccatgcccggctgatttttttttttgtatttttagtagagatggggtttcaccgtgttagccaggatggtctcgatctcctgaactcgtgatctgcctacctcggccttccaaagtgctgggattacaggcgtgagccgctgtgcccagccggccccaacctgtattttaatagcttcaataagtgggcctttgtgctttaatgggaattttctttctttttttttttttttttttgagacagggtctcacttggtcacccaggctggagtgcagtggcatgatcttggctcactgcagctttgacctctcaggttcaagccattctctgcctcagcccctcaaggagctgggactacaggagtgtgccatcatgccagctaattttttgtagagatgggattttgccatgttgcccaggcagatctcaaactcctgagctcaagtaatccgcctgcctcagccttccaaaatgccgggattaacaggcatgagccaccataaccagcctaatggtaattttcaaatacacactagagtagagtgaatagtacaaggatcaccatccagctttaacaaacattactatttccacaatcttatttcatctatctccctaattcatttattttgcatttatgtgtgtgtttgttatttatatttgattgtgctaaagcatttaaagatcagtgttgatgttaagtatttattacagcatgatccctgctggctctgaagcttttttttttctttttttttttttctttttttgagatggagtcttgctctgtcacccaggctggagtgcagtgacacgatctcggctcactgcaaactctgcctcccgagttgaagggattctcctgcctcagcctcccgactagctgggattacaggcgcccactaccatgcccagctaatttttgtatttttagtagagatggggtttcaccatattgtccaggctggtctggaacttctgacctcaggtgatctgcccaccttggcctcccaaagtgctgggattacaggggtgaaccaccatgcccggccacctgaagcttttttaggagccaaatctttttggtggtcaggtaagtacaccatataaactgccctccatataggaaggaggagctccattctagaagacatctaaatgctgtgcaatgggtggctcaatcccaagaatatgacacgtttatgacctgtgaatcttgaatatgattataggttatcaactttgtgagatcctgaaacttcacttaaaattgttgcctgtaatcccagctactcaagaggctgaggcaggagaatggcttgtacccaggaggcaggggttgcagtaagcagagatcacatcactacactccagcctgggtgacaaagcaagactctgtctcaaaagaacaacaaattggtttttgcctgtcaccaagcaggctgtcccatgcatctttctccccactgttccctgctcactgccagctggtgtctatttaggaaactgaaacttatgcttgttgcagcctgagcctaacagaacagaattcatgcatatttgtggtctaaaaaggtcacatgattttattacaaaataaagagaaatgcttggggtgggagagtcttctactaacatgaataacatcagctgcctttctacctccagcaggaacaagggaagggagggattgggcaggggctattttcattttaactcttttagtagtgcttgatttttaaaactatgtatctgtattgcttttatgataccaaaaaaaagttaaaaaaatgatcaggtggccaggcatgatggctcatgcctgtaatcccagcactttgtgaggcccacaagacgagaggatggcttgagcccaggagtttgagaccaagcttgagcaacatagtgagattccatctccaaaaaaaaattaatgatgaggtcccaattcttgaggatttaagtgtctgatattaaaggagcaagtcagcaaagattcaaatatgaaaacaaaacaaaaaacctggtctccccaaatggattgcaaacactgaggttaagggctgaaacaattttttctcattatctctcattcttaggcacatattttgcactcaagaagcttttctgaaatgaactgaattttgtgtgtgaccttaggcaatcgtttcatctttcagtagcttatactttttaacaaaacaaggataatagatttatctatctttgtttttagatttatctatctttgaacatcgttttttggtgaagataaaaaataatgcagagcagagggaaaaacgtcagataccgaaccaacataacaatgccagattccgggtctcggaagctgcagggcagttttgggagaggggcattagggttagggagataggctggacagaagaagatcgaggaccgagcaggcgacagctcctatttcaatctggggaccgaagctaccctctccagggggtaacccctggggccagtcgcccttccctcggaggaactctcactctcacccccacccctaccccagcacaccctctcagggcccgtacctgattagggttgcagtccccgcgccctccaatggctctggtcgcgacttcccgtccctagtatgagctcgggtactagaacctcgcgccccgcctacaacttcggctaacccccctcggacccgcccccttgtagttggcagcggaagtccggagcggcccccattcccagccgccaccccgacactggctgcca

SEQ ID NO: 2050 - DNA, 18656 bp, Homo sapiens; identical to SEQ ID NO: 2049
  source 1..18656: mol_type = genomic DNA

SEQ ID NO: 2051 - DNA, 75171 bp, Homo sapiens
  source 1..75171: mol_type = genomic DNA
acggttcctatataacgtttatttctggaagttaaagtagatacagcaatataccaaaaaaaaaaaaaaaaaaaaaagacaaaaaacctcacaataatataaatttttacactatgaagtacacattggaatttgaatgcagtggccaggacagcagcttataaaccaccttataggtaggtaagcaacccacgggattccctcggctgggctggggatggggagggggcagtggacaggaagcgggcagggcctgaggaccctgttctttaatgggccacaacagggctcagctcctctcagaacttttgctacaatcagagttaagaccagatacatgctacctaaggccatgaacttgacaatatctgctccagagaagccctgaaccctcgccctaggtccctatgatttaaacccaatggtaagcccaagtctcacctttctaaatattctgtttatcagttaagcttattatgtactgaagagtgttgctggagaagtaagagctctgcatgacacatcaactgtctccaggcaggaggactggggcgaaccctgttcatcttagagaaggtcgtctcccccttaattcagagaccagctaatttgatttaacaaacagaattccacagaaactctgatcagctgaggcaaggtggttttgagttgccaaatccggccatgcctctgagtcagaggcagcccatccagcacgtgctaggtgttcccatacgcacaggagaggcgagctagccagccaaggcgggcaggcggggaggccctctagctgttctgcctcacctgtggggccccagcagggaggagtcaccagcctcagagggaggccaggtatacaccctcatacgagggcagactcaagtttatcagtaagcctttgccctgcatgaactgaatgaagacgccattacaagtgccactggatatcaccaagaaactggctaagaaccatattccctgagctcaaccagacacgtcgctggggccccatagtgtgcatcatgtccaacctgtaactctctccccctcttcttccatgaggtcctgagaccaggattcctaaaacaaacaggatgagggacctttagacacgcaaggagacatgcctctagcaggatcagggggactggggtcgggagggtggggcaggaaggaagccagaatcagaagtatcccagccctgataaggcacccacagaaacaacctagcctctgaaacagcagatcaagtccagggagaaagggagtcaaggttgtaagcaccctctgcccagccttactcactaaaaggccaatacattacaaaggaaaataagtctatttataaaaaaaagtctaaaatgcttagattctccttaaaccttcctatttcaacaccaaaggccaggttgcagcttcagatgtcttaagggtttgacctgaagcccgtttcagggattatataaattaccagcctgaaggaagctgaatgcttaaagcaccaaggaggctgttaactgaagtttcttttttttttttttttttttgagacagagtctcagactgtcgcccaggatggagtgcagtgtgcagtggtgcaattttggctcactgcaacctccgcctctcaggttcaagcgattctcctgcctcagcctcccgagtagctgggactacaggcgcccaccaccacacccagctaattttttgtacttttagtagagacggggtttcaccgtgttagccaggatggtcttgatctcctgaccttatgatccgcctcggcctcccaaagtgctgggattacaggcgtgagccaccatgcccggctgcttaagtttcttaaatacagaaaggctatgctgatacagtgttttttgccctttaattgttattatttcttaatttaaaaagaaacctagggcttagatagtcctatcttctatttggatgtcagcaaggttaaaaagtgcaatgccaggagtatgtagctataggtggcctgtggcatttgcttacagaaacaggcagaaggatgccgcaggcaccaggaggcacttgtctaagaacaacaacaacaataacaaaaagctgctgagaaaggagggcaggggaacaaaacaacacaagacatttcctttttctccctctagccaccccccgccacatcccctgatcatgggtctcagagaacacatccttatttgcatttagataaaagcagatcacccacattcactcatttctctatttttaaaagtgcccagattgctcaaagatagcagaagtaggagattaaaaaaaatctggaaccacaaagttagtagtttcagatgatctggggtttggctgtgtgaggggtggcagaatgcaggtaggcgcctcagtcgtatctttctgcagcttccgttctcagctcctcacatgggggaggtagcgcactccgaggtcaactccatgtcaaaggtgagggactctggagggacagacagggaaaactagttcagttgtccaccctctgcaactggcaggccacgcccccagcccttcagaggacagggcccaggctaccactgctatccaatctcctgccccttaaggcccagggatggtcagaaaagccagatttaccctcctccctggaggaccctgcctcgggaagggtcctttctcattcccaccttaactgattcccagagctccatgtttacagaagctctaaggctgtcctgagatcttctgcccttgatctactgtttaattcaggagccccgagacacacgtggccaccaagcatttgagatttggtttgtccaaactgagctgtgctgtggctgtcaaaagcccactggattttaaaggcttagtatgaaaaaaaagaataaaaaaaggtctcaactttttctttttagtttagttttgtttatttgagatggagtctcactctgtcgcccaggctggagtgcagtggcacgatctctgctcactgcaacctccacctcccaggctcaagcgatcctcccacctcagcttcttgagtagctgggattacaggtatgcgccaccatgcccagctaatttttatattttagagattttggtcagactggtctcgaactcctgacctcaagtgatccacccacctcggcctcccaaagtgctgggattacaggcatgagccactcacccagcctcaactttttctgaaatgttaaattgagagtatgttggatttagtgggttaaataaaatatattgtaaaaattaagttcgtctatttccagtgtggctgctagaagatttatactcacacatgtggcattcataccatctcttttggaaagcaaagctctagaatctcctaccattccgagtgaccagctctcggtgtgtacatgtgagagcatcacacaaaggggaccaacttcccttatagggacaaagtctgtcaaccaaatactcaccaaactgccctcctgctgagggttcagcaccttcaccattatttccaaactgcatcaatgaatctaaagtgcggggggacatcggcaggtcaatggtattgctgcaggtcgttctgtaggaaatggggggcagcaggaggggaaacggggggttgacaagacacaatggaaaaaaaaaaaagaacaaaacacacacacacaagccatcaaactctggtctccaacagaaaaataaaagctcaagctttttaaacacacaaggtcactttgagtactaaacatagcccaggggcttccaacctttggcagattaactctcacccagtgtcccattcccagggataactgaggatattagaaatgaaggcaaaacggggaaaggaagccacttacggtgtcacacagataaacttggtcttcaggtatggggcagcgcctgggaagaagaaaaccagttttcttactgactgtgacttcgcattcagtaagcagagctggaggaagccatctgcctcggcaggactgatttgaaactcactcatcctcatgccaagattgtctggaaagctccatctgcccctcagggttgtctgccctcatttatactatttgatctcccaggcactagcagctgtgaacttcagttctttgcacaaagctgtcctgagctgcagagacttttcagcataaccttttcccacctgaccctagactaatgccaccttgtgtcccttctttccctagattatgtaaaagtttaacagcctccacgtggtctgagcattctattccggcctggtcatatctcttagataacttctctgcatgcaggaaccgagcctgtgtagtctttgcatggtgtccagcctaaataccaatatcaccaagtctttaaagaacatggagactgctaatgcttgtggttccaaagccaaaggttatatctcttattcctaccagcactaatctggcctctaccacatttttggatgagggcatgagtaactttctagttggataaatacgtcaatcaaaaagcaccaaagagaatgtgactttgtaaggcagtacaattgcttcaactagaagaccggagacctgggtccaggtacatcttcaatagctaagagacctggagcaaggcatggtctctctcttttgttgctgttgttcttattgttttgagacagagtctcactctgttgcccaggctcaagtgcagtggcacaatctcggttaccgcaacctcctactcccaggtcaaaacgattctcctgccttaggctcccaagcagctgggactacaggtggcaccaccatgcctggctaatttttgtcttttttttttttgagacggagtcttgctctctttcgcccaggttggagtgcagtagcgccatcttggctctctacaacctctgcctccagggttcaagtgattctccttcatcagcctcctgagtagctggattacaggcatctgccaccatgcctagctaattttttttttgtaattttagtagagatgaggtttcaccatgttggccaggctggtcttgaactcctgacctcaggtgatccatctgcctcaccctcccaaagtgctggattacaagtatgagctatcatgcccagccttggccacaatgcccagcccatattctcttttatgtataaaataagagggagggggaagacaaggtgccaattttctatgagctttgtcatttataattcttgttctacagttagaaatgcgttgacgggaataaaatgaattttagatgctgaatgcttacaccaagaggtcaaggaaccttggggatactggcatgaaatctggggaattcaggtgaacaaaccattgagaaggcatggggcagggtgaggtgggctgagaacagcacggtcataaaacatgaggcttagacagaacctgagggatcagagagcatgatgaccatgtgaaagaaggcactgcagagtggctcttgggctgccatctgagtttactttgggccaagaaactgatcaattcagtgcagaattcaaaggagctactgaggcaagactctagtgtcttataaatccaactgttttggcccagcccttagggagctgacaccctagacagaaaaggatttaattctccagcattcaagatagctgaggccaggcacagtggctcatgcctgtaatccctgcactttgggaggctgaagcaggtggatcacttgaggccaggagttcaagaccagcctcaccaacatggggaaaccctgtctttaatgaaattacaaaaatagctgggcgtggtggcacgcctgtaatcccagctactcaggaggctgagacaggagaatcacttgaacctgggaggcagaggctgaagtgaggtgagatcgcaccactgcactccagcctgggtgacagagtgacagactgtcaaaacaaaacaaaaacaaaaacaaggctgggcactgtggctcacacctataatcccagcactttgggaggcccaggcgggaagatcacttgaggtcaggggttcgagaccagcctggccaacagggtgaaacccggtctctactaaaaatccaaaaattagccaggcatagtggtgcatgtctgtaatcccagctactcaggaggctgaggtatgagaatctcttgaacctgggaggcagaggtttcagtgaagcaagatcgcgccactgcactccagtctggacgatagagcgagactcaggctcaaaaaaaaaaaaaaaaaaaaaaaaaaagctgagaaaaatgacttcattgtgtggctttgtacaagattgtaaatgtactttatctaatttgtaagtggctccgaacctctccctcaagccataaggaaatgctatgtgggcttccagtagagaaggaagagagaagagtcttgggaggataatctaacctgagaccctcataccataatactcttgtgatggaaatagagaggaaatggtcacatgctcatcgtcctgaaggcacccattttaaaataacacagggacacccccacacccgtcaccacactcacatggagtccctcagggcacactcctctcagcaaggcaaggcaaattactcaagtaattagttcctttctcctgatgagtgcctggcccctgaggaaacgctgacatcgctgggcaggaaaggacctggcctcccagcccacaggaagggcgatggtaatggaggatgcagcctcagactgggaggtgggaccttgaaagcaaaatgagtcaaaaggaccagccgtgggaccccaacgtcctctgcagaaggaacaaagagccgtgtggcaggggctgataaacagatctcccaactgaagcacacatgcaaagggagataggtggcagacaggaagtgagtaactcttacagcaggaacaagactcaggaccccaacaaaggagaaaggcaacggtcaattagctccaactccctcttccaagccccattctgccccatctcaagaaatccctcagaaggaattcctaggaaaaagtgggagggaagttggtaggtttctgtgtgtgtgctatttggacaaaaatagttttttcaacagcaactagggcaaggcgccaaccctaaaggatcacattaaagagcccatcattaggccaggcacagtggctcacgcctgtaatcccagcactttgggaggctgaagtgggcagatcacctgaggtcaggagttcgaggccagcctggccaacatggcgaaaccctttctctacaaaaaatacaaaaatcagctgggcatggtggcacaagcccataatcccagctactcgggaggctgaggcaggagaattgcttgaaccgggaggtggaggttgcagtgagccgagatggtgccactgcactccagcttgggtgatagagcaagacttagtctaaaaaaaaaaaaaaaaaaaaagcccatcattggctttatgattacagaaagttaaatcaaacaaagaatggcaaaccagagactccccatcaagacctgcacaaagaacccagagagtcaaaacagcaagtgctgaaggggaacagacagggctaccccctccacactgaggacagctgcagagattacagttttgtttcgtttttttctttctcttctttgtgtgtgtgtgtgtgtgtgtgtgtagtggggtcttgctatgttgccaggctggtcttgagttcctggcctcaagtgatcctcctgcttcagcctcccaaagtgctaggactgcaggtgtgaacccccatgcccagctgagattacagtatttttaatttctctctcttttttttttttttttttttggtgagtcaaggtcttgctctgtcacccaggctggagtgcagtggtgcgatcatggctcactgcagcctcaacctcctgggcttaagcaatcctcccacctcagcctcccgagtagctaggactacaggcacaaaccaccacacgtggctaatttaaaaaaaattatttttgtatagatagggtctcactatgttgtctaggctgttctcaaactcccaggctcaagtgatcctcccgcctgggcctcccaaagtgctaggactataggcatgagccacttcacccagctaaaataatttatatataacatataagtacatgtcctcttacacattaaaatataccttattttcaatagttgcacactctaaatactaatcccttgcccctccacccagtcactgtcttccccttcaaacgtgatgctcccagctcttctactctagtgtaaaccatactcccatgcagctaataataatttcctccagaaaccctttcttcagaccatctggcacactgacatggttcagttacaggcaaaaagccatatgctgggctgaaatctgggcctcaaaccttctagcatctactaagaagcactgtgccagcagggcatcctgttaactgccctcactttcccttctcgtgtttcaggcatgttttgggggacgtatgtgtattgatcccctctttatttttattttttgacacagtatctcactctatcagccaggctggagtgcggtggcatgatcaccgctcactacagccttgaactccttggctcaggtgatcctcccacctcagcctcccaagtagctacgactacaaatgcgtgccaccacaccgggtaatttttttggattttttgtagagacgaggtttcaccatattgcccaggctgtatcccctctttagactcatgcactctctgtggagcaggaactacactactctaagtgattctgattctcctctcaaatcccatcggtcaccccaacaaaagcactcactacaattctttcccataaggagaaataattatcccccaggttattcaggcatttgcctatctatcctccaaggatcccaaaatttccaacttttcccaaaaattaaatgccaggaacatggaaaatcaacaactacctgggtcagcttcaggatgctcctggctctctggccgacaatactttccgaatgcctcctccttgggaatgtcaggatagagatagaccagtggagacaccaggatattggtagcatccatgatcttatagcccatgatgatttcagcaaatgacatgttgttcagctgctgctttgtgtatggttccacggactggatctgggtcttacctgtcacaggacatgggaaggaaagatcatggaacctacagctaggtcatctcagagaaaactgcccattttttctttcctcgaaggggaaaagacttaagccaccctagtgttgagaccctgaacaccctgttcagtggcctggcactgtggaaatattcaggctggcttctaattaagaagaggctactagttgggtcatagaaaataaacttgaatataactacttgcgtaagatatattaacagggttaagtagaaaaagagatgaagaatacaatttaaattgcaaaattctcaacaaatagtcactggagcaagcaaaacaaagcaaaccaatccttcagctggaaggatttagaagtcacgcaaatgtgttttgcgagtctgagtgaaacagggagtcaaggccatctccacccaccagggggcagtaggtgcttgcaactagaagcagtgatgaggcctcagcagccaccagcaggtggggtgggtgggagcctcccttaccgctgatgtccttctccacccaagtgaaagtgacgcctccttctttgctgctttcactgaatcttagcaggaaggtgcctggaggcttagtgctcaagatggcccgctcccgctccttactgataaagcccatgatgtacctggagccaaggaggaggaacaatgttgttattgctaacagggcatccatcccctgccactggcttgctgagagcaggggacttggttacatctgtgcacactctgtccaacctacccttcgttccaaagggccaggatgtactttttcacaaggtcaatgatattgtccagccagacccagaaggagaagcccttgccagccatgttttcctggagaaaagagtaatgggaaagccaagtctactgccatcccagcccttcccttcctaggggtgcagtgcatcacccaaatcctcaggcccgtctaccttcaggcaggtcctactggccgctggaccaagagttcagggccttcaagccagagccctcaacgacagccgtgcaggtgagcattcccattcccacgagaatttaacaagattgcttactttgcaaaatttagcccatgtgatctgacaccctgaataattcacaccaggtcctgaaggaaagaaaaagagtcaagtagtacattttcagcttggggtcaagaggttatttcttaaaacagaacacacacacattcatcccacaatgggccacaaaataatcagctttcacatctttgaaggtaggcactgttgtgtgtgtgcacatgaggacaaacactatcccatcatttgactcacttgtgttgctgggtagcccagcagggatggagggtgatataacaagtccccctgctcttcccaacctcgggtggtaggctgggaaccaacagcagcactcactaacaagctgacatcgggtgtcagacaggtgtatttggtggcaacagctttattagaacaaagctacttctagcccaggtggcacataaaatattccactaattcttttttaaaaactagcctacgctgggcacagtggctcaagcctgtaatcccagcactttaggaggccgaggtgggcggatcacgaggtgaagagacggagactatcctggccaacatggtaaaaccccgtctctactaaaaatacaaaaattagctgggcgtggtggtgagcacctgtagtctcagctactcgggaggccgaggcagaagaatcgcttgaacccagaaggcggaggttgcagtgagccgagatcacactactgcactccagcctgggcaacagagcaagactcgtctcaaaaaaataaataaataaataaaataagacaaaaaaaaccaactagcctatagtttattaaaaaaatggacagggaatgtcaagcctttagtgccaccttccaacacacacttaaaagatcttctaaagttagatagagtgggtgaatgagacagcaaccaggagaaaagaaatctacctcccacctcaaaaatgatcacctcgactgaaaactgcaaactgtctctgcaccccaactccccaactcccctgtttcctggcaccagcacagcgccttgctcaggaaagaaacatggcctaatgctcagtagacatggcccaaatgaacagccctatgggccggatcccttttctgggcgggtgggcgggagggagaaggggtgaaatgcggacccaagagtttctctgccagtgtagtcagctgctcgatgctcagtcctcgcttggtggtggaggagaactgccagctcaggacctcggccacttgatcccaggttccaattgggggcttggtaaaaaagtttacattctattggaaagaacacatttgcttgtttagatgagggatggtgctcattgtctatactaggtacccctaagtcgcaagagatcccggggcaccaactaaaaggagggggcactaaccttgggattgttggtcagcatgttgtaccacaggatggacgcccaggcatttggcatctgacagatgttggagatcaccacaactggcaaggagtgggtctgcggagggagtggggactgagctggggaggcagaggggctctcacagccttggaaatctcttcacccgcatctcacggggctcagaatgaaaggacatgccataaaccacacctgctgccaactctaggcgaggagtgtgagtgagtcagctcagtgagcactcatagtggaaagaatgcccagcgtggccacacaactcaggctgcagtcggaatataccggtcccttgtaaaacctgacttgctcaaagcttgactcacaatccacagattccccatttttaagaccttggaggcattctccaagacttgaagctgtatcttcacatgaaacagggaggtctcaggaatcaaagaccaggattcctgcttttctaggtatatcttaatttaaaaatcaagaaagttgggaaaggagaatgtcattgccacaattttctgtatactaaacacactggctgctaagactcttatgcccaaactttataaagtcagttctaatttcttttttttttttttgagacggagtctcactctgtcacccaggctggagtgcaatggcacaatctcagctcactgcaacctctgcctcccaggttcaagtgattctcctgcctcagcctcccgagtagctgggattataggcgtccgccaccatacccagctaatttttgtattttagtagagacggggtttcgtcatgttggccaggctggtctcgaactcctgacctcgtgatccacccgcctcagcctcccaaagtgctgggattacaggcgtgagccaccgcgcccggccaatcaatttctaaatagagattttcatatcaagtttgctgaaagctgaatatacacacatcttctaagcattcaagcaagactttattgccagatgggatgccaaggatttttttggagaaaagtaagcaaaaataaacacagtgttaagcaaacagtaatcattccaccttctcttgtaaaaatcccagtggaagtttttgtcctgagtcacccctgtacgtagcctctcaccgattctgctgcagaacttacctctaggtcaatcttgaggccttggtgatacacctcggtctcaaaggtgatcaggtgcagctcctcagtcacaatcagggaagcctacagtaacgagaaggacactcttaggccaggtgtggtggctcatgcctgtaatcccagcactttgggaggccaaggcaggaggattgcctgagcccaggagttcgagaccagtctaagcagcacagcaaaactccatctctgcaaaaaatacaaaaattagctgggtgtggtggtgcacacctatagccccagctactcgagaggctgaggtgggaggatggcttgagcctaggagatggaggctgcagcgagctatgattgtgccactgcactctagctggggtgacagagtgagaccctgtcttaaaaaaaaattaaattaaataaaaaaaaaggctgagcgtgatggctcacacctacaatcccagcattttgggaggccgaggcaggtggatcacatggtcaggagttcgagaccagcctggccaataatttggtgaaaccccgtttctactaagaatacaaaaattagctgggtgtggtagtgggcgcctgtagtcccagctactcaggaggctgaggcaggagaatcgcttgaacccaggaggcagaggatgcagtgagccgagatcacgccactgcactccagcctgggtgacagagtgagactctgtctcaatcaatcagtcaatcaataaaaaagagaaggacacttttcctcagagagaatggcattcagtactaacagccacagccaaggaaagtgacatgccaagcctcaccacaccaagaagggtaagccaccaggtggtcacaaacaaactgccagggacacaacttgctcggcacttactctcttcaacaccaagaacttccaatgctgtgatcctcaacctaatcctttactcagtttgtattataatattacatagatccaattggttatttgtaaaatacgtaaggcacaaagaataacaaaacaatatgaacccaccattcaatttaaggaaaagtccatcactcctaaaattctctgggtgcccttccccaaccccatccccttccctcctccctcagaaataactgctattttgtcttttgggtttatcatttcctagccctttttgtcttgttttgttttgtttttttacagttttaccatatttgtttatctaagcaatgcaggtattgtttagtttgggacatttgtgaaccttacacttatggactccaatgaattcttttgggattcacttttcacttgatgtgaaatgaatccacatggttatgtgtatctgcagtgtattccttttcacagctgcggagtattccattgtgtctataccacaaataatgtattcattctaatgttgatgggtatttatttgggttgcatttagagcttataatcaggctgatgtccactttatatatgtctcctgggacatatatgcaaagatttctctgctattaaatcctgggaatggcaccgttggtttacaggtatgttcatttttatactgccaaattgttttccaaactgactacaacaatgtctcacatcagtacagcaaccttattttaagtaagagttgtcaatgaattctcaaaaattgaattctagtctgggcacagcggctcatgcctgtaatcccagcactttcggaggccgagatgggtggatcacgaggtcaggagttcaagaccagcctgaccaatatggtgaaaccctgtctctactaaaaatgcaaaaattagccaggcgtggtggcatgcacctatcgtcccagctacttgggaggctgagacaggagaatcgcttgaacctaggaggcagaggttgcagtgagctgagatcgcaccactgcaatccgatagaacgagactccgactcaaaaaaaaaaaagaaaaaagaaattaaattataattcatttttaatactatttttctgattataaaagtaatatattcagtttaaaatgcaaatatcacagagacagtctagaatagccatggataccaacagcagcactaatacacatagcactgctggtatattcctccagaatttcttaatatacatatgaatacacataagagtatagtgtatttttaaaacacatatactaataatactattcaaattattttacattttgctttttcttaatatgtcatgtacattttcccatatcattgcatacaggctacttcactctactgtcaagtaaaattccacatttttaaaaaggactgctacattttattttatttatttttttgagacagagtttcactctgttgcccaggctagagtgcagtggcaaaatcttggctcactgcaagctccacctctcaggttcaagcgattctcatgcctcagcctccccagtaactgggactacaggcgtgcaccaccacacccagctaatttttgtatctttagtagagacgggctttcaccatgttggccaggctggtcttgaactcctgacctcaagtgaccagcctgccttggcatcccaaagtacggggtgtgagccagcacgcccagctaggactgctacattttaaagaggaagaattgttcaggggacaaatgtaagaaaaagaacggggcatcacaatttttaaaaatgactgaaaactagccttccgtcacatttacctttttttgtttgtttgtttaaagtttattcttgacaataagaatccaataatctgaatcaatgaaaagcagaaaataagggggataaagaacaagatgggtttttgtttgttcattttattttatgtactcttttcctaagcaagctaatgcaaggtggtcatttattttaaagtttaactcaaatctgttgcttttacaccctctatcccacctcagtgggagagaaaaacagggcactaaaaatggagccaagcagggtcagccgcaggagctggatggggaatttggaaagccccaggcaaggtggaaagctgctttataccacatgggtgtggagaacaactcagcaagggactttccacttctccttaaggaggagccaactcccagatattcacggaaatgttccaagccagagagctccatggcacatggaacttctgttcatgtcactttggcctgaagtgactttttggaataactacagctgaaagaacaggttgatgtttctaattctggggattaagaaggatctttacccctctctccctcaaggaaaacaccccagttgtctttcatccccaacaaaacttacatcacaattggctcggcccccattcccacatctctgctccctcagggtctgtaagaaaagaaaaaggcaggtgtcctgtgaggctctccctagccctctccggcagccagaggccctttgtgaaggggagctcctcccacataccaagtgtttgaattctgcagagaggctgccgttgttggattcttccatgttcatcacttttgtgtttgtgcccagaatgttaaatttccgggatctgaatcacaggggaacaatcaactatgtaggtgaccaagtagccggaggatgaagttaggttaaacggaacaaaaggaagcctctaggctgaacttaccctctgagagctgcaacgtccccagagtctctgtaagaacacagactgttgttaataaaataggctctgtgtttcttcaaaaagcctactttgaccacctgttatttactgtcatgaaaaaacctctgtgctcctgggcatttctttaaactattcagttacagttgatcagcgcaacataacacctctgcgtagcaggcacagttggttgcctccccataggaaggggaacctatgtttcatattgcatatgtacttattaaacctaccaccttcgtcaactcccttatttcattattttccagtgcatcctcatgaaatttccacataattacatcaactaaaaataagaatgcattttatcttttcttttttctttttttttttttgagatagtttcgctcttgttgcccaggctggagtgcaatggtgtgatctcggctcaccacaacctccacctcctgagttcaagtgattctcctgcctcagcctcccgtgtagctgggattacgggcatgcgccaacacacctggctaattttgtatttttagtagagacaaggtttctccatgttggtcgggctggtttcgaactctcgacctcaggtgatctgcccacctcagcctcccaaagtgctgagattacaggcgtgagccaccgcgcccagccacattttctcttttcttttctttttttttttttttgagatggagtctctgtcgcccaggctggagtgcagtggtgtgatcttggctcactgcaaactccacctcccaggttcatgccattctcctgcctcagcctcctgagtagctgggactacaggtgcccgccaccacgcccagctagtttttttgtatttttagtagagacggggtttcaccgtgttacccaggatggtctcgatctcctgacctcgtgatccgcccgcctcggcctcccaaagtgctgggattacaggcatgagccaccgcgcccggcccacattttctcttttctaatgtcgtcaaagggtatatgtattttacatcctgaaaggtattgtgaaattttgcgtattccattatatggtaaagtgtggaacaattaaaaaaaagagatctattctttccacatgctatgtatggaaagaatatataacgacgtttcggtcaacaacaaaatgcatatatgatggtggtcccataagattatcatggagctgaaaaattcctacttcattgagatgtgttacaattgcctacggtattcagcacagtaacatactgtacaggtttacagcctacgaccagtaggctctgccacatagcgtaggtgtgcagtaggttctgccacccaggtttgtgtaaggactatatactctacaacatttgcacaacaaaattgcctaatgatacattttgcagaacgtatcccagtcgttaattaacacatgatctcagtcttatatataatatgcatgaatgacatgtacaagtaaaaaactaaacaaggaaaagagggactggttgtcacaatagcaaccacaaatcaaatctgtacccccagctttgtggctttgttcagacacgtaaatgacaatgcaccccaaggcttttgaaaacttttgtccacaaaatgaagatctctgaataaagacagagtctctagttcaaatgatgtctgtcaaagttctcatttttctattcctcatttgaaaaacagagctaagataggagtacttacttgtcaatgcacactttaattttaagctgataattcaactcagggaatttgaccagcaacctatttaaaaagaaaaaatccaaggaaaaaaagtcagtaactctcccataaccttttcttgaagaaatgtaaaattcataattcttcatttccaacaggtaaataggccaagctgtctataattacaggctcacatctataatctcagcactgtgggaggccaagctgggaggatcccttgagcccaggagttccataacagtctgggcaacaaagtgagagcccacatctataaaaaatttaaaaattagcggggtgtggtagcatgtacctgtagtcgcagttactcgggaggctgaggcaagaggatcacttgtgcccaggagttcaaggctacagtgatctatgatcatgccactgcactctagcctagatgacagagcgagatcctatctctctttctctttttttttttttgagacagtttctctcgttacccaggctggagtgcaatggcgcaatctccgttcaccgcaacctccgcctcctgggttcaagtgattctcctgcctcagcctctcaagtagctgggattacaggcgcgcgccaccacgctcagctaattttgtatttttagtagagacagagtttctccatgttggtcaggatggtctcgaactcccgacctcaggtgatccacccaccttggcctcccaaagtgctgggattacaggcgagagccaccgtgcctggcccctatctctctctttaaaaaaattaaaatagggctgggtgcggtgactcacacctgtaatcccagcactttgggaggccaaggcaggtggatcacaaggtcaggagttcgagaccagcctggccaagatggtgaaaccccgtctctactaaaaatacaaaaatcagccgggcatggtggcaggtacctgtaatcccagctacttgggaggctgaggcaggagaatcacttgaacccaggaggcagaggctgcagtgatccgagatcacacctcagcactctagcctgggtgatagagaaagactccatctcaaaaaaaaaaaaaaaaaaaaaaaggccgagcgtggtggctcacatctgtaatcccagcacttttggaggccggggtgggtggattactgaggtcaggagttttgagaccagcctggccaacatggagaaaccctgtctctactaaaaatacaaaaattagccgggcatggtggagtgtgccggtccagctactcagggaggctaaggcaggagaatcgcttgaacctgggaggtggaggttgcagtgagttgagattgcaacacgcactctggcctggccgaaagagcgagactctgtctcaaaaaaaaaaaaattagccgggtgtggtggcacgcacctctattcccagttactcaggaggctgaggcacaagaatcacttgaacctgggagatggaggttgcagtgagctgagatcatgccactgcacaccagcctgggtgagagtgagaccctgtctcaaacaaaaacaaaagatgagtatcactccttcaagccaaaggtactgagaaaacatctaagaactaacaacttaaagttgtgagagattcacaaaaggataatcaaagccatataatgaaaaatattacaggaacacatgctgtgcagctggcattttgttctattaatcctgaaaccgaacaccatactaagtttctgaggagggaaattttgctgcagaaggtcaaaaccccagcacacctgttctgacttgagtgtgaaagtaacacctcaccctacaggcccaccacccacctgccctggggcctctcagcttccccatcactaagccttactctttcccttaaaatccacagggaagagtagcctcaaagaacagaaaatagatgacattattttgtcccttgggcagaaggagaagctgtggcctgagactccaggtctacaatcataggaatatgcccaggtaccttcaaaaagatgactgctcttttgcttttgacatcagaatcagagagcaagcagatagtatggcaacaaatttcaaccccgcaacagtgtactgcctgtgacaccacacctggaaagaatgaccctggccaccaactctaccctcaccctaacagtgtccctcagtaaaatctctactggaaatggaagtggcatggcctacctgactttagtagtgaactggacgccggtcttgatgacgaggggccggtcaggatgcatgggcatgcagggctgccgctccaccacaaaggcactgaggaaagagaagatgggctcacgcgccacggccatgaccagaagtcagcccgcctctcactctaccacgtgagtctttaggtattttttagatgagggaaagggacaaggatgctaaattaccttttcattaagtttctaaacagctccacgattctctcctccagcatcggccggtgctgtacaatggggtcccctttgtaggaaactttttgctgcaactcctccagtttcttaatttgttgacgggtctgaagttgagattctgctaatgacgttatcctgccaataaattaagaaagatgctaattaccaaagtgaatgtatacaggtgagatggagaaggggaaggaaatactgaagacatggagaccactacaataagaacaaggaatttttttattgtggtgaaatatatatagcatgaaatttacaatttttcatcttaagtttacagttcagtgacattaagaaaagaggaatttttcaccatgttgggtggatgctgaaaaaataaataaaaaaagaaaataatttatttatttatttattttttgagctggagtgcagtggtgcaatctcggctcactgcaacctccatttcccgggttcaagtgattctcctgcctgagcctcctgagagattacaggtgtaagccactgcgcctggcctttttttttttttttttttttttgagatagagtcttactctgttgcccaggctggagtgcagtggcacagtctcagctcactgcaacctccgcctcccaagttcaagtgattctcctgcctcagcctcccaagtagctgggattacaggcacccaccaccactcccggataatttttgcatttttagtagagatgggattttgccttgttggccaggctggtcttgaactcctgacctcaggtgatccatctgcctcgacctcccgaagtactggcattacaggtgtgagccaccatgcctggccagaaaataatttattttaccttttattactagtcccttcctaaaatctcaaatttctaagagggggctgggcacacaagaagtattaaaatttataccactaggaggcattgatggagttatcactggaaaatgacaagcatctgagcccagatatgcagaacacgaaatatggaatttagcacttactttactcatcctaacttgtctatgaacataaagactcagaaaaagagattagacagctcccaaagatgggtttgagccagctctgtcacacactatctgtgcaagctttgccaggcccttcaccatcatgggccttagcatccccttgcatgaagagaagggcttgaactacatgagccctttcttttctttctttctttttttttttttgagacagggtcccactctgtggcctagtgcagtgcaatggcatgatcatagctcactgcctcctccaactcctggacatgagtgatcctcctacctcagcttcctgagtagctagaactataggtgtgtgccaccatgcctgtttagtttagtttagttttttgagatggagtctcactctgtcacccaggctgaagtgtaatggcacatgtctagttttttaaatttttgtagggatgggatctcactttgttgcccaggctggtctcaaactcctgggttcaagtgatcctcccgactctgcctcccaaagcattgggatttacaggcgtgagccacaacacccaatccccataagccttttcaatgtcagccttcaactgatcaaaggacatgacattatgtttcaaaatattgataacatgcacaaggaataagtgaatagagagggagaaaaagctcattaaatctatctccaagaatagagatattaggccaggtgcagtggctgacacctgtaatcccaaaaatttgagaggccgaggcaggtcgatctactaaaatacaaaaaaatagccaggcatggtggcatgggcctgtaatcccagctacttggaaggttgtgactaagaatcgcttgaacctgggaggaggaggttgcagtaagccaagatcatgccactgcactctaacctgggtgacagagtgagactctgtctcaaaaaaattaaaaaaagagagaagttagcatcattccatcattctttgatggtttatcactagtgtaacaaagaccaaaagaccagaaagacagaaagtgaaaggagagggagggggaccgctgcagggatttctgaactcctgagctcttttctggcacttctatcctcccattcccagaacttaagcttcttcgttccctggtcaggaagcatttaaaactgctttcagtaaattaacaacactcagggttagtgaggatatgaatagacaggcattctcatgtagagttgcgctaaatttccagtgcaggctctgtatctcaagtttctcctaaggcaagctggtgcaacatgctcactatagggccttgcacaggaagggttgcagtaagatatgctggatgaaggtaaaagtgcaaattacagaaaagcatataaaggaagatcctgggctgggcacggcagctcacatctataattccagagcttttgagaggccgaagtgggatgatcccttgagcccaggaatttgagaccagcccaggcaacaaagtaagaccctgtctctataaaaaatttaaaaattagccaggtgtggtggtgcatgcctgtagtcccagctactgagaaggctaaggtgggaagactgcctgagcccaggaggtcaaggctccagtgagccatgactgcataactgtactctagactgggtaacacagtgagaccctgactccaaaaaaagaaaaaaaaatgatcctaatataaactgtataaatttctatctttatgtgtatatacataatgtgtatatacataatgacagatgtctagattgagcatcaactaaattttaactactagtactgctgatgatttcatttaaaaattttttcttctcttgattaattttctgtatttgaattttttcccttaaaaagggcatgtgtcattttagattactaaaataactaaaattaaaaggtttgtctatctgttaaatacagttaaaccaaaagccttaattgaattattaagtaaaatatacttaaaatataataatataaatacattttttaaaacaaagtttctccaaataaagtaaaaactttattttatttttatttttttgagatggagtctcactctgtctcccaggctggttggtgtgcggtagtaagatctccgctcactgcaacttccatatcccaggttcaagtgattctcctgcctcagccgcccagagtagctgggactacaggtgcgcaccaccacgcccggctaatttttttatgtttttagtagagatgtgttttcaccatgttggccaggctggtctcaaactcctgacctcaagtgatccgcccatcttggtctcccaaagtgctgggattacaggtgtgagccacagcgcctggccgaaataaagtaaaaactttaattcttgggctaaatttgaatatggaaaagtccccacgttggagatatagtaccaattctgtgggcctgcagttaagatcagaattcaatctagctttcgagaaagaaaggaaaagcttctttcatcctttaccagttttctagccgatctaggcagatgttgggcgggcctccaatgcaggcaatctgttgccgcctcttccagtcagccagctcctcgtccgtgagagttttctgcacgtactccatcgctgacaaaagccccgccagctcactcacgatgctctggttggaaaccaaaacaaagtcagaaaacatttcctcagactgtctctaaccacattctttagtcaactccagagcaggaacttcttagaaaccaagcaagttctgccacaagacgctgaaatcccgcaagtgagcgagacacatgggggaagtggtccgacctatgcccttactctccgcatctggtccagcgcagtgagcatctgttccagctgctgcatcttctgcctggtcactgactggttgtttccattcagatcttgcatgtctgcgaaggaagaaaaaactccttgacctgagggaatactccttgacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactccttgacctgagggaatactcctggacctgagggaatactcctggacctgagggaatactcctgtccttaatgaccaggctcctttgaggacccgtacctcccttgcgccccgcccgccttaagatctaaacagagttaagacaaatgagtctttcaactcaacaacacaaactcactttctagagattttaacatctctaatattcacttgcctccttgactcttgagggttttatagttgaaatcaaagtcatcctggagattctctaccactttcattttctgttctagatcctgtttaaaataagcaaacaaaaaaacagaagtaaagaaagatttccttgggaacagaaaatataaagtttctgaggagaattcaaatgaagccaaaacctcaaaaaagatacatgcaggacctgcaggcagtatccccaagagaaggctccctgttggccaggtgcagtggctcacgcctgtaatgccagcactttgagaggctgagttgggaggatcacttgagcccaggagttcatgatcagcctggacaacacagggagacccccatctctacaaattttttttttttaattagctgggcgtggtggtgcatgcctgtggtcccggctacttgggaggatgaggtaggaggatcgcttgggcctgagaggtcgaggctgcagtgagctgtgatcatgccactgcagcccagcctgagtggcagagcaagaccctgtctcaaaaaaaaaaaaaaaaattaatgaaagctccctgcccgaggcttgtaacttgcatcacctgcactctcttccggacatcctgaaggtgctgctccagcatctgctgcttctccgtcaccacggctgctgtggggtggttggcctggcccccttgctgccaaaaaggaggtcaatgcacatgtgaacacagaactatggggagaggaatacctctacccagcttccatcccaccctaactacccttcttgtttggcttgagacgctgctgccatcacaagaggaagggaaacagaggcagtggtgctgtcactacacaggtgacactacacaggtcataccataaaccccctttatggcactaagagaccacatgttcagctaagacatggtctatgccttcaaaaacctcatgggcaagtatgtcaaaaaattcaaaacaatttatgacagcagatgttggatgtctacttaaacgtggtgtccagtatatttctgagggataataaaaaaaaagtcctgccctagggatgaaattccatattaaaagatattatcttggggagaaggggaggctggtaccttggaaaatgtcaaatagcacatggaaaaagaaaaagaagaaagaaggctggatgtagcagctcacacctataatatcagcacttgggaaggctgaagtgggaggactgcttgaggccaggagttcaaaactagcctagtcaacatagtgaggccccatctcgaatgaataaatgaatgaatgaattaaagaaataacaaaaaataaatagcatatgaaacttaaaaattacaggttcgtgccaggtgcggtggctgatgcctgtaatcccagcactttgggaggccaaggtgggcagattacctgaggtcaggagtttgagaccagcctgaccgacacggagaaacccatctctactaaaaatacaaagttagctgagcttggtggtgcatgcctgtaatcccagctactcgggaggctgaggaaggagaatcgcctgaacccgggaggtggaggttgtggtgagccaagactgcgccatgcactccagcctgagcaacaaaagtgaaactccatctcaaaaaaaaaaaaaaaaaattacaggcttgggctaggcatggtagctcccacctataatcctagcactttgggaaaccaaggcaggaggatcacttgaggctgggagtttgagaccggcccagggaacatagaaagagacctcatctcaaccaaaaaaaaaaaaaaatttttttttaactagctgggcatggtggcatatacctgtagttctagctacttgggaggctgaggtgggaggatcatttaagtccagaagtttgaggccacactacagccagttttatgggcaaccattctcttcctttcccatggtccctatccaagcccacagaatacaaacttcttagaagttttgggaaggtgacccatgcccctacttcttcccacagtgacagtgactcatctgattggtaagatggagagaaagactctgtgtacacacagatcttcaaagaacccagcacctaagctggtgcctccctcctctcactcttgccttcctagggcccaccataagcaagagcagcagcctggtttctagaagcaggtctagaggcctatccctctgccttgttggtctatggcagctgaagctccatatggatggctggggtggggtgggggtgctgctctgcacatccagtctctctaccccaagatctaactcagggcacaggcattggaaagcccctatggttaccagctcaagccacactttccattctagttttaccaacaatacagctgatgttttaaccttcattcctttctcatgtctatttctcaagcaggactacacttaaagggagaaaacatgattaacgatcacccacagaaacccacctctaataccttcgtaaaaaactgtattggctccccactgcttccagctataaacatctcaggccaacacagaaagctgtttcacacaattgataacttcaactttccctccctgtgccttggtcaccccagactcccaactcttccctgcatgcagtgtgtttccacactctcttcccacccgctatccactcagcatggcctgggcttcagcccaaacacacctgaactcactcaccttcaaattcagttcaaatgtttcttttcctgagaaatcttattcaacttccttagacaaaatgacacacatccttttctgtgtttttctcactttgagtgtttgtgtacttataatcccaactagcctgacagcccttggtagcagggattacatccactcttctatctttaaccaattctagacacttaagagcatgccaggtattgtaaacagaaaaaatagcagtgaggcctgggttgaggccacaaataaccaacttatagctttatatcaggggttgcaaactttttctctaagggacagagggtaaatatttttggtttcctgggtcatacagtccctgccacaaatagccctgccactgcagcaccaaagcagccacagataatgcataaataaatgagtgtggctgggttccgaaaaaacctcatttacaaaaacaagcagcaggctggatttgggccacgctcacagtttgcagacccctaatccgtacgattgaaaacatccttgggataactttggctttcctacctcccatggtaagttggagcctctatccaaattgacttaaaccacttatttttatcttgtggagcaggataaaatacaaaggttttccacagcagaaaatcctagtgctgcctgagcaaatgcctgtgtgctaacctcttgggctacagggcactgcacagtaagtgttacctaccacctcgctcacacctgagcatatcagttttctgcttaaaattcctcactagggccggacacagtggcttatgcctgtaatcccagcactttgggaggccgaggtggatggatcacctgaggtcaggagtttgagaccagcctggccaatatggtgaaaccctatctcactaaaaatacaaaaaattagcccagtgtggtggctcatgcctgtaatcccagctacttgggaagctgagacatgagaatcgcttgaacctgagaggcagaggttgcagtgggccgaaatcgcgtcactgcactccggcctgggtgacagagtgagactctgtctcaaaagaaaaaaaaaaaattcttcactgggtccccatttcctacagtaatggtgagggtgatgatagtgatgtcagcagcagcagaaagcagttaaattattttgcatttatgtgtcagatactgttctaagcattttacatgtatgaattaattctatgaagaaggtattgttatcactcccattggaggaacagagagagtaaaaattgtttacttaaggttacagagcaagtggcagggctgcgggttcaaaccgaagcagttggccccttgtggtaaactgctcttccagggccccactgttaggcatgactaattaaaacatcatgtggccttgactagcttgtcttccccgacccaatcagatgctgaactttctacacttctcccaagaatacacatttctgtttctgtctttgaacatgatcttctttctgcctggagagctctttctcatcagttgatgagcccaggagttcaacaccagcctgggaaacatggcaagagcccatctctaccaaaaaaaaaaaaaaaaaaaattagctgggcatggtggcatgtgcctgtagtcccagctactcataaggctgaggcaggaggatcgctagggcccaggtggttgaggctgcagtgagctgtgatcacaccactgcactccagcctgggtgacagagtgagactgtctcaaaaaaaaaaaaaaaaaacaaaggttacaaaggtaaatttgaaatgtaatgttatgtgtatttcaccacaattttttaaaaagcagggggtcacggagaaaaagaaaaaatgtccctgattataggatattaaagacggtaaaacccctcacagaaagtaaaaaagtctcctatgaccgactactttaatgatttagtatatgtgtttccagatattttcccatacataccaatagtatatgcaaattgcatacatttagttttactactatgaatcagatctttctttttttttttttttttttttcagtcggagtctcgctctgtcgcccaggagtgcagtggcgcaatcttggttcactacaacctccgcctcccaggttcaagcgattctcctgccccagcttcccgagtagctgggactacaggcgcgtaccaccacacccagctaatttttgtatttttagtagagatggggtttcatcatgttggccaggatggtctcaatctcttgacctcatgatctgcccaccttggcctcccaaagtgcttggattacaggcgtgagacatcgtgcctggcccagatctttactttcattacatcttctaacaggttactgctgctactgattaggggaactgcagattctaaaaatatttatcttgtatacaatggcctttctaaaccttgctagttccaattgttattgttagttttgtttctcttggatcttcgaggaagacctatctatctgtaaataataagagttctgtcccttgctttccaatatttgtaccctcatttctttttctttttgcataggctggatccctcagaaaagtatcaatggtaaaagacatccttatcttttgctgtttttactgagaatagtgtttcaccactgtgcatcatgctccctttggtttctgataaatattctttcttgtgtttagaaagatccttaattaagccaggtgcggttgctcacgcctgtaatcccagcactttgggaggccgaggcgggcggatcacgaggtcaagagatcgagaccatcctggctaacacagtgaaaccccatctctactaaaaacacaaaaaattagctgggtgtggtggcgcgcgcctgtagtcccagctacttgggaggctgaggcaggggaatagcttgaacctgggaggcagaagttgcagtgagctgagatcacgccactgcactccagcctggcaacagagcaagactctgtctcaaaaaaaaaaaaaaggctgggcgtggtggctcatgcctataatcccagcactttgggaggctgtggccggtggatcatgaagtcaggagatcaagaccatcctgcctaacaaggtgaaaccccatctctactaaaaaaaatacaaaaaattagccaggcttggtggcacacacctgtagtcccagctagtcgggaggctgaggcaagagaatcgcttgaacctgggaggcggaggttgcagtgagctaagatggcaccactgcactccagcctggacgacagagagagactctgtctcaaaaaaaaaaaaaaagagagatgaggtctcgctacattgccccagctggtctcgaactcctgaggctcaggcaatctgcccgtctcagcctcccaaagtgctgggattacaggcgtgagctactacacctggctgttttttaggttttgatatgaggatttttccagcctcataaaataagctgaaaacatcccttgttttcctatactttggaaaagtttgaatgatattggaataatctgtactatgaaagtttgtcagaacaggccgggcacagtggctcacgcctgtaatcccagcactgtgggaggctgaggcgggcggatcacctgaggtcaggagttcgagaccagcctgaccaacatgaagaaaccccgtctctactaaaaatacaaaattagctgggtgtggtggcacacgcctataatcccagctactcttgaggctgaggcaggagaatcacttgaaccctggaggtggaggttgcagtgagccaagatcgcgccattgcactctagcctgggtaacaagagcaaaactctgtctcagaaaaaaaaaaaaagaaaaacaaagaaaatttgtcagaacaaaacaaaacttttaaaccattgggtctgttggattcttttggtggaactttcttttttttagagtttttcaatgtattttggggggtggaactttctttttttttagagtttttcaatgtatttttatgattattgatctatttaatttcttttccttcttttttagtagatctaataatttatctcattataaagttgtttgattttccattcctcccagaccagggatttgttttgtctcaggtctcacctgggccgcagtggctgcagtctgtagaaggcgtgattcttcccacaggcaccgggccacaatccgggcaatctccattggcttctcaagatacctgctctataagtaggagagaaagagaataaaaatcagcagcagaccatggagatgtggactgaactgtggcaccttaaaactaatgtattcatcaaggaaagcatttattctaggaaacaacggaacaaaggcttcagagcctgggtgaaggctctctgtcggcggggggcgaaggggaggtcgttactatttctgtaacagaaggcacattagcctgagtcttttttttttttttttgagactggctctcactctgtccgccaggctggagtgcagtggcgcaatcacggcttattgcagcttcgacctcccaggctcaaacaattttctcacctcagccttctgagtagctgggactacaggtgcatgccaccacaatcagctagtttttaaaaaaaatttctgtagagatggtgtcttgttatgttgcccaagctggtctcaaaactcccaggctcaagcaatcctcccacctcaacctcctaaggtgttgggattacaggcgtgagccaccatgcctggccttgtctgagtctttacacagtatactatcctggtcttgcagggaagctactgacttagtcaagaagtatcccattatggtcaaacatttaacatgtaacagtgagagtcatcttcctatcagtggaccgcgttaacatgctaacatgtatgattaacataacaatcactttattacttcaactgtgacaagagaagtgattctcaggtaatgatgctcacgggtaagtatacagagctttgagaaagggctaattacttctcctgtgattgaaaatacaagatagattctcgttacttagccaaatgagaaaagagatgcttccaggaaagaacactaacacccgactctgcgggtcctgtttctccttgtcctcagtttctcatcatacctgaagaaactgcttgattcttcgtagattgtgctgatagagaacattcgactcttgcaggaagcggctatactgctggtcaatctctcccaggagattatgaaacaccaaagtggcatgtgattctttgctggccgcatatgccctaggaaaaggaagaatgataaagaatggctctgaagccgacgcatacacacaaacacagaaatcaccatcaagaaagaggaaaaaaacaaaaaaacaaagcaaacctgatgctataacccattcatcatgttagattcttcttgctcagcaataaaatgccatcaatgtaataattattaacaattattccaggccaggcatggtggctcatgcctgtaatcccagcactttgggaggctgaggcaggcggatcacctgaggtcaggagttccagaccaacctggccaacatggtgaaacgctgtctctactaaaaataaaaaattagccaggtgtggtggtgggcacctgtaatcccagctactcgggaggctgaggcgggagaatcgcttgaatccaagaggcagaggtgcagtgagccgagactgtaccactgcactccagcctgggctacagccagactccatctcaaaaaaaaaaaaaaaaaaaccacaaaacaaaaaaacaattattccagatattattacccactctcataatctgttgtatttgtaaaatatttgagcaaagtagacagatatgctgttttgctttaaaccctcaattaactctggtcagatttattagtacaaataagtaatcccaggctgggatggcctatctccaacatctgtgaatcacctcctggcccttcaccaaatcagagtatgcattctggaaaaaccaggtcatattaacactggcctgaattaaaccaaaatcagtagtgagcctgagcatattaaagtgaagaaaatagttgctggacatctgtgccattatctgctctatgaatggaatctacttcccttatcctgtgatctagtttggatctacatccctgcccaaatctcatactgaaatgtaacccccactgtttgaggtggggcctggtggaaggtgactggatcatgggggtgggtttctcatgaatggtttaataccatccctgttgatactgtcctcgagacagtgagttcttgtgagatctgatagtttaaaagtgtgtggcacctcccccttgctctcttgctcttgctgtggccatgtgacctgcctgctccctctctgccttccgccatgattggaagcttgctgaggcctccccagcagcagatgctgctatgcttcctatatagcctgcagaactatgagccgattaaacctcttttcttataaattacccagtctcaggtatttctttatagcaaattgagaacagactaatacacccctgtggctccttcctttaactaaaggggaattacaagtatcaacccaaagttctagctatgacagaattcacattcagagaaaaaatatgtctaccacatcactggattatcagaatatatagaggatctgcccaagtaaatgaggtccaaatcaaccttcaagacatccaccaccatacaggcggtttcaatgtgtcaaagacagttgcccacatgcccttctaagataaaaaaggctttacaagaccaaagggtgcccctttatctcctgatctcattttccccatcacctgtacccatacattttttaatggaacagcaaggcatgacattaagagttcatgtctcttgactcaaactgaaacctaacaatttggagagtcacttaagaaggacttaccaatcttgactctcaatccaaggggccagaaactgccgcagctccattgggaagctgtcactgtagagctgatggagctgctccaggtaccgtgtgtcaagctgctgtagctgattccattgggccatcctgctaaaatcaggggtcccaactgtaaaccaaagtgtgcatatgttcaccacaagtcccagtaggggtaaacaatctagaagtagccattgcccaacacaggtgtcaggtctgtgactagggataaagatgctctggggaggaccctgcttctttctcccagtttattttatttttaaaaaatagagatggggtctctattttttgcctgttgcccagggtggccttgaactcctggactcaagtgatcctcccaccttggcctcccaaagtgctgagattacaggcataagccaacacacccagcctgtttctcccagtttagaacaatacaaacacattcacaatccccaccttgggataatcacagctcctttttattattttttgaagacagagtcttgctctgtggcccaggctagagtgcaatggcatgatcatgggctcaagagatcctcccacctcagcctcccgaggagctgggactataggcacacaacaccatgccacactcattttttaaaaaatgtttcgtgagacaaacaaaacatgcccaggctggtcttgaactcctgggctcaagtcatcctcctgcctcggcttcccaaagtgctgggattacatatgtgagccaccccatctggccacacatctcttttacactgggatgacaagtggctattatgccaggttctagaatccattatctaccagaagtgtgtgaaattaaaaaattacttaactcccagatttctattcccttgtctataaaatagagataataattcccactcctcagaggtattgagatattcctacagcatccagctcagtgcatggcacataacagatgcccaacaaatgtcggttcctttctttctcctccacagcccttttagttatacacagtaaacctgtactgtagccaaaatgtagaaattggatgtttggggttgggggacagagcactaattccaagactacaggtttaaaagtataaatgaggatccaggaagatctgcctgagattctcctactcaacaaataataactattttaaaaattgcttagtctgggacaacagagaaggaaagaaaaatgccaggcataaaagttgtcccaggttcaggaacatcccagtgaaatgctctggtatgagaaacccagccagctaattacctgtaatcctctttctgaatagcatgggtcatggaaatatcaatagaggccaagttgttttaacaagttctaaaattaggccaggcgcagtggcttacgcctgtaatcccagcactttgggaggccaaggcgggcagatcacctgaggtcgggagtttgagaccagcctgaccaacttggagaaaccctgtctctactaaaaacacaaaattagccaggcgtggtggcacatgcctgtaattacagctactcaagaggttgaggcaggagaattgcttgaacctggaaggcagaggttgaggtgagctgagatcgtgccactgcattccagtctggcaactagagcaaaactctgtctccaaaaaaaaaaaaagagaagttctaaaaataattacaagtcagagccaaagatgaaggtatgtacagaccaaggtccaatgagatggttctctgggatagtgagaacatttaatgagagactgaacacacgcaaacatactagagttcttgattctcagagaaggcacgaagaagcacctagttagcactggctttttcataaaaatgactgagcaaactggcaacaaaaccagcaggtcttctgttctcaaggcagcaaatgtaacggaatgaaaggtgcgatcgtggaacctctaactcctgcaacctctaactcctgggctcaggcaatcctcctacctcagcctcccaagcagctgggagtacaggcagcattgctgcacctggctaatttttttaaaaaaatttttgtagagatagggtcttcactgtgttgcccaggctggtctcgaactcctgggcttaagcaatcctcctgcctcaacctcccaaagtgctgggattacaggcgtaagctaccacgcctggcctgggatcaggttttctgacagaacctgagagggctgcacttctccctccctctttgggggacagactcagaatacccctcttgctactgtgaagacggctggtggagctctcaagcatatattcagggaagtgcaggtagtacctcccagcagtctttacattgaataattaataatctaaggcagcagcatccaacagaaatagaatacaggccacacatgcattttaaattttctggtagccatacttaaaaagttaaaagaggctgggtgcagtggctcacgcctgtaatcccagaactttgggaggccaaggcaggcggatcatgaggtcaggagatcgagaccatcctggccaatatggtgaaaccccgtctctactaaaaatacaaaaattagctgggtgtggtggcacatgcctttaatcccagctactagggaggctgaggcagaagaatcgcttgaacccaggaggaggaggttgcagtgagccgagatcgtgccactgcactccagcctgatgacatagcgagactccatctcaaaaaaaaaaaaaaaaaagaaaagaaaagaaacaggtgaaattaattttaatgtattttatttcatttaatatatccaaaatgttattgcaacatatgaacatacaaaacatattattatttatttatttattttttggagacaggcactctgtcacccaggctggagtgcagtggttcaatcacagctcactgtagcctcaacttcccagctcaaacgatcctcccacctcagcctctcaagtaactgggactacagatgcgcaccacatctggctgattatttttgtagagacggggtcctactgtgttgcccaggctggtctcaaactcctagactcatgcatctcagcctcccaatgtgccaagagtataggcttgagccaccgtgtccagcccacaaaaactattaatgagatactttacactcttttttttgctacgaagttttctaaatctcctgtgtactttacatgtgcagcacagctccaaggtattttccctcctcatgtatcaagggcttaaattccactggtgaaaaagctcagtaaagcaaatagagagaatgtcagaataaggtatttgccccaattaggccaatacgcttctataaattaactaaatattccaacaatgttattttgttgttattgtttttgagatggaatcgcctaggctggagtgcagtggtgcaatctcacctcactgcaacttcagtctcccgggttcaagcgattttcctgcctcagcctcccaagtagctgggattataggcacgcaccaccatgcccagctaatttttttttttgtattttttagtagacagggttttaccatgttgcctaggctggtcttgaactcttatcagttcaagaccagtctggccaacacagtgagatcctgcttataattaattaatttaaaaatgtaggctgggcacggtggctcacacctgtaatcccagaactttgggaggccgaggcgggtggatcacgaggtcaggagttcgagaccagcctggccaacatagtgaaaccccgtctctactaaaaatacaaaaattagccgagcatggtggtggccgtctgtaatcccagctactcaggaggctgaggcaggagaatcacttgaacccgggaggtggaggttgtagtgagccgagatcgcaccactgcactccagcctgggcaatacagcaagactccctctcaaaaaaaagcaatgttacttgccaccttccaccctaagattcacctgccacaggacaaatgctgcctgggcagtggtacaggtacactaagcactagccagagtaaaagcagtggctgacgtgcatactatatgctgaagcattgtaaccatggcatgtattgattgccctctgtaagaaatcaaaggccattagatctctcttacaatatttgcattagggccaagttaaaatctgcctcacatggaggttgcagtgagccaagattgtgcatctacactccagcctgggtgaccaagtgagactctgtctcaaaaaaaaaaaaaaaaaaatctgcctcatagactaaaagcatcatgacctgacttatgctatgcaagaactgatgtgcatacaaagaaatctgcataatatgccaatttatgtagattctattgcatacaaatttactgaaactctaaacctacacagtccagtatggagtcactagccacatgtggctactgagcacttgaaatgtggctgcttcaaactgaactatgctgtcaatataaaatacacactggattttgaggacttagtgaaaaacaaaagaatgtaaagtatcttgttcatgttgaaatgataatattttagatatattgggttaaataaaatatattattaaaattaacttcacccatttctttttacttcttttaatatggctactagaaaacttaacattggtagggcatggtggctcatgcctgtaatcccagcacttagggaggccaaagcatgtggatcacccgaggtcaggagtttgagaccagactggccaacatggcaaagctccatctctactaaaaatacaaaaattagctgggtatggtggcacatgcctgtagtcccagctactcgggaggctgaggcaggagaattgcttgaacccgggaggcggaggttgcagtgggccgagatcgtgccactgcactccagcctgggcaacagagtgagactgcatatcaaaaaaaaaaaaaagaaagaaagaaagaaagaagagaaaagaaaagaaaagaaaaagaaactaaaagaaaacttaacattacatatgtgacttggatcttatttttattgaacactgctactctagacaatgtagccaaaaagcggtggttctcctaaaaaaaaatgatttaaaaaaagaaccaactgctttttgtaataaactccagtgtttaaaattaattttaaaaacagactttattttttgagacagggtctctctctgtcacccaggctggagtgcagtggcaaatatagatcactgtaacctccaactcctgggctcaagcaatcctcctaactcagggacctgagtagctgggactaggggcacaagccacaatgttcagctaattttttgtagtttttgtagagacaaggtctcattttgttgcccagactgatcttgaactcctggcctcaagcgatcctcccacctcagcctcccaaagtgctgggactgcaggcatgaggcatcatgcccagccaaaaatagactatttaattatttgtcttggatacaaatgcagaggcatcacagtctactccctgaaggtccaaattaaatcatgaaacagcatcccactatacctgctccatcatagattaacactggggtcatgcatgaatatttgcattttcaaactaacatatcctaaaaacgtgtaagttattgaaaattatctaattcatttccagtacataactaaggattttttggttgttgctgttcttatttttagctggggacagaggagggctagtaagtagtacaataattgtgttcttttttttttttttttttttgagatgaaatactgtcacccgggctggtgtgcagtggggcgatcttggctcactgcagcctccacctcccaggttcaagcgattctcctgcctcagcctcccgagtagctgggactacaggcatgccccaccacgcccggctaatttttgtatttttagtagagacggggtttcactatgttggccaggctggtctcaaactcctgacctcgtgatccgcccgcctcggcctcccaaactgctgggagtacaagcgcaagtcatggcacccggcctgtgttatttcttaaaacagaaaccagctagtagttttttccataaaattaaagcaccaggctgggcacagtggctaacacctataatcccagcactttgggaggctgaggtgggcggatcacaaggtcaggagtttgagaccagcctagccaatatagtgaaaccctgtctctactaaaaattcaaaaattagccaggcgtggtggtgggcgcctgtagtctcagctacttgggaggctgaggcaggagaatcgcttgaacctgggaggcagaggttgcagtgagccaagatcgtgccattgcactccagcctgggcaacagagtgagactctgtctcaaaaaaaaaaaaaagaaggcaccagggcaccaacaatgactgatttcatgttttacttcttagtctaatcaccataggtaatactttaatagttattctacaggggaaaataaaagtataacttaaagccaaagaccaggtagtattttcaaggagagaatatgcaaatacttccatagtcttctccttacaggctgcttagctacaaaccatatttaattaacagcagtcacaggagatgactagccaaagtgtctaggaaaatcactgccaagcagctttactgtaactgttttactggaaaagacctcaaagagcccatgttatttcacaatttcaattttggtttttcaaattacaagttaatctaaagaactccactaagttctaactacattacttcatatctacggaataattctaagcctgtgggtttttaaaaaaattttattagacattctagaattgggcaacacttcattcaatgccataggatgaatgttctccccaagcctgtgacttaataactacttcattgagccccagaacacacaaagttatctgaggaacaacttgagtgccaactaccactctgggtgcataagagagaagacaattcattactccatataggctgccttaggacattatatggggctcaattcaaagcatttactcaggttaagtcagcagatagtagatgcactgtacaaaggcaaggtgggtgtaatcctgttttctataactgaagagaaaagaaaaaaatgaaacagcaagtcatcaaagactttttggacttttcaaaacaggaatttctcagtcccttggggataacctaccaacagcaagtcataaaacaaataactattgtctaattgggaacttattaccgtaaagatgactgaaaaagtctgtccaaagttacagttctcatttatatacttgaatctaatgaaaccaaaagatatattgagaaacgcagtcaagaccacttacaaaagggatttactacacagcttcataaaactttttaaagttaagacttgtacttcacatccatgcactagtggatttacaacgagggtgagggaaggcggaaagagagacgaaaatcaggctcatacaataatccagaacagaaagtgatctaaagataacttctgttccactttgcaatgtgtcatgacattttcctttgggtaccacctatacttttattataaatacatgcattttaaatagagcatacctgtgttttatctgctgcctacactaacctcttctttgctgtcaggaaaggcccagtgatcaaggcaaccaaagtataaagaaacacagaagatttcttgcactgaattctataggaaccagtccttttaagagatatgtttgaaagattataaaataatgttcaatgtggaaaatttagaaaaatataaaaaagaaaataaaagataaaaacatccatatcccaccatcccactatgcagaacaaaaactgacatgttgccaggtgtggtggtctgtgaccccagcactttgggaggctgaggggggaggatcacttgaggccaggaagtcaaggctgcagtgagctgtgattgcaccactgtactccagcttgggtgacacagcgagaccctgtctccgaaaaaataaaaattgacatgttgatgtaattcctttaaatctatttcagaatgtgtttgtgtgtgtgtatatatatatatatatttttttttttttacattggagtcatagcattaatacagctgcatattcttttaaagtttattgtgtagtaaacatttttctatgaaaagagtattgtgtttgtttgtttgtttgttcaaatagagaccagctgcccaagctggtctcaaactcctggtctcaagcgaccctcctgttttggcctcccaaagtgctgggattacaggcgtgagccacagtacctggcctgaaaagagatgttttgttattgttgttgttgttgtttgagacagaatctcactctgttgcccaggctagagtgcagtggcaccatctcagctcactgcaacctccatctcctgagttcaagtgattctcatgcctcagcctctggagtagctgggattacaggcatgcgccatcatacccggctaatttttgtatttttagtagagacggcgcttcaccatgttggccaggcttgtcttaaactcctgacctgaggtgatctgcctgcctcagcctcccagggtgctgggattacaggtgtgagccactgcgcctggcctgaaaagaaatttttatttaaagcgcataaaagaactattttgtttctattggtgttttcaatacaaccctgctaatcccactgagggccacataatttattaagatttggaaaccccaatttatttgttctcaccataccacgttctaaaaataatctgaagtatctgcaagtagattaggaaggaaaaaaatgagaaaagtaagagaaagcaattcacgctagagaaaaacattcaatcttcataaaattttcaccacaggataaacagcataatggatgacagagagtccacattaaaatactgtaggccaggtgtggtggctcatgcttgtaatccttgggaggctgaggagggtaggtcacctgaggtcaggagttcgagaccagccaggctaacatggcaaaagcctgtctctactaaaaatacaaaaattagccaggcatggtgaaatacacctgtaatcccagccacttgggaggctgaggcaggagaatcacttgaacccgcgaggcagaggttgcagtgaaccaagatggtgccactacactccagcctgggcgacaagagcgaaactccatctcaaaaaataaattaaataaataaataaataaatactgtagctttaaactattagagtcattcataatttaaccattcataattactctagacattaagaatggaatttcaagtttaaaacataactcaaaataagtacacttatatagtaagcacacaatttcatagttttaagtccaaatagtacctttgtaagatttaagactagatacttgcaataagaagtctatatataaatctagttttgatttcctaaagagacaaaatattaacacttgagtgcccaatctgaaacaaattactataattactgtaatgttcaattacatataacaggatttgctttaaaattaaaaaccaatgacgatcaagcttgtaaaaatgaacatcaatctataagaaaacttgagttatagttccctactaatatgacaaaatttgaatatatgaaagaagtaaaggccaggcatggtggctcatgcctataattctagcactttgagaggccaaggtggaagagggattgcttgagctcaggagttcaagaccagcctgggcaacaccgtgagaccttgcctctacaaaaaaatttttttaaaattagcctagcatggtggcccatgcttgtagtcccatggaggctgaggcaggaggatcacttgagcagattgagactgcagtgagctgtgatcataccactgcgctccagcctgggtgacagagctagaccccatctctaaagaaggagcaagagcttaacaaacctaattccctctaaattaaaagtaacaaacatgatttgtcaattactgagtgcacagttgattgttaaagctgcctaagaacaggtctgagctctacaaaaactaaaactaaaacaagaaaacccacaaaacagaccaaatttgtgcatcagatgacctccccacttgggaacacttccacttccccaaccagacacattcctctgtatcagtgtggtgtgggggaaaggacagtagagacgggagctggatgggcctgggtgcaaaaccctgcctgacatttattagctatttgtctttgggaatggtatttcactaccaaatgggctttctcttcagtaaaacagggaactctctctcctttgaagaactgttgtaaagttaaaatcaataatggttgtacagcatccctctgtgctggtgctgctggtgccagatcctcagagctgcagttattgttcctttcccccagggtctccctttcatggacatttcttactttttttttttttttttttgagatgtagtctcactctgttgcccaggctggaatgcggtgggcacaatctcagctcactgcaagctctgcctcctgggttcacaccattctcttgcctcagcctcccgagtagctgggactccaggcgcccgccaccacacccggctaattttttgtatttttagtaaagagggggtttcatcgtgttagccaggatgatctcaatcacctgacctcgtgatctgcccacctcggcctcccaaagtgctgggattacaggcgtaaagccaccgcacccagccagatatttcttatcttaaacccatttccttagtgtcctggaaagcaggttaatccatcagattcactaggggttaagtgtgataatcactaatcagctttccctgctaagtaaaatacatgcatttcaatgcacactcttatcatatcgggagggaaggagtcagtgatgctgtgatttggcatgttaatttaaggagagaagggaggtcaggagagctgggtggtgacctgatcaaatatctccatacgtatttcacctaggatggctctaggtcctaaaaagagtaaaaggtgaaaacactaagtgatattcaaaacaaaagaaaaagatgaaaaataagaaccttggttaaagagcagtcgaaataagtaatgattatagctatgatttatatagcactttttacaagaagccaggcgctgttttaaacacttgacatacttatttgctcatttcataattgtaacaaccctatcagataggtactatttttatcccactttacagaggagaaactgaggcacagaattttaagtgatttggccgggtgcggtggctcacgcctgtaatcccaacactttgagaggctgaggcgggtggatcacgaggacaggagatcgagaccatcctggctaacacggtgaaaccccgtctctactaaaaatacaaaaaattagccaggtgtagtggcgggcacctgcagtcccagctacttgggaggctgaggcaggagaatggtgtgaacctgggaggcagagcttgcagtgagccgagatcgcgccactgcactccagcctgggcggcagagcaagactccgtctcaaaaaaaaaaaaaaaaaaaaaagatttttaagtgatttatccaaagtcacaacacaggtagtaaaggcatggagctggaatcataacgcacagtctgttttcggaatgtctgttcttcaccactataggagtcttgttttttcttttttttaaattagagatggcgtctggccatcttgcccaggctggtctcgaactcctaggctcaagcgatcctccagcctcagcctccaaaagtgctgggattacagatgtgacccaccgtacccagctactacaggagtattagaaagtgggaattttggccaggctcagtggctcacgcctgtaatcccagcactttgggaggctgaggcaggtggatcacctgaggtcgggagttcgagaccagcctgaccaacatggaaaaacctcatctctactaaaaatacagaattagctggccatggtggcacatgcctgtaatcccagctactcaggaggctaaggcaggggaattgcttgaacctgggaggcagaggtggcagtgagccaagattgtgtcattgcattccagcctaggcaacaagagcaaaactccatctcaaaaaaaaaaaaagaattttagttgatttttaagtaacccacaaaccaaccattgtaactagccaatgtgatcttatggtattttaatagacatactagtacttggattttgaaggatctagtagtctagctgtaacagacccacatctggatgctattctaattctgtgtatcaaaattgaaatggaacactaaaacaaccaaacacatccagggagggacaaccagggtgtgaggagttgaagaccttgaatattttgctcagcaagaagatgcaggcaacaggagtgaggttaggagagaaaaacatgaattacagaagagtggcccctcaaatacctggaaatctgtacgagaaaggataaatcactctaggactagaacctgtctcctcacaacatcttctcccaaattcttccccatgaagtaatacagaggtctccaccctggctgacactaaaaaatatatacagcaagaaagatgcctgggaaccaaaccagtgccaaattggaacctctgacagtgggaccaggtttcaaatttcgaaagctacggctgggcacggtggctcacacctgtaatcccagcactctggggggcctaggtgggtggatcagctgacgtcaggagttcaaaaccagcctgaccaacactgtgaaagcccacctctactaaaaaatacaaaaacattagcaggcatggtggtggatgcctgtaatttcagctacttgggaggctgaggcaggagaatctcttgaacccgggaggcggaggttgcagtgagctgagatcacgccattgcactccagcctgggcaacaagagcaaaactctgtcaaaaaaaaaaaaaaattcctcagatgatgctaaagtgaggccaaagaataataataaattttttcgtgatcattaataaatataacgagaacctcgaaatcagagcagagatcagggctcaactctgaatacgcctcagaatctcctgaggagctctacaaagccaggtgccagttcttagcccagaactagcaaataataatctccagggttctaatgaagcagtacactgtagagactgtacaaggagaccacggcagaagaggaggctggagaaggctctcctgtcaagatatctgcactttcttccaagggcaatggggtaagtctttgaaaagctttaaacagacaagtgatagtttgatttacatttcaaaaagatccctcaggctgcaataatcctggtgggaggtcgtggctgcccaatttaggtagcagcattgtaagtgttttgaggcagacatccatcttctgtgacattacagagctacatgtgatgggacttggtgactgactgaagggcaaaggtgactcagagaaagggaggagtaagtgacaacctcccaggttcctgtggcatttggtattcagatggcggtcacatgctcagcatggtaaatgtcatggcaggagtgccaacattgagagggcaattgggccacacagtctctaaaaactgtttgttctataaattactgtcaagctcgattccctcaagacattacagccacagcaactcaaaataatactgtaggaaaagcaagtagatatttaaccaaaaagggttcagggtttgtactccagctgaatggtaaaacctgccatcccctcaggaaaagaggcagaggcaagagaaaaatcaggcagaaacatcagagccaaaatgcatagggggccatggcaagagctgttaactgtctcccaacatctgtgtgcttgcctccaggccattttccacactgtgggtagagagaccttttcaagacacaaacttgatcttgccacacccctacttaaaaccctcctgatgactgctctgttcttaggctaaaaaacaagatttgttatcttaaggcagaatagcatggatttgaatcctggttccaccacttcgatcacttagcgtgtagctggtgccagttatttatcctctttgtgccttaatttcctcatctatagaaaggggagagaacagtgcttacctcacagggttgctgtacaaattcatcgagctaatgaacacgtagcactcaggagcccaatagcgtgcagcatgtaagtgtttgtactcattactagcatgaccgacatcctggctggctctgcccctctcgtatggctggtaccagctggtggctaagttcctggcactcactctgctccttcttcaggtcctcaaaaacaccaggctcctgcctgccactggccctcacacatgccttccttctatcaccatcaccatgacttgcacccaagtactgtgactccattaacttggactcataaccactatgctggactgaaagccccatgaagacaagaagagtcttggcttttgctcactagcgtgtcctaccctgaaccctggcatccagcatagtgtctggctcataataggtgctgaaaaaataggtattgaatgaatgaacgactggagtgaattacaactaaagtgtgtagccaggttctcccaagtgaggacactgcgcccaattagaaaatattctgaggaataggccaactcttccagttttgctgtttgaaaaattcaagaatgatcaagaatcactgattcaagaataatccttcagtgattcttcaataagagtaaaatcacagcactccccagctcaaaaacacacactaacatctcattgtccaatgcaaaatctttacccttatctcaggctctgtaactactcagccaactttagccccttccagttcctctctccagcctacagatgactttcattttttgagacagggtcttgctctgttacccaggctggagtgcaataatacgatcacagctcactgcagcctcaacctcctgggctcaagcaaccctcccacctcagcctcctgagtaactgggattacaggcacatgccaccatgtctggataattttcttttttttttttttttggtagagactcagtctcaccatgttgcccaggatggtctcgaactcctgggctcaagttgtcctcctacctcggcctcccaaagtgctgcgattataggcatgagccatggcacccagcctccaggtgactttcataagtgttgtcttccttcaagtcaacttatctcctccttgccccccacccacagactttgttcctttttcatatttgttcttgcctaaaatgcttttttctctgggtggcgttatccatccctttcttgtgtctgtcagacaggctctccctaaccccacccctagtccaatgactgctttcactctgaatccccacggtacatatataagcatctgaggctctttcctattggctttgattctacctccttcacttgaggagcagctctctgctggcaaccacgtaccatcctgatttagaacttcccacaggctaacttaagacaccaaataaacacttgcacacacacataaccaccacctcccattacagaagtacacctcccctactgaacagatgatggccacgatactgaaaagcatggcatcaacatgacaactgcatcctgaaagatcagcctatatataggtttggttatcttgaatttcgagtttggagagaagcaaagtatttttctaataaactgtgaatgctgaggaattcaccttcataggagtcagaaacaggctgccaaacttttcaaaagaaaaacagtggtaggttgagcaagcacattgtcatgtcagattttccaggctcgagggccactgaagggagaagagcgagtagctggaaaaaacctgtgggtactgttatctttggccaaagctcaaataaaagaatcacaaaaacatccactgatctaaaatgctatgtaagtcattaatattcatctaagagaggcaactgaaataaagcagataaagagaacttaagccattctcttacctcagcctcccaagtagctgggattacaggtgcccgccaccacacctggctaatttttgtatttttcgtagagatggagtttcaccattttggccaggttggtctcaaactcctgacctcaagtgatctgcctgccttggcctcccaaagtgttggggttacaggcgtgagccactgcgcctggccaagaatttaaatttctgagtctcaaagtcataaacctataatatggctcaatgcttacctcagtgcttactggagagaaggaagattcttttctcaaatttattcaggtcactttccctatacgaaatactaaggtagtcctggtcacttacatggaacaatatacctggggctgacgatgcttggatatatagaagtccttcagtcaaaggaactatgaacttttgaggcagaacctcaaattcagaaggcatttgtggtggttggataacatggccctaaattctctcattatgccccactctctgagaggagggggtctttgttcccttcctttgaatctagctaagtccataactgttccaaccaatagagcatgctgaaagcggcgagatgtcatttccacctgatttcattggaagtctcattctccagaaccagccacattctgtgagaaacccaaggcaaaaggggaggccacaagtaggcacgtggtctacagtctcagctgaaatcagcctttgagtcatcgcagcccagacatcagatacaggagtaaagaaaattccagatgattattacccccagccgcttgagttttctcagtgagacctcagacatcgcagagcaaagacaagccatccctgctgttatctaaattcctgcccacggcatcttcgaacatagtcaaatgattgctgctttaggccactaagtctgagctggtttattgcattcggcaactagaacaacatttttactaacatagtgattgaatgtagacttaataatgaaagagtccaacttccataagaaaaaaattcataattttaaaggaagaggctttgctgttaaagttttttttttttgtttttttttgtttttttttttgagacggagtcttgctctgttgcccaggatggagtgcagtggcgtgatcttggctcactgcaacctccacctcccgggttgaagtgattctcctgcctcaacctcccaagtagctgggactacaggtgcccggtacaacgcctggctaatttttgtattttcagtagagacagggtttcaccatattggccaggctggtctcaaactcctgaccttttgatctgcccaccccagcctcccaaagtgctgggattacaggcatgagccaccgtgcccggcctgttaaagctattttaatagtaaacttattttctctatgcactcctttctaaattattcagccccactttctttcaaaacaacgtttatacactgacaattctcaaatttatgtctctagccccatccgctaatatgaacatcagacacttatagccaactgcctcttcaatatctccacctggatgtctaaaatgcatgtcaaacttaatgtatccaaagccaaccccttcattaaaaacctctcccagccggcttctcctccagtctcccccattctagcaagtgacaactccattcctgcacatgttgaggctaaaaaccttgaaatgagccttaacttcaactccagtctctctctctcttcctccccctcctcctgccacacctaatccattaacaaatcctgttggctctgtcttcaaaatctggaagtgaccgggcacaatggctcaggcctataatcccagcactttaggaggctgaggcgggtggatcacttgagctcaggagtttgagaccagcctaggcaacatggcaaaaccctgtctctacgaaatatacaaaaattagccggatatagtggcgcaagcctgtgatcccagctacttgggaggctgaggtgggggtatcacttgagcccaggaggcggaggttgtagtaagctgagattgcaccactgcactccagcctgggagacagagtaagatcctgtctcaaaaaaaaaaaaaaaaaaaaaaaaggaaggtgagcctttctcacaacctcccactgacgcagccttaatccaggccaccagcatctcttacctagatagctggactaggctaactggcctggatgctttcatccttgtccctctaccttctattctccacattacagatcctttcaaaataagagtcctggctggcacggtggctcaaacctgtcatcccagcactttgggaggccaaggcgagcagataaattaaggtcaggagttcgagaccagcctggccaacaaggtgaaatcccgtttctactaaaaatacaaaaattagccaggtgtagtggcaggcgcctgtaatctcagctactcgggaggctgaggcaggagaagttgcttgaaccggggaggcagaggttgcagtgagctgagatcgcgccactgcactccagcctgggtgacacagcgagactccgtctcaaaaaacataaacataaaaataaataaaaaataaaaataaaaacagaaattcgccggcatggtggcccaagcctgtaatcctagctactcgggaggctgaggcaggagcatagcttgaacccaggaagtagatgttgcaatgagccgagattgcgccactgcacttcagcctcggcaacagagcaagattttgtctccaaaaaaaaaaaaaaccagagtcagatcatttcattcccctgctcaaaacccactcaggaaaaaatccaaagtcctaccacggcccaccagtcaatccattttgccccagatgtctctctttgcctccttccctacaactctccccttgctcacagctgtcccctctctgctcctggaacacaccttgcccgtttctgccctaggactcttctctccacctgataggctctttccctagatatctccatggcttgctccctcacttcgttcaggtctctgcacaatgtctcttgacacccctctatctaaaacagcaacatctcccctgctgaattctcctttacagtactcatcgccctccattgttcatatatttcttttttcatgtatctccttccaatatgatcaactaggaacttaagccccataagaacaaagacattcttcagttcactgctatttccccagcaactacagaatgctcaaatatttgaataaatgaatgaaaattaagtaagtttttcaaaaatctagaacacacttttagcatagagaaaactgaagtaccataggaggttaattcacttcatataacagcataaactgcccttccttaagtaggagacaataggtacaataatgcatgcaaatgttaagtggtaaagcaaacatacaaagtttcccaatagaagagtttaaattaaaatctaaacttccagccaggagcagtagtggacgtctagtcccagctactcaggaggctgaagcaggaagatcacttgagcccaggaattcaaggccagcctgggtaacataggaagaccccatctctaaaaacataaaaataaaaatctaagcctcaaaagaaaaaaaataaataaacaaaaggcatttcctataaagttaaactgttacagaattgtttttcttaaactgcaataatgagactttagcactctcttgtcctctaaaagacattatttcatgacatgtgcccattggcagtatttgagaatctaagaaagtagatcacactaaatattgatatgcagacactaaaatcgtacaaccacttggatgactaggtttgagatattcccaaagtgacaggtttttgttttgttttgttttgttttttgagacaaggtctcgccctgtcgcccaggctggaatgcagtggtgcaatctcagctcactgcaacctctgcctcctgagttcaagcaattctcctgcctcagcctccctggtagctgggactgcaggcatgcaccaccacacctggctaatttttgaatttttagtagagacagggtttctccacgttagccaagctggtctcgaattcctggcctcaagtgctctgcctgcctcagcctcccaatgcaaccagcctttttttttttttttaacttttattttaggtttggggttacacgtgcaagtttgttatataggtaaactcatgtcagaggggtttgttgtacagcttattttgataaaatattaagtattaagcccaatacccaatagttatcttttctgttcctctccctcctcccactctccaccctcaagtaaaccccagtatctgtggtttccttctttgtgttcacaagtccttatcatttagctcccacttataagtgagaacacgtggtcttcggttttctgttcctgcattactttgctaaggataatagcctccagctccatccatgttcctgcaaaaacatgatctcagccgagcacggtggctcacacgtaatcccggcactttgggaggccgaggtgggaggatcatgaggtcaggagttcaagaacagcctgcccaacacggtgaaaccccatctctactagaaatacaaaaattagccaggcatggtggagggcacctgtaatcccagctactcgggaggctgaggcagagaattgcttgaacctgggaggcggaggttgcagtgagctgaaatcgtgccacctgcattccagcctgggcaatagagcaagactccatctcaaaaacaaacaaacaaacaaacaaacaaaaacatgatctcgttgttttttatggctgcatagtattccacagtgtatgtaccacattttctttatccaatttgtcactgatgggcatttaggttgattccatgtctttgctattgtgaatagtgctgcaagtaaatctctttaaacagcaaatctattactgcctgcttttcaatgctttaccctcaagaaacttgggctacaactcaataacaaaaagcagcatttttgttcttgttgtttttaattcagtttcttttttttgttttgttttgtttctaagagacagggtctcactctgtggcccaggctggagtgcagtggcaggatcatagctcactataacctcgaactatcaaactcctgggcctaagtgatcctcccacctcagcctcctgagtagctaggactacaggtacatgctgccaaacccagctaattaaaaaatattttttttttggtgatgaggtctatgttgcccaggctggtctcaaattcctggactcaagcgatcctcctgcctcagcctcccaaaacattgggattatacagatgtaagtcactgcactttggccatgtgttggttttttgttgttgttttttgagacggagtcttgctctgtcgcccagactagagtgcggtggcgagatctcggttcactgtaacctccacctcctggttcaagcgattctcctgcctcgcctcccgagtagctgggattacaggcacccaccaccatgcccagctaactttagtatttttagtagagatggggtttcgccatgttcacctggcctcaagtgatccgcccaccttggcctcccaaagtgctaggattataggcatgagccaccacacccagccttttttttttttgagacagagtcttgctctgtcgtccaggctagagtacagtggcatgatctcggctcactgcaacctccgcctcccaggttcaagcgattctcctgcctcagcctcctgagtagctgggattacaggcgcctgccaccacacctggctaatttttgtatttttagcagagacggggtttcaccatattggccaggctggtctcgaattcctgacctcgggtgatctgcccatctcgggtgatctgcccgcctcggcctcccaaagtgctgggattacaggcgtgagccaccgcgcccagccatcttctcatttctttggtgagattgtttggtttttgcttctgaagattttcctgtttttctttttttgtttttttttttaagagacagaatcctgctctgtcacccaggctgaagtgcagtggcgcgatctcagctcgctgcaacctccgcctcccaagttcaagcatgcaccacctacaggtgtgcaccacaacacccagctaatttttttttttttttttagtagaggtggggtttcactacgtattggccaggctggtctggaactcctgacctcaggtgatccacccaccttggcctcccaaagttctgggattacaggcgtgagccaccacaccgggcctccctgttaagcccagtttatccagtatttctaggtgttttgtacaaaagagttttcagggcatttagcctaacataaagcagaaacaaaagtcaggatgagtcaagtaacagtatttgagaaaacttcagaggtagaaccaacaggatttgctgatgctttgaatgaaagcagagataagacagaacagggaatttaaggatgattcctagatttctggcttgcacaaaggagtagatggtggtctaccatttatttagatggggaagtcagacagggagagaggcacaaacttgcagagagaaaagtttaagagttatattttgggcaagtagacaggagacaactacaagttacttgagggaagatgtcaagtttgcagcaggatgcaggagctgggagcccagagcgactgggtggagggccacacttgctagtcatcacagcggctaacacgtcttcacagtaaaagccaaaacaggcggggcacggtggctcacacctgtaatctcagcactttgggaggctgaggcaggcggatcacctgagaacggggagttcaagaccagcctgaccaacatggagaaacctcgtctctaattaaaaaaaaaaaaaaaattagccaggcgtagtggcgggcgcctataatcccagctactcaggaggctgtggcaggagaatcgcttgaactcaggaggcggaggttgcagtgagccgagattgtgccactgcactccagcctggtcaacaggagcaaaactctgtctcaaaaaaaaaaaaaaaaaaattgaggccaggtgcggtggctcatgcctgtaatcctaacactttgggaagctgaggcaggtggattacctgagctcaggagttcaagaccagcctgggtaacacagtgaaaccccatctctactaaaatacaaaaaaattagcagaacatggtggcgtgcacctgtaatcccagctacttgggaggctgaggcaggagaatcacttgaaactgggaggcggaggctgcagtgagccgagattgcgccattgcactccagccagggcaacaagagtgaaactgtgaaactctgtctccaaaaaaaaccaattttaataggtataccattatacacccattaaaatggctaaaatccaaaacactgacaccactaaatgctggtgaagatgtggagtaacaggaactctcactcactgctgatgggaatgtataatggtacagtcactttgaatatagtttgatagcttcttacaaaactaaacatactcttaccatatgatctagcaattgcactccttgatatttatccagaggaggtgaaaagtcctgcactggaatgtttatagcagctttattcataactgctcaaacttggaagcaaccaagatgtctatccttcaggtgaatgtttgataaacaacatgtggtatatccatacaatagagtattactcaccaatgaaaagaaacaacctatcaagccacaaaaaaacatgaagaaacctgaaatgcatatcatttactgaaagaagccaatctgaaaaggctacacactgtatgtccaactatatgacattctggaaaagacaaaactatggagatattataaaagatcagtggttgccagtggttcagcagaggaatgaataggtggagcacagggggtttctagggcagtaaaactattttatataattgtgtactggcaaatatacatcatcacacatttgtcaaaatccatagaatgctcaacagagtgaaatgtaatgtaaactatggacttcaggctggacagagtggctcacacctgtaattccaacactttgggagactgaggcaggaggattgcttgagcccaggagtttcaggctatagcaagctatgatgatgccactgcaacctggcctggacaacacagtgagaccctacctctaaaaaataataataataaaataaaaatagaaataaaataaactcaggaatttggttaataataatgtatcgagttggttcattagttgtaagggacgtactatactaatgcaagatgttaataatagaagttgtgggagaaagtaaggggtatatggaaactctctgtactttccacataatttttctgtaaaactaacactgctttaaaaaataaagtctagactggccgcagtggctcacgcctgtaatcccagcactttgggaggccaaggcaggcggatcacgaggtcaagagatcgagacatcctggctaacatagtgaaaccctgtctctatcaaacatacaaaaaattagccaggcgtggtggcagacaactataatctcagctacttgggaggctgaggcaggagaatcacttgaacctgggaggcggaggttgcagtgagccgagatcatgccattgcactccagcctgggcaaaaagagtgaaactccatctcaaaaaaaagaaaagaaaagaaagaaaacacgtatctactaaaattacaaaaactagccgggtatggtggcaggcacctgtaatcctagctacttaggaggctgaggcaggagaatcacttgagcccgggaggtggagtttgcagtgagccaagatcacaccactgcactcagcctgggtgacagagcgagactctgcctcaaaaataaaataaaataaaaataataaagtctattaatttttaaaatatattaattgagccgggcgcggtggctcacgcttgtaatcccagcactttgggaggccgaggcgggtggatcacgaggtcaggagatcgagaccatcctaacacggtgaaaccccgtctctactaaaaatacaaaaaattagccgggcatcgtggcgggcgcctgtagtcccatctagtcaggaggctgaggcaggagaatggcatgaacctgggaggcagagcttgcagtgagccgagatcgcgccactacactccagcctgggcaacagagcgagactccgtctcaaaaaaaaaaaaaaaaaattaattgagctttatggttaagtttttaaaaagataaatctgacccataaagtttaaataatagtcaagatggaagatgagtgatctccccaaggagacaagcttttctatgaaaatcttatcaaaatgtataatgtacttagaaaactaagtgacctcattacacatcatagttttgcatgatgtaaccactcttcagagaatatctcattttgtccttcagctcccacacaagagaaggttaaggaaattccactactcatgaaattataatcccacaatgtaagtgaagtggtggctgtgcctaggaaagaaagagaatacacgcttagagagaatctagaaagaaacattatccagtttgtgttggggatagcccatgatctaaattctaaaaagcacacccatatagaacctagcctgggctgggtgcggtggctcatgcctgtaatcccagcactttgggagactgaagcaggtggatcacctgaggtcaggagtttgaaaccagtctgaccaacacagtgaaaccccgtctctactaaaaatacaaaaaaattagccaggcatggtggtgcatgcctgtaatcccagctactcgggagcctgaggcaggagaatcgcttgaacctgggaggcagaggttgcagtgagctgagatcgtgccattgcactccagcctgggcaataagagtgaaactccatctcaaaaaaaaaaaaaaaaaagaacccagtctgaagcatgaattcacattgcgttttccagtcaatcactcagccaaagagaacctgaggtggccaagataatgtaacaaccctatcaagtaggtgttattcccatttacagataaggacagaaatgttaagtgactacacatggatgcaaacttggaatcttcaaactcccaggctagtagccaaattacctgtttttaaatctcatctctgctatctgatctctgccaagcaaatttccctttgaatttgttatgcaaacaattaacgagaataaaggaaaatgagagctttatatacgttacatgtaataactggaagttaactttattaagacatctgaaataagtcaacacttttaaaacttaaaggctattctttaccagaatcgtctgtaggaattaaccccagcagtcagaaagtaccttaaaacaaaaccaacattaatctggtaatgtcatgacttcataaaatatccttaatattcaggtacgtgcataccaagaagagtaaacagaataaaaagaaatctctaaaacattttccctcattcactacatgtctactcttccacttacctttatctctaaaacaaaaacattttctaaaccctgtggacatgacttcactaatccaaagaagactttatattctatgggccttgtaaagccacatttctcaaactaaggaccaaggaccatctgaatcagaatatctgctatgcctgtgaggatgaccccagataaactacatcagaccctctcaggcagatccatagattctttcttctttttaagcaaataacccagggattcttatgttaaaacctttagaccaacctttctcaaactcttcgctctcatggcccctttatttattattttttaaatttaaaagaaataataagcaaaccgggtcaggtggctcaaaactgtaatcccagtactttgggaggctgaggcaggcagatctcctgaggttgggagttcgagaccagcctgaccaacatggagaaacccccatctctaataaaaatacaaaactagacgggtgtggtggcacatgcctgtaatcccagctactcgggaggcttaggcaagagaatcacttgaattcgggaggcggaggttgtggtgagccgagatcgcgccattgcactccagcctgggcaacaagagcgaaactccatctcaaaaaaaaaaaagaaaaagaaagaaagaaaagaaataatagagccgggcgcaatggctcacacctgtaatcccagcactttgggaggccaaggtgggcatatcatgaggtcaggagttcaagatcagcctggccaacatggtaaaaccctgtctctactaaaaatgcaaaaattagccaggtgtggctgctagcccctgtaatcccagctactcgggaggctgaggcaggagaattgctggaacctgggaggtggaggttgcagtgagccgagatcatgccactgcactccagcctgggtgacagagtgagactccgtctcaaaaaaaaaaagagaaagaatgattgataaaccaactgggatactggcagatattttctcaaaaatgaaagaagggaagctgtctgttcagggaaagcaactgacaatatttgttgccaatgataaaatttgagctttagagtaaaaatcagaatttgagaaagtttgtatccaccactgtgagtctgacagttgtctaatattaatgattattaatgaaaccccatctctactaaaattacaaaaattagctgtgcgtggtggcacacgcctgtagtcccagctactcaggaggctgaggcaggagaatcacttgaacccgggaggtggaggttgcagtgagcggagatcatgccattgcactccagcctggcaacagagcaagactccatctcaaaaaaaaaaaaaaaaaccggccaggtgcggtggctcacacctgtaattccagcactttgggaggccaaagcgggcggatcacaaggtcaggagatagagaccatcctggctaacatggtgaaaccccgactctactaaaaatacaaaaaattagccgggcattgtgacgggcgcctgtagtcccagctacttgggaggctgaggcaggagaatggcatgaacccgggaggctgagcttacagtgggcccagatcgcaccactgcactccagcctgggcaacagaatgaggctctgtctcaaaaaaaaaaaattggcggtttatgggtttgtggggggtacaattcctgcctgtccaagtgacagactcatttaattatccccaagttaatgtttaagtgcaatggggtaaaacatgcactctgttaactaaaaagccacatttccaaatagtatacatattacgattaaaacattaaaaatatatgtgtacagatttattcatataagcccaaaaacaaatgtcagacaatgtttctgtctttggaacctgactcaaaataaggttcctcctgttggcttcttcctgagacacagccaacgctaatttgccgcccaggcaaatcatctatgcctatcattaggaaatcaaatttatgatatgcatagcctagaatactactctgtagtttttttgtttttgtttttgttttttgagacagaatcttgctctgtggcccaggctggagtccagtggtgtgatctcagggttcaagtgattctcccaccacagcctcccgagtagctgggattacaggcacacactaccatgcctggctaattttactatgtagattttttaaacatgaggtatatacacatgtatttgcattgagtattctctaagataaagtgacaaaaagcaaaatacagagtttggtgtatttgctgctatatatggaaggaacaacacccagagaataacatgtttgcatgcatacatatgaagtaactcaggagagataaatagtaggtaactagctgtccctgggaaagagtcccaaggataaggtgcggactaactttccacttactacatatcttttgtactgattcatttcaaaatttactctaaaatattggtattacaataaagaaaactggagtctagaactgaatgacaaaactgatacattcttactacaaatctgtggttaagattagcattaatctttcctaggcaaagaggaaaaagtttaacccaaagactgtatggatcttctctaccctacatctccaatctcattcccattactcagaaaatattctcactgggtatagaggtatgaactcccattggaaaacttagggtaaacgtccgtggaatctatggggcactgctgacccaggacacctgggatatttctgcagaaacaggattttttttttttttttttttgagatggagtcttgctccatagcccaggctggagtgcaatggcgcgatctcggctcactgcaacctccacctcccaggttcaagcgattctcctgcctcagcctcctgagtagctgggattacaggcgtgagccaccgcacccagccagattattcttaatcagttgattatttctggctccagaatgcttcaattattccacctgcccctatgtataagcgttaccaccctaattatgcttgtttttgtttttttggttgtttgagacggagtctctgttgcccaggctggagtgcagtggcacgatctcgactcactgcaacctctgcctcccaggttcaagcgattctcttgctttagcctccagagtagctgggattacaggcacgcgtcaccacacccagctagttttttgtattttcagtagaaacaggatttcaccaagtcggcaaggatggtcttgaactcctgacctcaagcaatccacatgccttggtctcccaaagtgctgggattacaggcgtgagccatcgctcccggcctcctaattatgtttcattttggttaatgtttcaataaatgtgctttccctaaacatactgatgaaaagaggcccaaatgcaaaactgatttgtcgagaaagtcagtctgagatgaaatatttattatgtctaaaccacaagtagaaaaaaattcaaaggccgactatttcaatgctaactcaatgcaatattgcactttgtttggtttacgggagaggtaatttacacagctaacatttgggttttcaagattacattgtggggagagaaggggaaaacaagaaaagtctaatgcttttagattctgtcagaaaaagtgtttgctaaaaagcaaaacaaaatgaacatgagaaaaaatgtgaaaaaacatgcattttaggaagctttcaccgaagcaggtgctcaagttcagactcaaatcttccaactcttgtaataaaaatgagaggtcagaataccacaaactaatcaaatcaatcaaacaaagcgggaaacaggtggctgacaccagactgggcagggttttcctaaattgggcttaccttcactaatccaaatcagttttcagaaatggcttctacaaaaactacccaaacatccccctaataatttgcactcctcctccacaatagggaagccaagccgtttatttcccagaaggtttactttctctttcaagctctgctggcttcttcctgccccgcatacggccaggaaaaaagaaaagcactgccttttctttcctgccttctctaaaactggggagatggggtgagagaacctgtttcatggacaagctgggtggttcttaactgcaacactgttctgaatacagattagtttgcaaaggaaagttacaggacaggaaaataaaggtctacccctccaactaactcatacacatgtacatttgcatgtacgcacacacacagatgtgagggcacatttaattcagctgagtaatgtgcagcaatcagctcccagcttcatacctggccaccgggatgcctcctcactcccaccttctttacctgactcaaaataaggttcctcctgttggcttcttcctgagacacaaccaactctaatcattcctcttcccctcaaaccttcaacactacctgcactttctgggtcgggagcaattccttgggtggtaatccatttttaatgtgttaaatattacttaaaataagggagaggtaatcatggactgtgggcaatgcagagatttatcagaagggcatttgtgtaaacaggaatttacagtttgccttacctattccttttatatgacagcctcaatttcctctaacagaatgtaagtcccccatccctattcatttagtttttttcccattaggttagaatctgctaattattctttctctcctttgggtcattagtggctgccatgaatcataatttgcctgactttgtaatatctaacagatattaccattttagtttagtttttgatatgacagttttttgttttttgtttttgtgacggagtcttgctctgtctcccaggctggagtgcagcggcgcgatctcagctcactgcaacccccacctcctgggttcaaaagcaattctcctgcctcagcctcccgggtagctgggactacaggcacccgccaccacaacaggctaaattttatatttttagtagagacggggtctcactatgttgggcaggctggtcttgaactcctgacccgcctcggcctcccaaagtgctggaattacaggcgtgagccaccatgcccgacctcctaattatgttttattccacctgcccctatgtataagcgttaccaccctaattatgctttttgtttttcggtttttttgagacagagtctcactctgtcacccaggctgtagtgcagtggcacgatctcggttcaccgcaacctccgcctcccgggttcaagcgattatcctgcctcagcctcccgagtagctgggattacaggtgcccaccaccacaactggctaatttttatatttttagtagagacggggggggtctcactctgttgggcaggctggtcttgaactcctgacctcaggtgatccacccgccttggcctcccaaagtgctgggattacaggcgtgagccaccgcactcggcctgatattatagtttttaataagagtaattcagcctaggcaacgtgacgagatcctgactcaaaaaaattagaaaattagctgagggtggtagcacacacctgtagccccagctaccccgaaggctgaggcaggaggatcacttgagcctaggaggtcaaggctgtcatgagctgtgatctcaccgctgcactccagcctaggtgacagagtgagaacctgtctcaaaaaataaatagtaataatagtaattattagcacttgaatgttacctgtctgcccggcactatgcaaagtacttgatatgcatcatcttgcttcatcctctcaattactctacaagtggacctcgtttccacaattgtggacagagaaactgaaaaccagagaagtgaaaacaacaggcccaaggtctaagagaaggcagaactgggattaaagcccaataggtctgacctgatagtccactcttttaactgctatagtaactttggaccatgaaaccctcaaacataccaaccaagtgtttcaaaactacaatagcaatcaccttaggaatactcaaaatataagttctttggctgacgcagttaaaaattcaaaggtcaggtaaaatttcagtgatgagcaaggtcatttattcttatggctgggggtagcaggaaggaaagccggatcgtcgaagcattattttcttgtaggggcagatttaccttccttattattcttttgctaggctgttaaaaggaatttggaaggccaggcgtgctggctcacgcctgtaatcccagcactttgggaggccgaggcaggcggatcacaatgtgaggagattgagaccatcctggctaacacggtgaaaccctgtcgctactaaaaatataaaaaaaaaaacattagctgggcgtggtggcgggcgcctgtagtcccagctactcgggaggctgaggcaggagagtggcgtgaacccgggaggcggagcttgcaatgagccaagatagcgccactgcactccagcctgggcgacagagcgagactccatctcaaaaaaaaaaaaaaaaaggaatttggaataaatatgtctccaagataacctggtaaacagaaagggctgcaaaaaatctgaataaaagcaagtcaattaacaggatacatgtaaaacacacattttatattcctacaagtctttttttttataatagcatgttattacttttctaaaaaggacaaaataacttattttaatgacatttaaacccaattattaacagaaaagggataagaactgtggttccttggcctcctttccccttggtttagttctcctaaattaagaacttctacttatagctccctgaacacacaaggctgttttaagcctctgcaccctcatgttccttcagccttgaatgcaactttttgtaacgcaacttcgtggaaagaattcctattcatcctataaaaccctattcaggtgttcccatctgataaagcccctcaataatgatgactttctctcactcctgaaaagaattaatctcttttcttggatatttagtaagaacttagatttaccgagctcttactatgtgccaggcactatgctaagcattttatccacattatcttattgaatcgtcaacagtacctacaagataagcactgttataatcttcttttacagataagaaaatagaggctcagattctgactaggaagtggcagatccaggattcagtcccagatctgtttgacttcagagccagagtcttgaaccactcactgccctgtcgtctcccctgtcctacttccatactggcatagcacacacctcggtccctgcaacatctccagtttcatgaaaacggacaatatttcattatccttggatcctgcctgacgcaatacctggctctcaacatgtttgctgatctgaattaaagagttgcggtaatccttttttttttcttttttttttgagatggagtcccactctgttgcccaggctggagtgcagtggcacgatctcagctcactgcaagctccgcctccaggactcatgccattctcctgcctcagcctcctgagtagctgggactacaggcgtctgccaccacgctgggctaattttttgtatttttagtagaggcggagtttcaccgtgttagccaggatggtctcgatctcctgacctcgtgatccgcccacagcctcccaaagtgctggaattacaggcatgagccaccacacccggctgggtaagagttgcagtaatcctaacatgacaaatgagaactgaccataacagaaattcattcttccatatgttattcccaggcctcataacctctccttcctctgaagacatgtagcattcagtgtagcactgtcagaatgtctcactctgtcccccagtctggagtgcagtggcaggatcttggctcactgcagcctccacctcccaggttcaagcaattctcctggctcagcctccagagtagctggaactacaggcgtgtgccaccacacctggctaatttttgtatttttagtagagacggggttttaccatgttggccaggctggtctcaaactcctgacctcaagtgatccgctcacctctgcctcacaaagcgctgggattacaggcatcagccaccatgcccagcctgtttttgccttttttttttttttaaagaaacaaagtggtctcactatgttgcccaggctggtcttgaactcctgggctcaagcaatcctcttgcctcggccttccaaagtgctgggattataggcatgagccactgctcctggcccgatatgctactccttttaaaaactggaggcatctcaaacaatttaccaccaaaggaccatgtggccatactgactaaagcgcactacactttacgcttacgtcttgtaagccaaggtgtctaacaaagagtatataaccaccatattaattctttacaccataatcaataagggctgggccagcccagcaatgccatcctcctggatctcactgaggctgctccagaacaccagaagttcttcaggattcggggatgtccctcaagtactctttcagtggtttttataaatgactcaaaagttatggtgaaatttttaagtgccaaagacataaaatatgagtggtggtttgtatccaatcaaaaatcctcaaaaaacacttctgcacttaagcacactatacttttttcacccaaagtaccaaatcaaactagtcaggatacctacctttgtacaatgtcagactccagttaataactcccctagggcagagggcatatgcactgatttactttgtacaaattaaccagcatcaggcaatcaggcctgtgcctaacacatagtaagcactctatgattaaacatcagtgcttcggctccaaagttttatttatttatttatttatttattttttttttttttgagacggagtctcgctctgtcgcccaggctggagtgcagtggtgcgatatcggctcactgcaagctccgcctcccgagttcacgctcttctcctgcctcagcctcccgagtagctgggactacagacgcccgccacaacgcccggctacttttttttgtatttttagtagagatggggtttcaccgtgttagccaggatggtctcgatctcctggcctcgtgatccgcgcgtctgggcctcccaaagtgctgggattacaggcgtgagccaccgcgcccggcgccccgaaagttttaaaagcttcccctacaaaagaacagaactgaaattccttggtcctgtattcaatgtcttttgtaagtaatcacttctcccctacttaccctcctagtctaccgggctaccaggaattttttttttttttggagacagggtctcactctgtcacccaggctggagtgcggtggcgggatcacggctcactgcagccttaacccccggggcttgggtgatcctcccaccttagtctcaccagtagctgggactacaggtccacgccaccaggcctggctaattttttttatttttaggggagagggagttttaccacgttgcccaagctggtctcaaactcctgggctcaagcaatcctcctgcctcagcctcccaaagtgctgggattacaggcataaaccaccgcaaattctttacacctatcaaattccacccattatttgggacccagttgaaatccctctttggcaaaaagactttctagacaactccaggcctcataacctctcctttctctgaagatctgtagcattcagcctagcactgtccaatagaacgttctatgataacagaaaagttctacatctgtactgtatgttcttttatgtagaacagctaccttgttagcacaagtgtaaagtctcaccatctctttgatgacaacatgttacattggatggttaaaacatttatcagctcccccagtagactgcaatttctgtgaacaagatacaacttattcttcatagcaactctgacaaagttgcaaaaggtatatatatgttggccaggcaaggtggttcacgcctgtaatcccagcactttgggaggctgaggtgggcagatctcttgaggtcaggagtttgagaccagcctggtcaatatagtgaaaccttatctctactaaaaatacaaaaattagccgggcgtagtggcgggcacctgtaatcccagctactcaggaggctgaggtgcgagaatcacttgaacccgggaggaggaggttgcagtgagccacgatcatgccactgcactccagcctgggtgatagagtgcaactccaactcaaaaaaaaaaaaaaaaaagtatatatttgttgatttgcacatcacctaagaaaaccataagctaagaaggtttggactcaggcgtctggaaagttggtcaccacctctaccccacctcatatctgaatgtcaagagacacgtagaggcagagaagttaaagcaactttctagagacagaaatgaccactgatcaagccacaatgcactctggtttaaatgacatttaggtcatgactgtccttaatctaaaacaaacctagattagtatttcttttcattagtaaatagctaaattctgatggtaaattatgctgaccaaaaacagttcctcacttcccaagttagacatagcaattagaaaaataatctaagcaagctccatttgtatttcttttttcacctgtttattgaatatttacctcccatgaagtctttcagcctattggtggtattttactgttcagatatatgttagaatttcactgatacttactgggcgcggtggctcacacctgtaatcccagcactttgggagatagaggtgggcaaatcacaaggtcaggagttcaagaccagcctggccaatatggtaaaaccccggtctctactaaaaatacaaaaattagctgggcgtggtggcgcacgcctgtagtcccagctacttgggaggctgaggcaggagaatcgcttgaacccaggaggcagaggttgcagtgagccaagattgcgccactgcactctagcctgggcaacagagcaagactctgactcaaaaaaaaaaaaaaaaagaatttcactgatacttttcacaaaatatacagaaggaggcacaaattccaccactatggcactctgctgcgttggccaagtgtcttgatcctttggcctcaattttcttatctacgatattagggtaattgttatgtgaactacccacctcacaagtcctttgtgggttaattcataactgtgctgtgggtatttctttttctttcctttcttcctcctttcctttctttctttcttaaagatgggttctcattatggtgcttagactagactctagacccaattcctggcctctcaccatgttgcccagaccagactcaactcctggactcaaggaatcctcccacctcagccttcaattagctgggatcagaggtgtgcaccaccatgcctggcactgtggatatttctaagtgattattcttctcaaatgaactacataaaaaacaaaagattcatgaatttactaatggttctttgtgatggatgtgctaatatagagactaaaatcaaggctccaacctctaaaacatttttttttaaattccagacttgtttccccatcccactgtgcaaactgaacaaaaactgggctagcactcctgtctggaacatgtaataaggaaataaatgtgctgactcagagaacacagacatatttaatataaaataagatagaaaactggctgaaccaagtcataacacagtctaaatccacatataaaagattgagatgattttctgctttgctttattcaagcccaatgctttatcagcacagccagccaaaaatttacaacccatacacagactatgtaaacctttagttgcacatacagtaagaccagcaggtacacactatacacatttttaattaaaaaaatgactaaccactgattttgtcaccacacttaacaacgacctgatatggcacagagtgatgtgtaccaaacatggaaataccaacttgggcgacggtttgaatcttgttaacttcagtgcaaccacaccccccaaatgcatgtaaagtttgcacacatggttttttcaaggccagcctgtctttgtttccctctcctctgcatttacccaagatcttggctctgagacagaaaactcccactctcaattggttcattccgtcctatgcaattaagcaacaccacaatccagtaaatgcaatggctcaattatttatcttctggccgactttaccaggtatttggaaaaggacaatgtcaagaggtttatttctctctctagagctggcttgacgggttgatggggattttattttgtctttttttctcttttttacaaggcggggacgtggggggagcataatttaacctagaaaaagatgcgagggaatttagaaagagtaccggtctgtcaatttccctacaggaaacttgattcttatgcaataaagcctacccacgaccagccagcccgtaaggctgcaggcgacagacacacctattcctgcctccaaaagggcacagctgtctcctgaaggagcgggaacagggcaagcggaggaagtggctcagcgggagccgccgaccgggcggggaggaggcgctttccgaccccccactcgcgccggtgatccccgtcggcgtgacagtcgctccggtggccggaacgtccccagggccccagggagcaggaaatcgggggactgtccctcactcctgccgccgcaaccgagtgcgccctcgccccacggtgccccctcgagcgcgttctgtttctccgaagaacgaaacttccctccagcgccccgagtcccttccgaggcccgctcctgtcatcccgaagagtcttccctcagggcgaccctccgcgtctcttcatctctcccggccccactgcagcgtccatcacaacatccccaaggtcccagaggccccctgccgctgcggagcccccgggtccccaggcctccccaacggccccaccctgcacccccttcacctgtttctccggcagaggccgagaggccggggctgcgcgtgtgccggggacgggcggcgaggctccctcaggccgaagggcctctccgagccgagggggagagacagcgccaagccggggtgcctgtccaggatccggttggggcttgttccctcggctgcgacgtcggaacccccggctccccctcccagtctgcgccgccgcagctccggaaacc

SEQ ID NO: 2052 - DNA, 75171 bp, Homo sapiens; identical to SEQ ID NO: 2051
  source 1..75171: mol_type = genomic DNA

SEQ ID NO: 2053 - DNA, 75063 bp, Homo sapiens
  source 1..75063: mol_type = genomic DNA
acggttcctatataacgtttatttctggaagttaaagtagatacagcaatataccaaaaaaaaaaaaaaaaaaaaaagacaaaaaacctcacaataatataaatttttacactatgaagtacacattggaatttgaatgcagtggccaggacagcagcttataaaccaccttataggtaggtaagcaacccacgggattccctcggctgggctggggatggggagggggcagtggacaggaagcgggcagggcctgaggaccctgttctttaatgggccacaacagggctcagctcctctcagaacttttgctacaatcagagttaagaccagatacatgctacctaaggccatgaacttgacaatatctgctccagagaagccctgaaccctcgccctaggtccctatgatttaaacccaatggtaagcccaagtctcacctttctaaatattctgtttatcagttaagcttattatgtactgaagagtgttgctggagaagtaagagctctgcatgacacatcaactgtctccaggcaggaggactggggcgaaccctgttcatcttagagaaggtcgtctcccccttaattcagagaccagctaatttgatttaacaaacagaattccacagaaactctgatcagctgaggcaaggtggttttgagttgccaaatccggccatgcctctgagtcagaggcagcccatccagcacgtgctaggtgttcccatacgcacaggagaggcgagctagccagccaaggcgggcaggcggggaggccctctagctgttctgcctcacctgtggggccccagcagggaggagtcaccagcctcagagggaggccaggtatacaccctcatacgagggcagactcaagtttatcagtaagcctttgccctgcatgaactgaatgaagacgccattacaagtgccactggatatcaccaagaaactggctaagaaccatattccctgagctcaaccagacacgtcgctggggccccatagtgtgcatcatgtccaacctgtaactctctccccctcttcttccatgaggtcctgagaccaggattcctaaaacaaacaggatgagggacctttagacacgcaaggagacatgcctctagcaggatcagggggactggggtcgggagggtggggcaggaaggaagccagaatcagaagtatcccagccctgataaggcacccacagaaacaacctagcctctgaaacagcagatcaagtccagggagaaagggagtcaaggttgtaagcaccctctgcccagccttactcactaaaaggccaatacattacaaaggaaaataagtctatttataaaaaaaagtctaaaatgcttagattctccttaaaccttcctatttcaacaccaaaggccaggttgcagcttcagatgtcttaagggtttgacctgaagcccgtttcagggattatataaattaccagcctgaaggaagctgaatgcttaaagcaccaaggaggctgttaactgaagtttcttttttttttttttttttttgagacagagtctcagactgtcgcccaggatggagtgcagtgtgcagtggtgcaattttggctcactgcaacctccgcctctcaggttcaagcgattctcctgcctcagcctcccgagtagctgggactacaggcgcccaccaccacacccagctaattttttgtacttttagtagagacggggtttcaccgtgttagccaggatggtcttgatctcctgaccttatgatccgcctcggcctcccaaagtgctgggattacaggcgtgagccaccatgcccggctgcttaagtttcttaaatacagaaaggctatgctgatacagtgttttttgccctttaattgttattatttcttaatttaaaaagaaacctagggcttagatagtcctatcttctatttggatgtcagcaaggttaaaaagtgcaatgccaggagtatgtagctataggtggcctgtggcatttgcttacagaaacaggcagaaggatgccgcaggcaccaggaggcacttgtctaagaacaacaacaacaataacaaaaagctgctgagaaaggagggcaggggaacaaaacaacacaagacatttcctttttctccctctagccaccccccgccacatcccctgatcatgggtctcagagaacacatccttatttgcatttagataaaagcagatcacccacattcactcatttctctatttttaaaagtgcccagattgctcaaagatagcagaagtaggagattaaaaaaaatctggaaccacaaagttagtagtttcagatgatctggggtttggctgtgtgaggggtggcagaatgcaggtaggcgcctcagtcgtatctttctgcagcttccgttctcagctcctcacatgggggaggtagcgcactccgaggtcaactccatgtcaaaggtgagggactctggagggacagacagggaaaactagttcagttgtccaccctctgcaactggcaggccacgcccccagcccttcagaggacagggcccaggctaccactgctatccaatctcctgccccttaaggcccagggatggtcagaaaagccagatttaccctcctccctggaggaccctgcctcgggaagggtcctttctcattcccaccttaactgattcccagagctccatgtttacagaagctctaaggctgtcctgagatcttctgcccttgatctactgtttaattcaggagccccgagacacacgtggccaccaagcatttgagatttggtttgtccaaactgagctgtgctgtggctgtcaaaagcccactggattttaaaggcttagtatgaaaaaaaagaataaaaaaaggtctcaactttttctttttagtttagttttgtttatttgagatggagtctcactctgtcgcccaggctggagtgcagtggcacgatctctgctcactgcaacctccacctcccaggctcaagcgatcctcccacctcagcttcttgagtagctgggattacaggtatgcgccaccatgcccagctaatttttatattttagagattttggtcagactggtctcgaactcctgacctcaagtgatccacccacctcggcctcccaaagtgctgggattacaggcatgagccactcacccagcctcaactttttctgaaatgttaaattgagagtatgttggatttagtgggttaaataaaatatattgtaaaaattaagttcgtctatttccagtgtggctgctagaagatttatactcacacatgtggcattcataccatctcttttggaaagcaaagctctagaatctcctaccattccgagtgaccagctctcggtgtgtacatgtgagagcatcacacaaaggggaccaacttcccttatagggacaaagtctgtcaaccaaatactcaccaaactgccctcctgctgagggttcagcaccttcaccattatttccaaactgcatcaatgaatctaaagtgcggggggacatcggcaggtcaatggtattgctgcaggtcgttctgtaggaaatggggggcagcaggaggggaaacggggggttgacaagacacaatggaaaaaaaaaaaagaacaaaacacacacacacaagccatcaaactctggtctccaacagaaaaataaaagctcaagctttttaaacacacaaggtcactttgagtactaaacatagcccaggggcttccaacctttggcagattaactctcacccagtgtcccattcccagggataactgaggatattagaaatgaaggcaaaacggggaaaggaagccacttacggtgtcacacagataaacttggtcttcaggtatggggcagcgcctgggaagaagaaaaccagttttcttactgactgtgacttcgcattcagtaagcagagctggaggaagccatctgcctcggcaggactgatttgaaactcactcatcctcatgccaagattgtctggaaagctccatctgcccctcagggttgtctgccctcatttatactatttgatctcccaggcactagcagctgtgaacttcagttctttgcacaaagctgtcctgagctgcagagacttttcagcataaccttttcccacctgaccctagactaatgccaccttgtgtcccttctttccctagattatgtaaaagtttaacagcctccacgtggtctgagcattctattccggcctggtcatatctcttagataacttctctgcatgcaggaaccgagcctgtgtagtctttgcatggtgtccagcctaaataccaatatcaccaagtctttaaagaacatggagactgctaatgcttgtggttccaaagccaaaggttatatctcttattcctaccagcactaatctggcctctaccacatttttggatgagggcatgagtaactttctagttggataaatacgtcaatcaaaaagcaccaaagagaatgtgactttgtaaggcagtacaattgcttcaactagaagaccggagacctgggtccaggtacatcttcaatagctaagagacctggagcaaggcatggtctctctcttttgttgctgttgttcttattgttttgagacagagtctcactctgttgcccaggctcaagtgcagtggcacaatctcggttaccgcaacctcctactcccaggtcaaaacgattctcctgccttaggctcccaagcagctgggactacaggtggcaccaccatgcctggctaatttttgtcttttttttttttgagacggagtcttgctctctttcgcccaggttggagtgcagtagcgccatcttggctctctacaacctctgcctccagggttcaagtgattctccttcatcagcctcctgagtagctggattacaggcatctgccaccatgcctagctaattttttttttgtaattttagtagagatgaggtttcaccatgttggccaggctggtcttgaactcctgacctcaggtgatccatctgcctcaccctcccaaagtgctggattacaagtatgagctatcatgcccagccttggccacaatgcccagcccatattctcttttatgtataaaataagagggagggggaagacaaggtgccaattttctatgagctttgtcatttataattcttgttctacagttagaaatgcgttgacgggaataaaatgaattttagatgctgaatgcttacaccaagaggtcaaggaaccttggggatactggcatgaaatctggggaattcaggtgaacaaaccattgagaaggcatggggcagggtgaggtgggctgagaacagcacggtcataaaacatgaggcttagacagaacctgagggatcagagagcatgatgaccatgtgaaagaaggcactgcagagtggctcttgggctgccatctgagtttactttgggccaagaaactgatcaattcagtgcagaattcaaaggagctactgaggcaagactctagtgtcttataaatccaactgttttggcccagcccttagggagctgacaccctagacagaaaaggatttaattctccagcattcaagatagctgaggccaggcacagtggctcatgcctgtaatccctgcactttgggaggctgaagcaggtggatcacttgaggccaggagttcaagaccagcctcaccaacatggggaaaccctgtctttaatgaaattacaaaaatagctgggcgtggtggcacgcctgtaatcccagctactcaggaggctgagacaggagaatcacttgaacctgggaggcagaggctgaagtgaggtgagatcgcaccactgcactccagcctgggtgacagagtgacagactgtcaaaacaaaacaaaaacaaaaacaaggctgggcactgtggctcacacctataatcccagcactttgggaggcccaggcgggaagatcacttgaggtcaggggttcgagaccagcctggccaacagggtgaaacccggtctctactaaaaatccaaaaattagccaggcatagtggtgcatgtctgtaatcccagctactcaggaggctgaggtatgagaatctcttgaacctgggaggcagaggtttcagtgaagcaagatcgcgccactgcactccagtctggacgatagagcgagactcaggctcaaaaaaaaaaaaaaaaaaaaaaaaaaagctgagaaaaatgacttcattgtgtggctttgtacaagattgtaaatgtactttatctaatttgtaagtggctccgaacctctccctcaagccataaggaaatgctatgtgggcttccagtagagaaggaagagagaagagtcttgggaggataatctaacctgagaccctcataccataatactcttgtgatggaaatagagaggaaatggtcacatgctcatcgtcctgaaggcacccattttaaaataacacagggacacccccacacccgtcaccacactcacatggagtccctcagggcacactcctctcagcaaggcaaggcaaattactcaagtaattagttcctttctcctgatgagtgcctggcccctgaggaaacgctgacatcgctgggcaggaaaggacctggcctcccagcccacaggaagggcgatggtaatggaggatgcagcctcagactgggaggtgggaccttgaaagcaaaatgagtcaaaaggaccagccgtgggaccccaacgtcctctgcagaaggaacaaagagccgtgtggcaggggctgataaacagatctcccaactgaagcacacatgcaaagggagataggtggcagacaggaagtgagtaactcttacagcaggaacaagactcaggaccccaacaaaggagaaaggcaacggtcaattagctccaactccctcttccaagccccattctgccccatctcaagaaatccctcagaaggaattcctaggaaaaagtgggagggaagttggtaggtttctgtgtgtgtgctatttggacaaaaatagttttttcaacagcaactagggcaaggcgccaaccctaaaggatcacattaaagagcccatcattaggccaggcacagtggctcacgcctgtaatcccagcactttgggaggctgaagtgggcagatcacctgaggtcaggagttcgaggccagcctggccaacatggcgaaaccctttctctacaaaaaatacaaaaatcagctgggcatggtggcacaagcccataatcccagctactcgggaggctgaggcaggagaattgcttgaaccgggaggtggaggttgcagtgagccgagatggtgccactgcactccagcttgggtgatagagcaagacttagtctaaaaaaaaaaaaaaaaaaaaagcccatcattggctttatgattacagaaagttaaatcaaacaaagaatggcaaaccagagactccccatcaagacctgcacaaagaacccagagagtcaaaacagcaagtgctgaaggggaacagacagggctaccccctccacactgaggacagctgcagagattacagttttgtttcgtttttttctttctcttctttgtgtgtgtgtgtgtgtgtgtgtgtagtggggtcttgctatgttgccaggctggtcttgagttcctggcctcaagtgatcctcctgcttcagcctcccaaagtgctaggactgcaggtgtgaacccccatgcccagctgagattacagtatttttaatttctctctcttttttttttttttttttttggtgagtcaaggtcttgctctgtcacccaggctggagtgcagtggtgcgatcatggctcactgcagcctcaacctcctgggcttaagcaatcctcccacctcagcctcccgagtagctaggactacaggcacaaaccaccacacgtggctaatttaaaaaaaattatttttgtatagatagggtctcactatgttgtctaggctgttctcaaactcccaggctcaagtgatcctcccgcctgggcctcccaaagtgctaggactataggcatgagccacttcacccagctaaaataatttatatataacatataagtacatgtcctcttacacattaaaatataccttattttcaatagttgcacactctaaatactaatcccttgcccctccacccagtcactgtcttccccttcaaacgtgatgctcccagctcttctactctagtgtaaaccatactcccatgcagctaataataatttcctccagaaaccctttcttcagaccatctggcacactgacatggttcagttacaggcaaaaagccatatgctgggctgaaatctgggcctcaaaccttctagcatctactaagaagcactgtgccagcagggcatcctgttaactgccctcactttcccttctcgtgtttcaggcatgttttgggggacgtatgtgtattgatcccctctttatttttattttttgacacagtatctcactctatcagccaggctggagtgcggtggcatgatcaccgctcactacagccttgaactccttggctcaggtgatcctcccacctcagcctcccaagtagctacgactacaaatgcgtgccaccacaccgggtaatttttttggattttttgtagagacgaggtttcaccatattgcccaggctgtatcccctctttagactcatgcactctctgtggagcaggaactacactactctaagtgattctgattctcctctcaaatcccatcggtcaccccaacaaaagcactcactacaattctttcccataaggagaaataattatcccccaggttattcaggcatttgcctatctatcctccaaggatcccaaaatttccaacttttcccaaaaattaaatgccaggaacatggaaaatcaacaactacctgggtcagcttcaggatgctcctggctctctggccgacaatactttccgaatgcctcctccttgggaatgtcaggatagagatagaccagtggagacaccaggatattggtagcatccatgatcttatagcccatgatgatttcagcaaatgacatgttgttcagctgctgctttgtgtatggttccacggactggatctgggtcttacctgtcacaggacatgggaaggaaagatcatggaacctacagctaggtcatctcagagaaaactgcccattttttctttcctcgaaggggaaaagacttaagccaccctagtgttgagaccctgaacaccctgttcagtggcctggcactgtggaaatattcaggctggcttctaattaagaagaggctactagttgggtcatagaaaataaacttgaatataactacttgcgtaagatatattaacagggttaagtagaaaaagagatgaagaatacaatttaaattgcaaaattctcaacaaatagtcactggagcaagcaaaacaaagcaaaccaatccttcagctggaaggatttagaagtcacgcaaatgtgttttgcgagtctgagtgaaacagggagtcaaggccatctccacccaccagggggcagtaggtgcttgcaactagaagcagtgatgaggcctcagcagccaccagcaggtggggtgggtgggagcctcccttaccgctgatgtccttctccacccaagtgaaagtgacgcctccttctttgctgctttcactgaatcttagcaggaaggtgcctggaggcttagtgctcaagatggcccgctcccgctccttactgataaagcccatgatgtacctggagccaaggaggaggaacaatgttgttattgctaacagggcatccatcccctgccactggcttgctgagagcaggggacttggttacatctgtgcacactctgtccaacctacccttcgttccaaagggccaggatgtactttttcacaaggtcaatgatattgtccagccagacccagaaggagaagcccttgccagccatgttttcctggagaaaagagtaatgggaaagccaagtctactgccatcccagcccttcccttcctaggggtgcagtgcatcacccaaatcctcaggcccgtctaccttcaggcaggtcctactggccgctggaccaagagttcagggccttcaagccagagccctcaacgacagccgtgcaggtgagcattcccattcccacgagaatttaacaagattgcttactttgcaaaatttagcccatgtgatctgacaccctgaataattcacaccaggtcctgaaggaaagaaaaagagtcaagtagtacattttcagcttggggtcaagaggttatttcttaaaacagaacacacacacattcatcccacaatgggccacaaaataatcagctttcacatctttgaaggtaggcactgttgtgtgtgtgcacatgaggacaaacactatcccatcatttgactcacttgtgttgctgggtagcccagcagggatggagggtgatataacaagtccccctgctcttcccaacctcgggtggtaggctgggaaccaacagcagcactcactaacaagctgacatcgggtgtcagacaggtgtatttggtggcaacagctttattagaacaaagctacttctagcccaggtggcacataaaatattccactaattcttttttaaaaactagcctacgctgggcacagtggctcaagcctgtaatcccagcactttaggaggccgaggtgggcggatcacgaggtgaagagacggagactatcctggccaacatggtaaaaccccgtctctactaaaaatacaaaaattagctgggcgtggtggtgagcacctgtagtctcagctactcgggaggccgaggcagaagaatcgcttgaacccagaaggcggaggttgcagtgagccgagatcacactactgcactccagcctgggcaacagagcaagactcgtctcaaaaaaataaataaataaataaaataagacaaaaaaaaccaactagcctatagtttattaaaaaaatggacagggaatgtcaagcctttagtgccaccttccaacacacacttaaaagatcttctaaagttagatagagtgggtgaatgagacagcaaccaggagaaaagaaatctacctcccacctcaaaaatgatcacctcgactgaaaactgcaaactgtctctgcaccccaactccccaactcccctgtttcctggcaccagcacagcgccttgctcaggaaagaaacatggcctaatgctcagtagacatggcccaaatgaacagccctatgggccggatcccttttctgggcgggtgggcgggagggagaaggggtgaaatgcggacccaagagtttctctgccagtgtagtcagctgctcgatgctcagtcctcgcttggtggtggaggagaactgccagctcaggacctcggccacttgatcccaggttccaattgggggcttggtaaaaaagtttacattctattggaaagaacacatttgcttgtttagatgagggatggtgctcattgtctatactaggtacccctaagtcgcaagagatcccggggcaccaactaaaaggagggggcactaaccttgggattgttggtcagcatgttgtaccacaggatggacgcccaggcatttggcatctgacagatgttggagatcaccacaactggcaaggagtgggtctgcggagggagtggggactgagctggggaggcagaggggctctcacagccttggaaatctcttcacccgcatctcacggggctcagaatgaaaggacatgccataaaccacacctgctgccaactctaggcgaggagtgtgagtgagtcagctcagtgagcactcatagtggaaagaatgcccagcgtggccacacaactcaggctgcagtcggaatataccggtcccttgtaaaacctgacttgctcaaagcttgactcacaatccacagattccccatttttaagaccttggaggcattctccaagacttgaagctgtatcttcacatgaaacagggaggtctcaggaatcaaagaccaggattcctgcttttctaggtatatcttaatttaaaaatcaagaaagttgggaaaggagaatgtcattgccacaattttctgtatactaaacacactggctgctaagactcttatgcccaaactttataaagtcagttctaatttcttttttttttttttgagacggagtctcactctgtcacccaggctggagtgcaatggcacaatctcagctcactgcaacctctgcctcccaggttcaagtgattctcctgcctcagcctcccgagtagctgggattataggcgtccgccaccatacccagctaatttttgtattttagtagagacggggtttcgtcatgttggccaggctggtctcgaactcctgacctcgtgatccacccgcctcagcctcccaaagtgctgggattacaggcgtgagccaccgcgcccggccaatcaatttctaaatagagattttcatatcaagtttgctgaaagctgaatatacacacatcttctaagcattcaagcaagactttattgccagatgggatgccaaggatttttttggagaaaagtaagcaaaaataaacacagtgttaagcaaacagtaatcattccaccttctcttgtaaaaatcccagtggaagtttttgtcctgagtcacccctgtacgtagcctctcaccgattctgctgcagaacttacctctaggtcaatcttgaggccttggtgatacacctcggtctcaaaggtgatcaggtgcagctcctcagtcacaatcagggaagcctacagtaacgagaaggacactcttaggccaggtgtggtggctcatgcctgtaatcccagcactttgggaggccaaggcaggaggattgcctgagcccaggagttcgagaccagtctaagcagcacagcaaaactccatctctgcaaaaaatacaaaaattagctgggtgtggtggtgcacacctatagccccagctactcgagaggctgaggtgggaggatggcttgagcctaggagatggaggctgcagcgagctatgattgtgccactgcactctagctggggtgacagagtgagaccctgtcttaaaaaaaaattaaattaaataaaaaaaaaggctgagcgtgatggctcacacctacaatcccagcattttgggaggccgaggcaggtggatcacatggtcaggagttcgagaccagcctggccaataatttggtgaaaccccgtttctactaagaatacaaaaattagctgggtgtggtagtgggcgcctgtagtcccagctactcaggaggctgaggcaggagaatcgcttgaacccaggaggcagaggatgcagtgagccgagatcacgccactgcactccagcctgggtgacagagtgagactctgtctcaatcaatcagtcaatcaataaaaaagagaaggacacttttcctcagagagaatggcattcagtactaacagccacagccaaggaaagtgacatgccaagcctcaccacaccaagaagggtaagccaccaggtggtcacaaacaaactgccagggacacaacttgctcggcacttactctcttcaacaccaagaacttccaatgctgtgatcctcaacctaatcctttactcagtttgtattataatattacatagatccaattggttatttgtaaaatacgtaaggcacaaagaataacaaaacaatatgaacccaccattcaatttaaggaaaagtccatcactcctaaaattctctgggtgcccttccccaaccccatccccttccctcctccctcagaaataactgctattttgtcttttgggtttatcatttcctagccctttttgtcttgttttgttttgtttttttacagttttaccatatttgtttatctaagcaatgcaggtattgtttagtttgggacatttgtgaaccttacacttatggactccaatgaattcttttgggattcacttttcacttgatgtgaaatgaatccacatggttatgtgtatctgcagtgtattccttttcacagctgcggagtattccattgtgtctataccacaaataatgtattcattctaatgttgatgggtatttatttgggttgcatttagagcttataatcaggctgatgtccactttatatatgtctcctgggacatatatgcaaagatttctctgctattaaatcctgggaatggcaccgttggtttacaggtatgttcatttttatactgccaaattgttttccaaactgactacaacaatgtctcacatcagtacagcaaccttattttaagtaagagttgtcaatgaattctcaaaaattgaattctagtctgggcacagcggctcatgcctgtaatcccagcactttcggaggccgagatgggtggatcacgaggtcaggagttcaagaccagcctgaccaatatggtgaaaccctgtctctactaaaaatgcaaaaattagccaggcgtggtggcatgcacctatcgtcccagctacttgggaggctgagacaggagaatcgcttgaacctaggaggcagaggttgcagtgagctgagatcgcaccactgcaatccgatagaacgagactccgactcaaaaaaaaaaaagaaaaaagaaattaaattataattcatttttaatactatttttctgattataaaagtaatatattcagtttaaaatgcaaatatcacagagacagtctagaatagccatggataccaacagcagcactaatacacatagcactgctggtatattcctccagaatttcttaatatacatatgaatacacataagagtatagtgtatttttaaaacacatatactaataatactattcaaattattttacattttgctttttcttaatatgtcatgtacattttcccatatcattgcatacaggctacttcactctactgtcaagtaaaattccacatttttaaaaaggactgctacattttattttatttatttttttgagacagagtttcactctgttgcccaggctagagtgcagtggcaaaatcttggctcactgcaagctccacctctcaggttcaagcgattctcatgcctcagcctccccagtaactgggactacaggcgtgcaccaccacacccagctaatttttgtatctttagtagagacgggctttcaccatgttggccaggctggtcttgaactcctgacctcaagtgaccagcctgccttggcatcccaaagtacggggtgtgagccagcacgcccagctaggactgctacattttaaagaggaagaattgttcaggggacaaatgtaagaaaaagaacggggcatcacaatttttaaaaatgactgaaaactagccttccgtcacatttacctttttttgtttgtttgtttaaagtttattcttgacaataagaatccaataatctgaatcaatgaaaagcagaaaataagggggataaagaacaagatgggtttttgtttgttcattttattttatgtactcttttcctaagcaagctaatgcaaggtggtcatttattttaaagtttaactcaaatctgttgcttttacaccctctatcccacctcagtgggagagaaaaacagggcactaaaaatggagccaagcagggtcagccgcaggagctggatggggaatttggaaagccccaggcaaggtggaaagctgctttataccacatgggtgtggagaacaactcagcaagggactttccacttctccttaaggaggagccaactcccagatattcacggaaatgttccaagccagagagctccatggcacatggaacttctgttcatgtcactttggcctgaagtgactttttggaataactacagctgaaagaacaggttgatgtttctaattctggggattaagaaggatctttacccctctctccctcaaggaaaacaccccagttgtctttcatccccaacaaaacttacatcacaattggctcggcccccattcccacatctctgctccctcagggtctgtaagaaaagaaaaaggcaggtgtcctgtgaggctctccctagccctctccggcagccagaggccctttgtgaaggggagctcctcccacataccaagtgtttgaattctgcagagaggctgccgttgttggattcttccatgttcatcacttttgtgtttgtgcccagaatgttaaatttccgggatctgaatcacaggggaacaatcaactatgtaggtgaccaagtagccggaggatgaagttaggttaaacggaacaaaaggaagcctctaggctgaacttaccctctgagagctgcaacgtccccagagtctctgtaagaacacagactgttgttaataaaataggctctgtgtttcttcaaaaagcctactttgaccacctgttatttactgtcatgaaaaaacctctgtgctcctgggcatttctttaaactattcagttacagttgatcagcgcaacataacacctctgcgtagcaggcacagttggttgcctccccataggaaggggaacctatgtttcatattgcatatgtacttattaaacctaccaccttcgtcaactcccttatttcattattttccagtgcatcctcatgaaatttccacataattacatcaactaaaaataagaatgcattttatcttttcttttttctttttttttttttgagatagtttcgctcttgttgcccaggctggagtgcaatggtgtgatctcggctcaccacaacctccacctcctgagttcaagtgattctcctgcctcagcctcccgtgtagctgggattacgggcatgcgccaacacacctggctaattttgtatttttagtagagacaaggtttctccatgttggtcgggctggtttcgaactctcgacctcaggtgatctgcccacctcagcctcccaaagtgctgagattacaggcgtgagccaccgcgcccagccacattttctcttttcttttctttttttttttttttgagatggagtctctgtcgcccaggctggagtgcagtggtgtgatcttggctcactgcaaactccacctcccaggttcatgccattctcctgcctcagcctcctgagtagctgggactacaggtgcccgccaccacgcccagctagtttttttgtatttttagtagagacggggtttcaccgtgttacccaggatggtctcgatctcctgacctcgtgatccgcccgcctcggcctcccaaagtgctgggattacaggcatgagccaccgcgcccggcccacattttctcttttctaatgtcgtcaaagggtatatgtattttacatcctgaaaggtattgtgaaattttgcgtattccattatatggtaaagtgtggaacaattaaaaaaaagagatctattctttccacatgctatgtatggaaagaatatataacgacgtttcggtcaacaacaaaatgcatatatgatggtggtcccataagattatcatggagctgaaaaattcctacttcattgagatgtgttacaattgcctacggtattcagcacagtaacatactgtacaggtttacagcctacgaccagtaggctctgccacatagcgtaggtgtgcagtaggttctgccacccaggtttgtgtaaggactatatactctacaacatttgcacaacaaaattgcctaatgatacattttgcagaacgtatcccagtcgttaattaacacatgatctcagtcttatatataatatgcatgaatgacatgtacaagtaaaaaactaaacaaggaaaagagggactggttgtcacaatagcaaccacaaatcaaatctgtacccccagctttgtggctttgttcagacacgtaaatgacaatgcaccccaaggcttttgaaaacttttgtccacaaaatgaagatctctgaataaagacagagtctctagttcaaatgatgtctgtcaaagttctcatttttctattcctcatttgaaaaacagagctaagataggagtacttacttgtcaatgcacactttaattttaagctgataattcaactcagggaatttgaccagcaacctatttaaaaagaaaaaatccaaggaaaaaaagtcagtaactctcccataaccttttcttgaagaaatgtaaaattcataattcttcatttccaacaggtaaataggccaagctgtctataattacaggctcacatctataatctcagcactgtgggaggccaagctgggaggatcccttgagcccaggagttccataacagtctgggcaacaaagtgagagcccacatctataaaaaatttaaaaattagcggggtgtggtagcatgtacctgtagtcgcagttactcgggaggctgaggcaagaggatcacttgtgcccaggagttcaaggctacagtgatctatgatcatgccactgcactctagcctagatgacagagcgagatcctatctctctttctctttttttttttttgagacagtttctctcgttacccaggctggagtgcaatggcgcaatctccgttcaccgcaacctccgcctcctgggttcaagtgattctcctgcctcagcctctcaagtagctgggattacaggcgcgcgccaccacgctcagctaattttgtatttttagtagagacagagtttctccatgttggtcaggatggtctcgaactcccgacctcaggtgatccacccaccttggcctcccaaagtgctgggattacaggcgagagccaccgtgcctggcccctatctctctctttaaaaaaattaaaatagggctgggtgcggtgactcacacctgtaatcccagcactttgggaggccaaggcaggtggatcacaaggtcaggagttcgagaccagcctggccaagatggtgaaaccccgtctctactaaaaatacaaaaatcagccgggcatggtggcaggtacctgtaatcccagctacttgggaggctgaggcaggagaatcacttgaacccaggaggcagaggctgcagtgatccgagatcacacctcagcactctagcctgggtgatagagaaagactccatctcaaaaaaaaaaaaaaaaaaaaaaaggccgagcgtggtggctcacatctgtaatcccagcacttttggaggccggggtgggtggattactgaggtcaggagttttgagaccagcctggccaacatggagaaaccctgtctctactaaaaatacaaaaattagccgggcatggtggagtgtgccggtccagctactcagggaggctaaggcaggagaatcgcttgaacctgggaggtggaggttgcagtgagttgagattgcaacacgcactctggcctggccgaaagagcgagactctgtctcaaaaaaaaaaaaattagccgggtgtggtggcacgcacctctattcccagttactcaggaggctgaggcacaagaatcacttgaacctgggagatggaggttgcagtgagctgagatcatgccactgcacaccagcctgggtgagagtgagaccctgtctcaaacaaaaacaaaagatgagtatcactccttcaagccaaaggtactgagaaaacatctaagaactaacaacttaaagttgtgagagattcacaaaaggataatcaaagccatataatgaaaaatattacaggaacacatgctgtgcagctggcattttgttctattaatcctgaaaccgaacaccatactaagtttctgaggagggaaattttgctgcagaaggtcaaaaccccagcacacctgttctgacttgagtgtgaaagtaacacctcaccctacaggcccaccacccacctgccctggggcctctcagcttccccatcactaagccttactctttcccttaaaatccacagggaagagtagcctcaaagaacagaaaatagatgacattattttgtcccttgggcagaaggagaagctgtggcctgagactccaggtctacaatcataggaatatgcccaggtaccttcaaaaagatgactgctcttttgcttttgacatcagaatcagagagcaagcagatagtatggcaacaaatttcaaccccgcaacagtgtactgcctgtgacaccacacctggaaagaatgaccctggccaccaactctaccctcaccctaacagtgtccctcagtaaaatctctactggaaatggaagtggcatggcctacctgactttagtagtgaactggacgccggtcttgatgacgaggggccggtcaggatgcatgggcatgcagggctgccgctccaccacaaaggcactgaggaaagagaagatgggctcacgcgccacggccatgaccagaagtcagcccgcctctcactctaccacgtgagtctttaggtattttttagatgagggaaagggacaaggatgctaaattaccttttcattaagtttctaaacagctccacgattctctcctccagcatcggccggtgctgtacaatggggtcccctttgtaggaaactttttgctgcaactcctccagtttcttaatttgttgacgggtctgaagttgagattctgctaatgacgttatcctgccaataaattaagaaagatgctaattaccaaagtgaatgtatacaggtgagatggagaaggggaaggaaatactgaagacatggagaccactacaataagaacaaggaatttttttattgtggtgaaatatatatagcatgaaatttacaatttttcatcttaagtttacagttcagtgacattaagaaaagaggaatttttcaccatgttgggtggatgctgaaaaaataaataaaaaaagaaaataatttatttatttatttattttttgagctggagtgcagtggtgcaatctcggctcactgcaacctccatttcccgggttcaagtgattctcctgcctgagcctcctgagagattacaggtgtaagccactgcgcctggcctttttttttttttttttttttttgagatagagtcttactctgttgcccaggctggagtgcagtggcacagtctcagctcactgcaacctccgcctcccaagttcaagtgattctcctgcctcagcctcccaagtagctgggattacaggcacccaccaccactcccggataatttttgcatttttagtagagatgggattttgccttgttggccaggctggtcttgaactcctgacctcaggtgatccatctgcctcgacctcccgaagtactggcattacaggtgtgagccaccatgcctggccagaaaataatttattttaccttttattactagtcccttcctaaaatctcaaatttctaagagggggctgggcacacaagaagtattaaaatttataccactaggaggcattgatggagttatcactggaaaatgacaagcatctgagcccagatatgcagaacacgaaatatggaatttagcacttactttactcatcctaacttgtctatgaacataaagactcagaaaaagagattagacagctcccaaagatgggtttgagccagctctgtcacacactatctgtgcaagctttgccaggcccttcaccatcatgggccttagcatccccttgcatgaagagaagggcttgaactacatgagccctttcttttctttctttctttttttttttttgagacagggtcccactctgtggcctagtgcagtgcaatggcatgatcatagctcactgcctcctccaactcctggacatgagtgatcctcctacctcagcttcctgagtagctagaactataggtgtgtgccaccatgcctgtttagtttagtttagttttttgagatggagtctcactctgtcacccaggctgaagtgtaatggcacatgtctagttttttaaatttttgtagggatgggatctcactttgttgcccaggctggtctcaaactcctgggttcaagtgatcctcccgactctgcctcccaaagcattgggatttacaggcgtgagccacaacacccaatccccataagccttttcaatgtcagccttcaactgatcaaaggacatgacattatgtttcaaaatattgataacatgcacaaggaataagtgaatagagagggagaaaaagctcattaaatctatctccaagaatagagatattaggccaggtgcagtggctgacacctgtaatcccaaaaatttgagaggccgaggcaggtcgatctactaaaatacaaaaaaatagccaggcatggtggcatgggcctgtaatcccagctacttggaaggttgtgactaagaatcgcttgaacctgggaggaggaggttgcagtaagccaagatcatgccactgcactctaacctgggtgacagagtgagactctgtctcaaaaaaattaaaaaaagagagaagttagcatcattccatcattctttgatggtttatcactagtgtaacaaagaccaaaagaccagaaagacagaaagtgaaaggagagggagggggaccgctgcagggatttctgaactcctgagctcttttctggcacttctatcctcccattcccagaacttaagcttcttcgttccctggtcaggaagcatttaaaactgctttcagtaaattaacaacactcagggttagtgaggatatgaatagacaggcattctcatgtagagttgcgctaaatttccagtgcaggctctgtatctcaagtttctcctaaggcaagctggtgcaacatgctcactatagggccttgcacaggaagggttgcagtaagatatgctggatgaaggtaaaagtgcaaattacagaaaagcatataaaggaagatcctgggctgggcacggcagctcacatctataattccagagcttttgagaggccgaagtgggatgatcccttgagcccaggaatttgagaccagcccaggcaacaaagtaagaccctgtctctataaaaaatttaaaaattagccaggtgtggtggtgcatgcctgtagtcccagctactgagaaggctaaggtgggaagactgcctgagcccaggaggtcaaggctccagtgagccatgactgcataactgtactctagactgggtaacacagtgagaccctgactccaaaaaaagaaaaaaaaatgatcctaatataaactgtataaatttctatctttatgtgtatatacataatgtgtatatacataatgacagatgtctagattgagcatcaactaaattttaactactagtactgctgatgatttcatttaaaaattttttcttctcttgattaattttctgtatttgaattttttcccttaaaaagggcatgtgtcattttagattactaaaataactaaaattaaaaggtttgtctatctgttaaatacagttaaaccaaaagccttaattgaattattaagtaaaatatacttaaaatataataatataaatacattttttaaaacaaagtttctccaaataaagtaaaaactttattttatttttatttttttgagatggagtctcactctgtctcccaggctggttggtgtgcggtagtaagatctccgctcactgcaacttccatatcccaggttcaagtgattctcctgcctcagccgcccagagtagctgggactacaggtgcgcaccaccacgcccggctaatttttttatgtttttagtagagatgtgttttcaccatgttggccaggctggtctcaaactcctgacctcaagtgatccgcccatcttggtctcccaaagtgctgggattacaggtgtgagccacagcgcctggccgaaataaagtaaaaactttaattcttgggctaaatttgaatatggaaaagtccccacgttggagatatagtaccaattctgtgggcctgcagttaagatcagaattcaatctagctttcgagaaagaaaggaaaagcttctttcatcctttaccagttttctagccgatctaggcagatgttgggcgggcctccaatgcaggcaatctgttgccgcctcttccagtcagccagctcctcgtccgtgagagttttctgcacgtactccatcgctgacaaaagccccgccagctcactcacgatgctctggttggaaaccaaaacaaagtcagaaaacatttcctcagactgtctctaaccacattctttagtcaactccagagcaggaacttcttagaaaccaagcaagttctgccacaagacgctgaaatcccgcaagtgagcgagacacatgggggaagtggtccgacctatgcccttactctccgcatctggtccagcgcagtgagcatctgttccagctgctgcatcttctgcctggtcactgactggttgtttccattcagatcttgcatgtctgcgaaggaagaaaaaactccttgacctgagggaatactccttgacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactccttgacctgagggaatactcctggacctgagggaatactcctggacctgagggaatactcctgtccttaatgaccaggctcctttgaggacccgtacctcccttgcgccccgcccgccttaagatctaaacagagttaagacaaatgagtctttcaactcaacaacacaaactcactttctagagattttaacatctctaatattcacttgcctccttgactcttgagggttttatagttgaaatcaaagtcatcctggagattctctaccactttcattttctgttctagatcctgtttaaaataagcaaacaaaaaaacagaagtaaagaaagatttccttgggaacagaaaatataaagtttctgaggagaattcaaatgaagccaaaacctcaaaaaagatacatgcaggacctgcaggcagtatccccaagagaaggctccctgttggccaggtgcagtggctcacgcctgtaatgccagcactttgagaggctgagttgggaggatcacttgagcccaggagttcatgatcagcctggacaacacagggagacccccatctctacaaattttttttttttaattagctgggcgtggtggtgcatgcctgtggtcccggctacttgggaggatgaggtaggaggatcgcttgggcctgagaggtcgaggctgcagtgagctgtgatcatgccactgcagcccagcctgagtggcagagcaagaccctgtctcaaaaaaaaaaaaaaaaattaatgaaagctccctgcccgaggcttgtaacttgcatcacctgcactctcttccggacatcctgaaggtgctgctccagcatctgctgcttctccgtcaccacggctgctgtggggtggttggcctggcccccttgctgccaaaaaggaggtcaatgcacatgtgaacacagaactatggggagaggaatacctctacccagcttccatcccaccctaactacccttcttgtttggcttgagacgctgctgccatcacaagaggaagggaaacagaggcagtggtgctgtcactacacaggtgacactacacaggtcataccataaaccccctttatggcactaagagaccacatgttcagctaagacatggtctatgccttcaaaaacctcatgggcaagtatgtcaaaaaattcaaaacaatttatgacagcagatgttggatgtctacttaaacgtggtgtccagtatatttctgagggataataaaaaaaaagtcctgccctagggatgaaattccatattaaaagatattatcttggggagaaggggaggctggtaccttggaaaatgtcaaatagcacatggaaaaagaaaaagaagaaagaaggctggatgtagcagctcacacctataatatcagcacttgggaaggctgaagtgggaggactgcttgaggccaggagttcaaaactagcctagtcaacatagtgaggccccatctcgaatgaataaatgaatgaatgaattaaagaaataacaaaaaataaatagcatatgaaacttaaaaattacaggttcgtgccaggtgcggtggctgatgcctgtaatcccagcactttgggaggccaaggtgggcagattacctgaggtcaggagtttgagaccagcctgaccgacacggagaaacccatctctactaaaaatacaaagttagctgagcttggtggtgcatgcctgtaatcccagctactcgggaggctgaggaaggagaatcgcctgaacccgggaggtggaggttgtggtgagccaagactgcgccatgcactccagcctgagcaacaaaagtgaaactccatctcaaaaaaaaaaaaaaaaaattacaggcttgggctaggcatggtagctcccacctataatcctagcactttgggaaaccaaggcaggaggatcacttgaggctgggagtttgagaccggcccagggaacatagaaagagacctcatctcaaccaaaaaaaaaaaaaaatttttttttaactagctgggcatggtggcatatacctgtagttctagctacttgggaggctgaggtgggaggatcatttaagtccagaagtttgaggccacactacagccagttttatgggcaaccattctcttcctttcccatggtccctatccaagcccacagaatacaaacttcttagaagttttgggaaggtgacccatgcccctacttcttcccacagtgacagtgactcatctgattggtaagatggagagaaagactctgtgtacacacagatcttcaaagaacccagcacctaagctggtgcctccctcctctcactcttgccttcctagggcccaccataagcaagagcagcagcctggtttctagaagcaggtctagaggcctatccctctgccttgttggtctatggcagctgaagctccatatggatggctggggtggggtgggggtgctgctctgcacatccagtctctctaccccaagatctaactcagggcacaggcattggaaagcccctatggttaccagctcaagccacactttccattctagttttaccaacaatacagctgatgttttaaccttcattcctttctcatgtctatttctcaagcaggactacacttaaagggagaaaacatgattaacgatcacccacagaaacccacctctaataccttcgtaaaaaactgtattggctccccactgcttccagctataaacatctcaggccaacacagaaagctgtttcacacaattgataacttcaactttccctccctgtgccttggtcaccccagactcccaactcttccctgcatgcagtgtgtttccacactctcttcccacccgctatccactcagcatggcctgggcttcagcccaaacacacctgaactcactcaccttcaaattcagttcaaatgtttcttttcctgagaaatcttattcaacttccttagacaaaatgacacacatccttttctgtgtttttctcactttgagtgtttgtgtacttataatcccaactagcctgacagcccttggtagcagggattacatccactcttctatctttaaccaattctagacacttaagagcatgccaggtattgtaaacagaaaaaatagcagtgaggcctgggttgaggccacaaataaccaacttatagctttatatcaggggttgcaaactttttctctaagggacagagggtaaatatttttggtttcctgggtcatacagtccctgccacaaatagccctgccactgcagcaccaaagcagccacagataatgcataaataaatgagtgtggctgggttccgaaaaaacctcatttacaaaaacaagcagcaggctggatttgggccacgctcacagtttgcagacccctaatccgtacgattgaaaacatccttgggataactttggctttcctacctcccatggtaagttggagcctctatccaaattgacttaaaccacttatttttatcttgtggagcaggataaaatacaaaggttttccacagcagaaaatcctagtgctgcctgagcaaatgcctgtgtgctaacctcttgggctacagggcactgcacagtaagtgttacctaccacctcgctcacacctgagcatatcagttttctgcttaaaattcctcactagggccggacacagtggcttatgcctgtaatcccagcactttgggaggccgaggtggatggatcacctgaggtcaggagtttgagaccagcctggccaatatggtgaaaccctatctcactaaaaatacaaaaaattagcccagtgtggtggctcatgcctgtaatcccagctacttgggaagctgagacatgagaatcgcttgaacctgagaggcagaggttgcagtgggccgaaatcgcgtcactgcactccggcctgggtgacagagtgagactctgtctcaaaagaaaaaaaaaaaattcttcactgggtccccatttcctacagtaatggtgagggtgatgatagtgatgtcagcagcagcagaaagcagttaaattattttgcatttatgtgtcagatactgttctaagcattttacatgtatgaattaattctatgaagaaggtattgttatcactcccattggaggaacagagagagtaaaaattgtttacttaaggttacagagcaagtggcagggctgcgggttcaaaccgaagcagttggccccttgtggtaaactgctcttccagggccccactgttaggcatgactaattaaaacatcatgtggccttgactagcttgtcttccccgacccaatcagatgctgaactttctacacttctcccaagaatacacatttctgtttctgtctttgaacatgatcttctttctgcctggagagctctttctcatcagttgatgagcccaggagttcaacaccagcctgggaaacatggcaagagcccatctctaccaaaaaaaaaaaaaaaaaaaattagctgggcatggtggcatgtgcctgtagtcccagctactcataaggctgaggcaggaggatcgctagggcccaggtggttgaggctgcagtgagctgtgatcacaccactgcactccagcctgggtgacagagtgagactgtctcaaaaaaaaaaaaaaaaaacaaaggttacaaaggtaaatttgaaatgtaatgttatgtgtatttcaccacaattttttaaaaagcagggggtcacggagaaaaagaaaaaatgtccctgattataggatattaaagacggtaaaacccctcacagaaagtaaaaaagtctcctatgaccgactactttaatgatttagtatatgtgtttccagatattttcccatacataccaatagtatatgcaaattgcatacatttagttttactactatgaatcagatctttctttttttttttttttttttttcagtcggagtctcgctctgtcgcccaggagtgcagtggcgcaatcttggttcactacaacctccgcctcccaggttcaagcgattctcctgccccagcttcccgagtagctgggactacaggcgcgtaccaccacacccagctaatttttgtatttttagtagagatggggtttcatcatgttggccaggatggtctcaatctcttgacctcatgatctgcccaccttggcctcccaaagtgcttggattacaggcgtgagacatcgtgcctggcccagatctttactttcattacatcttctaacaggttactgctgctactgattaggggaactgcagattctaaaaatatttatcttgtatacaatggcctttctaaaccttgctagttccaattgttattgttagttttgtttctcttggatcttcgaggaagacctatctatctgtaaataataagagttctgtcccttgctttccaatatttgtaccctcatttctttttctttttgcataggctggatccctcagaaaagtatcaatggtaaaagacatccttatcttttgctgtttttactgagaatagtgtttcaccactgtgcatcatgctccctttggtttctgataaatattctttcttgtgtttagaaagatccttaattaagccaggtgcggttgctcacgcctgtaatcccagcactttgggaggccgaggcgggcggatcacgaggtcaagagatcgagaccatcctggctaacacagtgaaaccccatctctactaaaaacacaaaaaattagctgggtgtggtggcgcgcgcctgtagtcccagctacttgggaggctgaggcaggggaatagcttgaacctgggaggcagaagttgcagtgagctgagatcacgccactgcactccagcctggcaacagagcaagactctgtctcaaaaaaaaaaaaaaggctgggcgtggtggctcatgcctataatcccagcactttgggaggctgtggccggtggatcatgaagtcaggagatcaagaccatcctgcctaacaaggtgaaaccccatctctactaaaaaaaatacaaaaaattagccaggcttggtggcacacacctgtagtcccagctagtcgggaggctgaggcaagagaatcgcttgaacctgggaggcggaggttgcagtgagctaagatggcaccactgcactccagcctggacgacagagagagactctgtctcaaaaaaaaaaaaaaagagagatgaggtctcgctacattgccccagctggtctcgaactcctgaggctcaggcaatctgcccgtctcagcctcccaaagtgctgggattacaggcgtgagctactacacctggctgttttttaggttttgatatgaggatttttccagcctcataaaataagctgaaaacatcccttgttttcctatactttggaaaagtttgaatgatattggaataatctgtactatgaaagtttgtcagaacaggccgggcacagtggctcacgcctgtaatcccagcactgtgggaggctgaggcgggcggatcacctgaggtcaggagttcgagaccagcctgaccaacatgaagaaaccccgtctctactaaaaatacaaaattagctgggtgtggtggcacacgcctataatcccagctactcttgaggctgaggcaggagaatcacttgaaccctggaggtggaggttgcagtgagccaagatcgcgccattgcactctagcctgggtaacaagagcaaaactctgtctcagaaaaaaaaaaaaagaaaaacaaagaaaatttgtcagaacaaaacaaaacttttaaaccattgggtctgttggattcttttggtggaactttcttttttttagagtttttcaatgtattttggggggtggaactttctttttttttagagtttttcaatgtatttttatgattattgatctatttaatttcttttccttcttttttagtagatctaataatttatctcattataaagttgtttgattttccattcctcccagaccagggatttgttttgtctcaggtctcacctgggccgcagtggctgcagtctgtagaaggcgtgattcttcccacaggcaccgggccacaatccgggcaatctccattggcttctcaagatacctgctctataagtaggagagaaagagaataaaaatcagcagcagaccatggagatgtggactgaactgtggcaccttaaaactaatgtattcatcaaggaaagcatttattctaggaaacaacggaacaaaggcttcagagcctgggtgaaggctctctgtcggcggggggcgaaggggaggtcgttactatttctgtaacagaaggcacattagcctgagtcttttttttttttttttgagactggctctcactctgtccgccaggctggagtgcagtggcgcaatcacggcttattgcagcttcgacctcccaggctcaaacaattttctcacctcagccttctgagtagctgggactacaggtgcatgccaccacaatcagctagtttttaaaaaaaatttctgtagagatggtgtcttgttatgttgcccaagctggtctcaaaactcccaggctcaagcaatcctcccacctcaacctcctaaggtgttgggattacaggcgtgagccaccatgcctggccttgtctgagtctttacacagtatactatcctggtcttgcagggaagctactgacttagtcaagaagtatcccattatggtcaaacatttaacatgtaacagtgagagtcatcttcctatcagtggaccgcgttaacatgctaacatgtatgattaacataacaatcactttattacttcaactgtgacaagagaagtgattctcaggtaatgatgctcacgggtaagtatacagagctttgagaaagggctaattacttctcctgtgattgaaaatacaagatagattctcgttacttagccaaatgagaaaagagatgcttccaggaaagaacactaacacccgactctgcgggtcctgtttctccttgtcctcagtttctcatcatacctgaagaaactgcttgattcttcgtagattgtgctgatagagaacattcgactcttgcaggaagcggctatactgctggtcaatctctcccaggagattatgaaacaccaaagtggcatgtgattctttgctggccgcatatgccctaggaaaaggaagaatgataaagaatggctctgaagccgacgcatacacacaaacacagaaatcaccatcaagaaagaggaaaaaaacaaaaaaacaaagcaaacctgatgctataacccattcatcatgttagattcttcttgctcagcaataaaatgccatcaatgtaataattattaacaattattccaggccaggcatggtggctcatgcctgtaatcccagcactttgggaggctgaggcaggcggatcacctgaggtcaggagttccagaccaacctggccaacatggtgaaacgctgtctctactaaaaataaaaaattagccaggtgtggtggtgggcacctgtaatcccagctactcgggaggctgaggcgggagaatcgcttgaatccaagaggcagaggtgcagtgagccgagactgtaccactgcactccagcctgggctacagccagactccatctcaaaaaaaaaaaaaaaaaaaccacaaaacaaaaaaacaattattccagatattattacccactctcataatctgttgtatttgtaaaatatttgagcaaagtagacagatatgctgttttgctttaaaccctcaattaactctggtcagatttattagtacaaataagtaatcccaggctgggatggcctatctccaacatctgtgaatcacctcctggcccttcaccaaatcagagtatgcattctggaaaaaccaggtcatattaacactggcctgaattaaaccaaaatcagtagtgagcctgagcatattaaagtgaagaaaatagttgctggacatctgtgccattatctgctctatgaatggaatctacttcccttatcctgtgatctagtttggatctacatccctgcccaaatctcatactgaaatgtaacccccactgtttgaggtggggcctggtggaaggtgactggatcatgggggtgggtttctcatgaatggtttaataccatccctgttgatactgtcctcgagacagtgagttcttgtgagatctgatagtttaaaagtgtgtggcacctcccccttgctctcttgctcttgctgtggccatgtgacctgcctgctccctctctgccttccgccatgattggaagcttgctgaggcctccccagcagcagatgctgctatgcttcctatatagcctgcagaactatgagccgattaaacctcttttcttataaattacccagtctcaggtatttctttatagcaaattgagaacagactaatacacccctgtggctccttcctttaactaaaggggaattacaagtatcaacccaaagttctagctatgacagaattcacattcagagaaaaaatatgtctaccacatcactggattatcagaatatatagaggatctgcccaagtaaatgaggtccaaatcaaccttcaagacatccaccaccatacaggcggtttcaatgtgtcaaagacagttgcccacatgcccttctaagataaaaaaggctttacaagaccaaagggtgcccctttatctcctgatctcattttccccatcacctgtacccatacattttttaatggaacagcaaggcatgacattaagagttcatgtctcttgactcaaactgaaacctaacaatttggagagtcacttaagaaggacttaccaatcttgactctcaatccaaggggccagaaactgccgcagctccattgggaagctgtcactgtagagctgatggagctgctccaggtaccgtgtgtcaagctgctgtagctgattccattgggccatcctgctaaaatcaggggtcccaactgtaaaccaaagtgtgcatatgttcaccacaagtcccagtaggggtaaacaatctagaagtagccattgcccaacacaggtgtcaggtctgtgactagggataaagatgctctggggaggaccctgcttctttctcccagtttattttatttttaaaaaatagagatggggtctctattttttgcctgttgcccagggtggccttgaactcctggactcaagtgatcctcccaccttggcctcccaaagtgctgagattacaggcataagccaacacacccagcctgtttctcccagtttagaacaatacaaacacattcacaatccccaccttgggataatcacagctcctttttattattttttgaagacagagtcttgctctgtggcccaggctagagtgcaatggcatgatcatgggctcaagagatcctcccacctcagcctcccgaggagctgggactataggcacacaacaccatgccacactcattttttaaaaaatgtttcgtgagacaaacaaaacatgcccaggctggtcttgaactcctgggctcaagtcatcctcctgcctcggcttcccaaagtgctgggattacatatgtgagccaccccatctggccacacatctcttttacactgggatgacaagtggctattatgccaggttctagaatccattatctaccagaagtgtgtgaaattaaaaaattacttaactcccagatttctattcccttgtctataaaatagagataataattcccactcctcagaggtattgagatattcctacagcatccagctcagtgcatggcacataacagatgcccaacaaatgtcggttcctttctttctcctccacagcccttttagttatacacagtaaacctgtactgtagccaaaatgtagaaattggatgtttggggttgggggacagagcactaattccaagactacaggtttaaaagtataaatgaggatccaggaagatctgcctgagattctcctactcaacaaataataactattttaaaaattgcttagtctgggacaacagagaaggaaagaaaaatgccaggcataaaagttgtcccaggttcaggaacatcccagtgaaatgctctggtatgagaaacccagccagctaattacctgtaatcctctttctgaatagcatgggtcatggaaatatcaatagaggccaagttgttttaacaagttctaaaattaggccaggcgcagtggcttacgcctgtaatcccagcactttgggaggccaaggcgggcagatcacctgaggtcgggagtttgagaccagcctgaccaacttggagaaaccctgtctctactaaaaacacaaaattagccaggcgtggtggcacatgcctgtaattacagctactcaagaggttgaggcaggagaattgcttgaacctggaaggcagaggttgaggtgagctgagatcgtgccactgcattccagtctggcaactagagcaaaactctgtctccaaaaaaaaaaaaagagaagttctaaaaataattacaagtcagagccaaagatgaaggtatgtacagaccaaggtccaatgagatggttctctgggatagtgagaacatttaatgagagactgaacacacgcaaacatactagagttcttgattctcagagaaggcacgaagaagcacctagttagcactggctttttcataaaaatgactgagcaaactggcaacaaaaccagcaggtcttctgttctcaaggcagcaaatgtaacggaatgaaaggtgcgatcgtggaacctctaactcctgcaacctctaactcctgggctcaggcaatcctcctacctcagcctcccaagcagctgggagtacaggcagcattgctgcacctggctaatttttttaaaaaaatttttgtagagatagggtcttcactgtgttgcccaggctggtctcgaactcctgggcttaagcaatcctcctgcctcaacctcccaaagtgctgggattacaggcgtaagctaccacgcctggcctgggatcaggttttctgacagaacctgagagggctgcacttctccctccctctttgggggacagactcagaatacccctcttgctactgtgaagacggctggtggagctctcaagcatatattcagggaagtgcaggtagtacctcccagcagtctttacattgaataattaataatctaaggcagcagcatccaacagaaatagaatacaggccacacatgcattttaaattttctggtagccatacttaaaaagttaaaagaggctgggtgcagtggctcacgcctgtaatcccagaactttgggaggccaaggcaggcggatcatgaggtcaggagatcgagaccatcctggccaatatggtgaaaccccgtctctactaaaaatacaaaaattagctgggtgtggtggcacatgcctttaatcccagctactagggaggctgaggcagaagaatcgcttgaacccaggaggaggaggttgcagtgagccgagatcgtgccactgcactccagcctgatgacatagcgagactccatctcaaaaaaaaaaaaaaaaaagaaaagaaaagaaacaggtgaaattaattttaatgtattttatttcatttaatatatccaaaatgttattgcaacatatgaacatacaaaacatattattatttatttatttattttttggagacaggcactctgtcacccaggctggagtgcagtggttcaatcacagctcactgtagcctcaacttcccagctcaaacgatcctcccacctcagcctctcaagtaactgggactacagatgcgcaccacatctggctgattatttttgtagagacggggtcctactgtgttgcccaggctggtctcaaactcctagactcatgcatctcagcctcccaatgtgccaagagtataggcttgagccaccgtgtccagcccacaaaaactattaatgagatactttacactcttttttttgctacgaagttttctaaatctcctgtgtactttacatgtgcagcacagctccaaggtattttccctcctcatgtatcaagggcttaaattccactggtgaaaaagctcagtaaagcaaatagagagaatgtcagaataaggtatttgccccaattaggccaatacgcttctataaattaactaaatattccaacaatgttattttgttgttattgtttttgagatggaatcgcctaggctggagtgcagtggtgcaatctcacctcactgcaacttcagtctcccgggttcaagcgattttcctgcctcagcctcccaagtagctgggattataggcacgcaccaccatgcccagctaatttttttttttgtattttttagtagacagggttttaccatgttgcctaggctggtcttgaactcttatcagttcaagaccagtctggccaacacagtgagatcctgcttataattaattaatttaaaaatgtaggctgggcacggtggctcacacctgtaatcccagaactttgggaggccgaggcgggtggatcacgaggtcaggagttcgagaccagcctggccaacatagtgaaaccccgtctctactaaaaatacaaaaattagccgagcatggtggtggccgtctgtaatcccagctactcaggaggctgaggcaggagaatcacttgaacccgggaggtggaggttgtagtgagccgagatcgcaccactgcactccagcctgggcaatacagcaagactccctctcaaaaaaaagcaatgttacttgccaccttccaccctaagattcacctgccacaggacaaatgctgcctgggcagtggtacaggtacactaagcactagccagagtaaaagcagtggctgacgtgcatactatatgctgaagcattgtaaccatggcatgtattgattgccctctgtaagaaatcaaaggccattagatctctcttacaatatttgcattagggccaagttaaaatctgcctcacatggaggttgcagtgagccaagattgtgcatctacactccagcctgggtgaccaagtgagactctgtctcaaaaaaaaaaaaaaaaaaatctgcctcatagactaaaagcatcatgacctgacttatgctatgcaagaactgatgtgcatacaaagaaatctgcataatatgccaatttatgtagattctattgcatacaaatttactgaaactctaaacctacacagtccagtatggagtcactagccacatgtggctactgagcacttgaaatgtggctgcttcaaactgaactatgctgtcaatataaaatacacactggattttgaggacttagtgaaaaacaaaagaatgtaaagtatcttgttcatgttgaaatgataatattttagatatattgggttaaataaaatatattattaaaattaacttcacccatttctttttacttcttttaatatggctactagaaaacttaacattggtagggcatggtggctcatgcctgtaatcccagcacttagggaggccaaagcatgtggatcacccgaggtcaggagtttgagaccagactggccaacatggcaaagctccatctctactaaaaatacaaaaattagctgggtatggtggcacatgcctgtagtcccagctactcgggaggctgaggcaggagaattgcttgaacccgggaggcggaggttgcagtgggccgagatcgtgccactgcactccagcctgggcaacagagtgagactgcatatcaaaaaaaaaaaaaagaaagaaagaaagaaagaagagaaaagaaaagaaaagaaaaagaaactaaaagaaaacttaacattacatatgtgacttggatcttatttttattgaacactgctactctagacaatgtagccaaaaagcggtggttctcctaaaaaaaaatgatttaaaaaaagaaccaactgctttttgtaataaactccagtgtttaaaattaattttaaaaacagactttattttttgagacagggtctctctctgtcacccaggctggagtgcagtggcaaatatagatcactgtaacctccaactcctgggctcaagcaatcctcctaactcagggacctgagtagctgggactaggggcacaagccacaatgttcagctaattttttgtagtttttgtagagacaaggtctcattttgttgcccagactgatcttgaactcctggcctcaagcgatcctcccacctcagcctcccaaagtgctgggactgcaggcatgaggcatcatgcccagccaaaaatagactatttaattatttgtcttggatacaaatgcagaggcatcacagtctactccctgaaggtccaaattaaatcatgaaacagcatcccactatacctgctccatcatagattaacactggggtcatgcatgaatatttgcattttcaaactaacatatcctaaaaacgtgtaagttattgaaaattatctaattcatttccagtacataactaaggattttttggttgttgctgttcttatttttagctggggacagaggagggctagtaagtagtacaataattgtgttcttttttttttttttttttttgagatgaaatactgtcacccgggctggtgtgcagtggggcgatcttggctcactgcagcctccacctcccaggttcaagcgattctcctgcctcagcctcccgagtagctgggactacaggcatgccccaccacgcccggctaatttttgtatttttagtagagacggggtttcactatgttggccaggctggtctcaaactcctgacctcgtgatccgcccgcctcggcctcccaaactgctgggagtacaagcgcaagtcatggcacccggcctgtgttatttcttaaaacagaaaccagctagtagttttttccataaaattaaagcaccaggctgggcacagtggctaacacctataatcccagcactttgggaggctgaggtgggcggatcacaaggtcaggagtttgagaccagcctagccaatatagtgaaaccctgtctctactaaaaattcaaaaattagccaggcgtggtggtgggcgcctgtagtctcagctacttgggaggctgaggcaggagaatcgcttgaacctgggaggcagaggttgcagtgagccaagatcgtgccattgcactccagcctgggcaacagagtgagactctgtctcaaaaaaaaaaaaaagaaggcaccagggcaccaacaatgactgatttcatgttttacttcttagtctaatcaccataggtaatactttaatagttattctacaggggaaaataaaagtataacttaaagccaaagaccaggtagtattttcaaggagagaatatgcaaatacttccatagtcttctccttacaggctgcttagctacaaaccatatttaattaacagcagtcacaggagatgactagccaaagtgtctaggaaaatcactgccaagcagctttactgtaactgttttactggaaaagacctcaaagagcccatgttatttcacaatttcaattttggtttttcaaattacaagttaatctaaagaactccactaagttctaactacattacttcatatctacggaataattctaagcctgtgggtttttaaaaaaattttattagacattctagaattgggcaacacttcattcaatgccataggatgaatgttctccccaagcctgtgacttaataactacttcattgagccccagaacacacaaagttatctgaggaacaacttgagtgccaactaccactctgggtgcataagagagaagacaattcattactccatataggctgccttaggacattatatggggctcaattcaaagcatttactcaggttaagtcagcagatagtagatgcactgtacaaaggcaaggtgggtgtaatcctgttttctataactgaagagaaaagaaaaaaatgaaacagcaagtcatcaaagactttttggacttttcaaaacaggaatttctcagtcccttggggataacctaccaacagcaagtcataaaacaaataactattgtctaattgggaacttattaccgtaaagatgactgaaaaagtctgtccaaagttacagttctcatttatatacttgaatctaatgaaaccaaaagatatattgagaaacgcagtcaagaccacttacaaaagggatttactacacagcttcataaaactttttaaagttaagacttgtacttcacatccatgcactagtggatttacaacgagggtgagggaaggcggaaagagagacgaaaatcaggctcatacaataatccagaacagaaagtgatctaaagataacttctgttccactttgcaatgtgtcatgacattttcctttgggtaccacctatacttttattataaatacatgcattttaaatagagcatacctgtgttttatctgctgcctacactaacctcttctttgctgtcaggaaaggcccagtgatcaaggcaaccaaagtataaagaaacacagaagatttcttgcactgaattctataggaaccagtccttttaagagatatgtttgaaagattataaaataatgttcaatgtggaaaatttagaaaaatataaaaaagaaaataaaagataaaaacatccatatcccaccatcccactatgcagaacaaaaactgacatgttgccaggtgtggtggtctgtgaccccagcactttgggaggctgaggggggaggatcacttgaggccaggaagtcaaggctgcagtgagctgtgattgcaccactgtactccagcttgggtgacacagcgagaccctgtctccgaaaaaataaaaattgacatgttgatgtaattcctttaaatctatttcagaatgtgtttgtgtgtgtgtatatatatatatatatttttttttttttacattggagtcatagcattaatacagctgcatattcttttaaagtttattgtgtagtaaacatttttctatgaaaagagtattgtgtttgtttgtttgtttgttcaaatagagaccagctgcccaagctggtctcaaactcctggtctcaagcgaccctcctgttttggcctcccaaagtgctgggattacaggcgtgagccacagtacctggcctgaaaagagatgttttgttattgttgttgttgttgtttgagacagaatctcactctgttgcccaggctagagtgcagtggcaccatctcagctcactgcaacctccatctcctgagttcaagtgattctcatgcctcagcctctggagtagctgggattacaggcatgcgccatcatacccggctaatttttgtatttttagtagagacggcgcttcaccatgttggccaggcttgtcttaaactcctgacctgaggtgatctgcctgcctcagcctcccagggtgctgggattacaggtgtgagccactgcgcctggcctgaaaagaaatttttatttaaagcgcataaaagaactattttgtttctattggtgttttcaatacaaccctgctaatcccactgagggccacataatttattaagatttggaaaccccaatttatttgttctcaccataccacgttctaaaaataatctgaagtatctgcaagtagattaggaaggaaaaaaatgagaaaagtaagagaaagcaattcacgctagagaaaaacattcaatcttcataaaattttcaccacaggataaacagcataatggatgacagagagtccacattaaaatactgtaggccaggtgtggtggctcatgcttgtaatccttgggaggctgaggagggtaggtcacctgaggtcaggagttcgagaccagccaggctaacatggcaaaagcctgtctctactaaaaatacaaaaattagccaggcatggtgaaatacacctgtaatcccagccacttgggaggctgaggcaggagaatcacttgaacccgcgaggcagaggttgcagtgaaccaagatggtgccactacactccagcctgggcgacaagagcgaaactccatctcaaaaaataaattaaataaataaataaataaatactgtagctttaaactattagagtcattcataatttaaccattcataattactctagacattaagaatggaatttcaagtttaaaacataactcaaaataagtacacttatatagtaagcacacaatttcatagttttaagtccaaatagtacctttgtaagatttaagactagatacttgcaataagaagtctatatataaatctagttttgatttcctaaagagacaaaatattaacacttgagtgcccaatctgaaacaaattactataattactgtaatgttcaattacatataacaggatttgctttaaaattaaaaaccaatgacgatcaagcttgtaaaaatgaacatcaatctataagaaaacttgagttatagttccctactaatatgacaaaatttgaatatatgaaagaagtaaaggccaggcatggtggctcatgcctataattctagcactttgagaggccaaggtggaagagggattgcttgagctcaggagttcaagaccagcctgggcaacaccgtgagaccttgcctctacaaaaaaatttttttaaaattagcctagcatggtggcccatgcttgtagtcccatggaggctgaggcaggaggatcacttgagcagattgagactgcagtgagctgtgatcataccactgcgctccagcctgggtgacagagctagaccccatctctaaagaaggagcaagagcttaacaaacctaattccctctaaattaaaagtaacaaacatgatttgtcaattactgagtgcacagttgattgttaaagctgcctaagaacaggtctgagctctacaaaaactaaaactaaaacaagaaaacccacaaaacagaccaaatttgtgcatcagatgacctccccacttgggaacacttccacttccccaaccagacacattcctctgtatcagtgtggtgtgggggaaaggacagtagagacgggagctggatgggcctgggtgcaaaaccctgcctgacatttattagctatttgtctttgggaatggtatttcactaccaaatgggctttctcttcagtaaaacagggaactctctctcctttgaagaactgttgtaaagttaaaatcaataatggttgtacagcatccctctgtgctggtgctgctggtgccagatcctcagagctgcagttattgttcctttcccccagggtctccctttcatggacatttcttactttttttttttttttttttgagatgtagtctcactctgttgcccaggctggaatgcggtgggcacaatctcagctcactgcaagctctgcctcctgggttcacaccattctcttgcctcagcctcccgagtagctgggactccaggcgcccgccaccacacccggctaattttttgtatttttagtaaagagggggtttcatcgtgttagccaggatgatctcaatcacctgacctcgtgatctgcccacctcggcctcccaaagtgctgggattacaggcgtaaagccaccgcacccagccagatatttcttatcttaaacccatttccttagtgtcctggaaagcaggttaatccatcagattcactaggggttaagtgtgataatcactaatcagctttccctgctaagtaaaatacatgcatttcaatgcacactcttatcatatcgggagggaaggagtcagtgatgctgtgatttggcatgttaatttaaggagagaagggaggtcaggagagctgggtggtgacctgatcaaatatctccatacgtatttcacctaggatggctctaggtcctaaaaagagtaaaaggtgaaaacactaagtgatattcaaaacaaaagaaaaagatgaaaaataagaaccttggttaaagagcagtcgaaataagtaatgattatagctatgatttatatagcactttttacaagaagccaggcgctgttttaaacacttgacatacttatttgctcatttcataattgtaacaaccctatcagataggtactatttttatcccactttacagaggagaaactgaggcacagaattttaagtgatttggccgggtgcggtggctcacgcctgtaatcccaacactttgagaggctgaggcgggtggatcacgaggacaggagatcgagaccatcctggctaacacggtgaaaccccgtctctactaaaaatacaaaaaattagccaggtgtagtggcgggcacctgcagtcccagctacttgggaggctgaggcaggagaatggtgtgaacctgggaggcagagcttgcagtgagccgagatcgcgccactgcactccagcctgggcggcagagcaagactccgtctcaaaaaaaaaaaaaaaaaaaaaagatttttaagtgatttatccaaagtcacaacacaggtagtaaaggcatggagctggaatcataacgcacagtctgttttcggaatgtctgttcttcaccactataggagtcttgttttttcttttttttaaattagagatggcgtctggccatcttgcccaggctggtctcgaactcctaggctcaagcgatcctccagcctcagcctccaaaagtgctgggattacagatgtgacccaccgtacccagctactacaggagtattagaaagtgggaattttggccaggctcagtggctcacgcctgtaatcccagcactttgggaggctgaggcaggtggatcacctgaggtcgggagttcgagaccagcctgaccaacatggaaaaacctcatctctactaaaaatacagaattagctggccatggtggcacatgcctgtaatcccagctactcaggaggctaaggcaggggaattgcttgaacctgggaggcagaggtggcagtgagccaagattgtgtcattgcattccagcctaggcaacaagagcaaaactccatctcaaaaaaaaaaaaagaattttagttgatttttaagtaacccacaaaccaaccattgtaactagccaatgtgatcttatggtattttaatagacatactagtacttggattttgaaggatctagtagtctagctgtaacagacccacatctggatgctattctaattctgtgtatcaaaattgaaatggaacactaaaacaaccaaacacatccagggagggacaaccagggtgtgaggagttgaagaccttgaatattttgctcagcaagaagatgcaggcaacaggagtgaggttaggagagaaaaacatgaattacagaagagtggcccctcaaatacctggaaatctgtacgagaaaggataaatcactctaggactagaacctgtctcctcacaacatcttctcccaaattcttccccatgaagtaatacagaggtctccaccctggctgacactaaaaaatatatacagcaagaaagatgcctgggaaccaaaccagtgccaaattggaacctctgacagtgggaccaggtttcaaatttcgaaagctacggctgggcacggtggctcacacctgtaatcccagcactctggggggcctaggtgggtggatcagctgacgtcaggagttcaaaaccagcctgaccaacactgtgaaagcccacctctactaaaaaatacaaaaacattagcaggcatggtggtggatgcctgtaatttcagctacttgggaggctgaggcaggagaatctcttgaacccgggaggcggaggttgcagtgagctgagatcacgccattgcactccagcctgggcaacaagagcaaaactctgtcaaaaaaaaaaaaaaattcctcagatgatgctaaagtgaggccaaagaataataataaattttttcgtgatcattaataaatataacgagaacctcgaaatcagagcagagatcagggctcaactctgaatacgcctcagaatctcctgaggagctctacaaagccaggtgccagttcttagcccagaactagcaaataataatctccagggttctaatgaagcagtacactgtagagactgtacaaggagaccacggcagaagaggaggctggagaaggctctcctgtcaagatatctgcactttcttccaagggcaatggggtaagtctttgaaaagctttaaacagacaagtgatagtttgatttacatttcaaaaagatccctcaggctgcaataatcctggtgggaggtcgtggctgcccaatttaggtagcagcattgtaagtgttttgaggcagacatccatcttctgtgacattacagagctacatgtgatgggacttggtgactgactgaagggcaaaggtgactcagagaaagggaggagtaagtgacaacctcccaggttcctgtggcatttggtattcagatggcggtcacatgctcagcatggtaaatgtcatggcaggagtgccaacattgagagggcaattgggccacacagtctctaaaaactgtttgttctataaattactgtcaagctcgattccctcaagacattacagccacagcaactcaaaataatactgtaggaaaagcaagtagatatttaaccaaaaagggttcagggtttgtactccagctgaatggtaaaacctgccatcccctcaggaaaagaggcagaggcaagagaaaaatcaggcagaaacatcagagccaaaatgcatagggggccatggcaagagctgttaactgtctcccaacatctgtgtgcttgcctccaggccattttccacactgtgggtagagagaccttttcaagacacaaacttgatcttgccacacccctacttaaaaccctcctgatgactgctctgttcttaggctaaaaaacaagatttgttatcttaaggcagaatagcatggatttgaatcctggttccaccacttcgatcacttagcgtgtagctggtgccagttatttatcctctttgtgccttaatttcctcatctatagaaaggggagagaacagtgcttacctcacagggttgctgtacaaattcatcgagctaatgaacacgtagcactcaggagcccaatagcgtgcagcatgtaagtgtttgtactcattactagcatgaccgacatcctggctggctctgcccctctcgtatggctggtaccagctggtggctaagttcctggcactcactctgctccttcttcaggtcctcaaaaacaccaggctcctgcctgccactggccctcacacatgccttccttctatcaccatcaccatgacttgcacccaagtactgtgactccattaacttggactcataaccactatgctggactgaaagccccatgaagacaagaagagtcttggcttttgctcactagcgtgtcctaccctgaaccctggcatccagcatagtgtctggctcataataggtgctgaaaaaataggtattgaatgaatgaacgactggagtgaattacaactaaagtgtgtagccaggttctcccaagtgaggacactgcgcccaattagaaaatattctgaggaataggccaactcttccagttttgctgtttgaaaaattcaagaatgatcaagaatcactgattcaagaataatccttcagtgattcttcaataagagtaaaatcacagcactccccagctcaaaaacacacactaacatctcattgtccaatgcaaaatctttacccttatctcaggctctgtaactactcagccaactttagccccttccagttcctctctccagcctacagatgactttcattttttgagacagggtcttgctctgttacccaggctggagtgcaataatacgatcacagctcactgcagcctcaacctcctgggctcaagcaaccctcccacctcagcctcctgagtaactgggattacaggcacatgccaccatgtctggataattttcttttttttttttttttggtagagactcagtctcaccatgttgcccaggatggtctcgaactcctgggctcaagttgtcctcctacctcggcctcccaaagtgctgcgattataggcatgagccatggcacccagcctccaggtgactttcataagtgttgtcttccttcaagtcaacttatctcctccttgccccccacccacagactttgttcctttttcatatttgttcttgcctaaaatgcttttttctctgggtggcgttatccatccctttcttgtgtctgtcagacaggctctccctaaccccacccctagtccaatgactgctttcactctgaatccccacggtacatatataagcatctgaggctctttcctattggctttgattctacctccttcacttgaggagcagctctctgctggcaaccacgtaccatcctgatttagaacttcccacaggctaacttaagacaccaaataaacacttgcacacacacataaccaccacctcccattacagaagtacacctcccctactgaacagatgatggccacgatactgaaaagcatggcatcaacatgacaactgcatcctgaaagatcagcctatatataggtttggttatcttgaatttcgagtttggagagaagcaaagtatttttctaataaactgtgaatgctgaggaattcaccttcataggagtcagaaacaggctgccaaacttttcaaaagaaaaacagtggtaggttgagcaagcacattgtcatgtcagattttccaggctcgagggccactgaagggagaagagcgagtagctggaaaaaacctgtgggtactgttatctttggccaaagctcaaataaaagaatcacaaaaacatccactgatctaaaatgctatgtaagtcattaatattcatctaagagaggcaactgaaataaagcagataaagagaacttaagccattctcttacctcagcctcccaagtagctgggattacaggtgcccgccaccacacctggctaatttttgtatttttcgtagagatggagtttcaccattttggccaggttggtctcaaactcctgacctcaagtgatctgcctgccttggcctcccaaagtgttggggttacaggcgtgagccactgcgcctggccaagaatttaaatttctgagtctcaaagtcataaacctataatatggctcaatgcttacctcagtgcttactggagagaaggaagattcttttctcaaatttattcaggtcactttccctatacgaaatactaaggtagtcctggtcacttacatggaacaatatacctggggctgacgatgcttggatatatagaagtccttcagtcaaaggaactatgaacttttgaggcagaacctcaaattcagaaggcatttgtggtggttggataacatggccctaaattctctcattatgccccactctctgagaggagggggtctttgttcccttcctttgaatctagctaagtccataactgttccaaccaatagagcatgctgaaagcggcgagatgtcatttccacctgatttcattggaagtctcattctccagaaccagccacattctgtgagaaacccaaggcaaaaggggaggccacaagtaggcacgtggtctacagtctcagctgaaatcagcctttgagtcatcgcagcccagacatcagatacaggagtaaagaaaattccagatgattattacccccagccgcttgagttttctcagtgagacctcagacatcgcagagcaaagacaagccatccctgctgttatctaaattcctgcccacggcatcttcgaacatagtcaaatgattgctgctttaggccactaagtctgagctggtttattgcattcggcaactagaacaacatttttactaacatagtgattgaatgtagacttaataatgaaagagtccaacttccataagaaaaaaattcataattttaaaggaagaggctttgctgttaaagttttttttttttgtttttttttgtttttttttttgagacggagtcttgctctgttgcccaggatggagtgcagtggcgtgatcttggctcactgcaacctccacctcccgggttgaagtgattctcctgcctcaacctcccaagtagctgggactacaggtgcccggtacaacgcctggctaatttttgtattttcagtagagacagggtttcaccatattggccaggctggtctcaaactcctgaccttttgatctgcccaccccagcctcccaaagtgctgggattacaggcatgagccaccgtgcccggcctgttaaagctattttaatagtaaacttattttctctatgcactcctttctaaattattcagccccactttctttcaaaacaacgtttatacactgacaattctcaaatttatgtctctagccccatccgctaatatgaacatcagacacttatagccaactgcctcttcaatatctccacctggatgtctaaaatgcatgtcaaacttaatgtatccaaagccaaccccttcattaaaaacctctcccagccggcttctcctccagtctcccccattctagcaagtgacaactccattcctgcacatgttgaggctaaaaaccttgaaatgagccttaacttcaactccagtctctctctctcttcctccccctcctcctgccacacctaatccattaacaaatcctgttggctctgtcttcaaaatctggaagtgaccgggcacaatggctcaggcctataatcccagcactttaggaggctgaggcgggtggatcacttgagctcaggagtttgagaccagcctaggcaacatggcaaaaccctgtctctacgaaatatacaaaaattagccggatatagtggcgcaagcctgtgatcccagctacttgggaggctgaggtgggggtatcacttgagcccaggaggcggaggttgtagtaagctgagattgcaccactgcactccagcctgggagacagagtaagatcctgtctcaaaaaaaaaaaaaaaaaaaaaaaaggaaggtgagcctttctcacaacctcccactgacgcagccttaatccaggccaccagcatctcttacctagatagctggactaggctaactggcctggatgctttcatccttgtccctctaccttctattctccacattacagatcctttcaaaataagagtcctggctggcacggtggctcaaacctgtcatcccagcactttgggaggccaaggcgagcagataaattaaggtcaggagttcgagaccagcctggccaacaaggtgaaatcccgtttctactaaaaatacaaaaattagccaggtgtagtggcaggcgcctgtaatctcagctactcgggaggctgaggcaggagaagttgcttgaaccggggaggcagaggttgcagtgagctgagatcgcgccactgcactccagcctgggtgacacagcgagactccgtctcaaaaaacataaacataaaaataaataaaaaataaaaataaaaacagaaattcgccggcatggtggcccaagcctgtaatcctagctactcgggaggctgaggcaggagcatagcttgaacccaggaagtagatgttgcaatgagccgagattgcgccactgcacttcagcctcggcaacagagcaagattttgtctccaaaaaaaaaaaaaaccagagtcagatcatttcattcccctgctcaaaacccactcaggaaaaaatccaaagtcctaccacggcccaccagtcaatccattttgccccagatgtctctctttgcctccttccctacaactctccccttgctcacagctgtcccctctctgctcctggaacacaccttgcccgtttctgccctaggactcttctctccacctgataggctctttccctagatatctccatggcttgctccctcacttcgttcaggtctctgcacaatgtctcttgacacccctctatctaaaacagcaacatctcccctgctgaattctcctttacagtactcatcgccctccattgttcatatatttcttttttcatgtatctccttccaatatgatcaactaggaacttaagccccataagaacaaagacattcttcagttcactgctatttccccagcaactacagaatgctcaaatatttgaataaatgaatgaaaattaagtaagtttttcaaaaatctagaacacacttttagcatagagaaaactgaagtaccataggaggttaattcacttcatataacagcataaactgcccttccttaagtaggagacaataggtacaataatgcatgcaaatgttaagtggtaaagcaaacatacaaagtttcccaatagaagagtttaaattaaaatctaaacttccagccaggagcagtagtggacgtctagtcccagctactcaggaggctgaagcaggaagatcacttgagcccaggaattcaaggccagcctgggtaacataggaagaccccatctctaaaaacataaaaataaaaatctaagcctcaaaagaaaaaaaataaataaacaaaaggcatttcctataaagttaaactgttacagaattgtttttcttaaactgcaataatgagactttagcactctcttgtcctctaaaagacattatttcatgacatgtgcccattggcagtatttgagaatctaagaaagtagatcacactaaatattgatatgcagacactaaaatcgtacaaccacttggatgactaggtttgagatattcccaaagtgacaggtttttgttttgttttgttttgttttttgagacaaggtctcgccctgtcgcccaggctggaatgcagtggtgcaatctcagctcactgcaacctctgcctcctgagttcaagcaattctcctgcctcagcctccctggtagctgggactgcaggcatgcaccaccacacctggctaatttttgaatttttagtagagacagggtttctccacgttagccaagctggtctcgaattcctggcctcaagtgctctgcctgcctcagcctcccaatgcaaccagcctttttttttttttttaacttttattttaggtttggggttacacgtgcaagtttgttatataggtaaactcatgtcagaggggtttgttgtacagcttattttgataaaatattaagtattaagcccaatacccaatagttatcttttctgttcctctccctcctcccactctccaccctcaagtaaaccccagtatctgtggtttccttctttgtgttcacaagtccttatcatttagctcccacttataagtgagaacacgtggtcttcggttttctgttcctgcattactttgctaaggataatagcctccagctccatccatgttcctgcaaaaacatgatctcagccgagcacggtggctcacacgtaatcccggcactttgggaggccgaggtgggaggatcatgaggtcaggagttcaagaacagcctgcccaacacggtgaaaccccatctctactagaaatacaaaaattagccaggcatggtggagggcacctgtaatcccagctactcgggaggctgaggcagagaattgcttgaacctgggaggcggaggttgcagtgagctgaaatcgtgccacctgcattccagcctgggcaatagagcaagactccatctcaaaaacaaacaaacaaacaaacaaacaaaaacatgatctcgttgttttttatggctgcatagtattccacagtgtatgtaccacattttctttatccaatttgtcactgatgggcatttaggttgattccatgtctttgctattgtgaatagtgctgcaagtaaatctctttaaacagcaaatctattactgcctgcttttcaatgctttaccctcaagaaacttgggctacaactcaataacaaaaagcagcatttttgttcttgttgtttttaattcagtttcttttttttgttttgttttgtttctaagagacagggtctcactctgtggcccaggctggagtgcagtggcaggatcatagctcactataacctcgaactatcaaactcctgggcctaagtgatcctcccacctcagcctcctgagtagctaggactacaggtacatgctgccaaacccagctaattaaaaaatattttttttttggtgatgaggtctatgttgcccaggctggtctcaaattcctggactcaagcgatcctcctgcctcagcctcccaaaacattgggattatacagatgtaagtcactgcactttggccatgtgttggttttttgttgttgttttttgagacggagtcttgctctgtcgcccagactagagtgcggtggcgagatctcggttcactgtaacctccacctcctggttcaagcgattctcctgcctcgcctcccgagtagctgggattacaggcacccaccaccatgcccagctaactttagtatttttagtagagatggggtttcgccatgttcacctggcctcaagtgatccgcccaccttggcctcccaaagtgctaggattataggcatgagccaccacacccagccttttttttttttgagacagagtcttgctctgtcgtccaggctagagtacagtggcatgatctcggctcactgcaacctccgcctcccaggttcaagcgattctcctgcctcagcctcctgagtagctgggattacaggcgcctgccaccacacctggctaatttttgtatttttagcagagacggggtttcaccatattggccaggctggtctcgaattcctgacctcgggtgatctgcccatctcgggtgatctgcccgcctcggcctcccaaagtgctgggattacaggcgtgagccaccgcgcccagccatcttctcatttctttggtgagattgtttggtttttgcttctgaagattttcctgtttttctttttttgtttttttttttaagagacagaatcctgctctgtcacccaggctgaagtgcagtggcgcgatctcagctcgctgcaacctccgcctcccaagttcaagcatgcaccacctacaggtgtgcaccacaacacccagctaatttttttttttttttttagtagaggtggggtttcactacgtattggccaggctggtctggaactcctgacctcaggtgatccacccaccttggcctcccaaagttctgggattacaggcgtgagccaccacaccgggcctccctgttaagcccagtttatccagtatttctaggtgttttgtacaaaagagttttcagggcatttagcctaacataaagcagaaacaaaagtcaggatgagtcaagtaacagtatttgagaaaacttcagaggtagaaccaacaggatttgctgatgctttgaatgaaagcagagataagacagaacagggaatttaaggatgattcctagatttctggcttgcacaaaggagtagatggtggtctaccatttatttagatggggaagtcagacagggagagaggcacaaacttgcagagagaaaagtttaagagttatattttgggcaagtagacaggagacaactacaagttacttgagggaagatgtcaagtttgcagcaggatgcaggagctgggagcccagagcgactgggtggagggccacacttgctagtcatcacagcggctaacacgtcttcacagtaaaagccaaaacaggcggggcacggtggctcacacctgtaatctcagcactttgggaggctgaggcaggcggatcacctgagaacggggagttcaagaccagcctgaccaacatggagaaacctcgtctctaattaaaaaaaaaaaaaaaattagccaggcgtagtggcgggcgcctataatcccagctactcaggaggctgtggcaggagaatcgcttgaactcaggaggcggaggttgcagtgagccgagattgtgccactgcactccagcctggtcaacaggagcaaaactctgtctcaaaaaaaaaaaaaaaaaaattgaggccaggtgcggtggctcatgcctgtaatcctaacactttgggaagctgaggcaggtggattacctgagctcaggagttcaagaccagcctgggtaacacagtgaaaccccatctctactaaaatacaaaaaaattagcagaacatggtggcgtgcacctgtaatcccagctacttgggaggctgaggcaggagaatcacttgaaactgggaggcggaggctgcagtgagccgagattgcgccattgcactccagccagggcaacaagagtgaaactgtgaaactctgtctccaaaaaaaaccaattttaataggtataccattatacacccattaaaatggctaaaatccaaaacactgacaccactaaatgctggtgaagatgtggagtaacaggaactctcactcactgctgatgggaatgtataatggtacagtcactttgaatatagtttgatagcttcttacaaaactaaacatactcttaccatatgatctagcaattgcactccttgatatttatccagaggaggtgaaaagtcctgcactggaatgtttatagcagctttattcataactgctcaaacttggaagcaaccaagatgtctatccttcaggtgaatgtttgataaacaacatgtggtatatccatacaatagagtattactcaccaatgaaaagaaacaacctatcaagccacaaaaaaacatgaagaaacctgaaatgcatatcatttactgaaagaagccaatctgaaaaggctacacactgtatgtccaactatatgacattctggaaaagacaaaactatggagatattataaaagatcagtggttgccagtggttcagcagaggaatgaataggtggagcacagggggtttctagggcagtaaaactattttatataattgtgtactggcaaatatacatcatcacacatttgtcaaaatccatagaatgctcaacagagtgaaatgtaatgtaaactatggacttcaggctggacagagtggctcacacctgtaattccaacactttgggagactgaggcaggaggattgcttgagcccaggagtttcaggctatagcaagctatgatgatgccactgcaacctggcctggacaacacagtgagaccctacctctaaaaaataataataataaaataaaaatagaaataaaataaactcaggaatttggttaataataatgtatcgagttggttcattagttgtaagggacgtactatactaatgcaagatgttaataatagaagttgtgggagaaagtaaggggtatatggaaactctctgtactttccacataatttttctgtaaaactaacactgctttaaaaaataaagtctagactggccgcagtggctcacgcctgtaatcccagcactttgggaggccaaggcaggcggatcacgaggtcaagagatcgagacatcctggctaacatagtgaaaccctgtctctatcaaacatacaaaaaattagccaggcgtggtggcagacaactataatctcagctacttgggaggctgaggcaggagaatcacttgaacctgggaggcggaggttgcagtgagccgagatcatgccattgcactccagcctgggcaaaaagagtgaaactccatctcaaaaaaaagaaaagaaaagaaagaaaacacgtatctactaaaattacaaaaactagccgggtatggtggcaggcacctgtaatcctagctacttaggaggctgaggcaggagaatcacttgagcccgggaggtggagtttgcagtgagccaagatcacaccactgcactcagcctgggtgacagagcgagactctgcctcaaaaataaaataaaataaaaataataaagtctattaatttttaaaatatattaattgagccgggcgcggtggctcacgcttgtaatcccagcactttgggaggccgaggcgggtggatcacgaggtcaggagatcgagaccatcctaacacggtgaaaccccgtctctactaaaaatacaaaaaattagccgggcatcgtggcgggcgcctgtagtcccatctagtcaggaggctgaggcaggagaatggcatgaacctgggaggcagagcttgcagtgagccgagatcgcgccactacactccagcctgggcaacagagcgagactccgtctcaaaaaaaaaaaaaaaaaattaattgagctttatggttaagtttttaaaaagataaatctgacccataaagtttaaataatagtcaagatggaagatgagtgatctccccaaggagacaagcttttctatgaaaatcttatcaaaatgtataatgtacttagaaaactaagtgacctcattacacatcatagttttgcatgatgtaaccactcttcagagaatatctcattttgtccttcagctcccacacaagagaaggttaaggaaattccactactcatgaaattataatcccacaatgtaagtgaagtggtggctgtgcctaggaaagaaagagaatacacgcttagagagaatctagaaagaaacattatccagtttgtgttggggatagcccatgatctaaattctaaaaagcacacccatatagaacctagcctgggctgggtgcggtggctcatgcctgtaatcccagcactttgggagactgaagcaggtggatcacctgaggtcaggagtttgaaaccagtctgaccaacacagtgaaaccccgtctctactaaaaatacaaaaaaattagccaggcatggtggtgcatgcctgtaatcccagctactcgggagcctgaggcaggagaatcgcttgaacctgggaggcagaggttgcagtgagctgagatcgtgccattgcactccagcctgggcaataagagtgaaactccatctcaaaaaaaaaaaaaaaaaagaacccagtctgaagcatgaattcacattgcgttttccagtcaatcactcagccaaagagaacctgaggtggccaagataatgtaacaaccctatcaagtaggtgttattcccatttacagataaggacagaaatgttaagtgactacacatggatgcaaacttggaatcttcaaactcccaggctagtagccaaattacctgtttttaaatctcatctctgctatctgatctctgccaagcaaatttccctttgaatttgttatgcaaacaattaacgagaataaaggaaaatgagagctttatatacgttacatgtaataactggaagttaactttattaagacatctgaaataagtcaacacttttaaaacttaaaggctattctttaccagaatcgtctgtaggaattaaccccagcagtcagaaagtaccttaaaacaaaaccaacattaatctggtaatgtcatgacttcataaaatatccttaatattcaggtacgtgcataccaagaagagtaaacagaataaaaagaaatctctaaaacattttccctcattcactacatgtctactcttccacttacctttatctctaaaacaaaaacattttctaaaccctgtggacatgacttcactaatccaaagaagactttatattctatgggccttgtaaagccacatttctcaaactaaggaccaaggaccatctgaatcagaatatctgctatgcctgtgaggatgaccccagataaactacatcagaccctctcaggcagatccatagattctttcttctttttaagcaaataacccagggattcttatgttaaaacctttagaccaacctttctcaaactcttcgctctcatggcccctttatttattattttttaaatttaaaagaaataataagcaaaccgggtcaggtggctcaaaactgtaatcccagtactttgggaggctgaggcaggcagatctcctgaggttgggagttcgagaccagcctgaccaacatggagaaacccccatctctaataaaaatacaaaactagacgggtgtggtggcacatgcctgtaatcccagctactcgggaggcttaggcaagagaatcacttgaattcgggaggcggaggttgtggtgagccgagatcgcgccattgcactccagcctgggcaacaagagcgaaactccatctcaaaaaaaaaaaagaaaaagaaagaaagaaaagaaataatagagccgggcgcaatggctcacacctgtaatcccagcactttgggaggccaaggtgggcatatcatgaggtcaggagttcaagatcagcctggccaacatggtaaaaccctgtctctactaaaaatgcaaaaattagccaggtgtggctgctagcccctgtaatcccagctactcgggaggctgaggcaggagaattgctggaacctgggaggtggaggttgcagtgagccgagatcatgccactgcactccagcctgggtgacagagtgagactccgtctcaaaaaaaaaaagagaaagaatgattgataaaccaactgggatactggcagatattttctcaaaaatgaaagaagggaagctgtctgttcagggaaagcaactgacaatatttgttgccaatgataaaatttgagctttagagtaaaaatcagaatttgagaaagtttgtatccaccactgtgagtctgacagttgtctaatattaatgattattaatgaaaccccatctctactaaaattacaaaaattagctgtgcgtggtggcacacgcctgtagtcccagctactcaggaggctgaggcaggagaatcacttgaacccgggaggtggaggttgcagtgagcggagatcatgccattgcactccagcctggcaacagagcaagactccatctcaaaaaaaaaaaaaaaaaccggccaggtgcggtggctcacacctgtaattccagcactttgggaggccaaagcgggcggatcacaaggtcaggagatagagaccatcctggctaacatggtgaaaccccgactctactaaaaatacaaaaaattagccgggcattgtgacgggcgcctgtagtcccagctacttgggaggctgaggcaggagaatggcatgaacccgggaggctgagcttacagtgggcccagatcgcaccactgcactccagcctgggcaacagaatgaggctctgtctcaaaaaaaaaaaattggcggtttatgggtttgtggggggtacaattcctgcctgtccaagtgacagactcatttaattatccccaagttaatgtttaagtgcaatggggtaaaacatgcactctgttaactaaaaagccacatttccaaatagtatacatattacgattaaaacattaaaaatatatgtgtacagatttattcatataagcccaaaaacaaatgtcagacaatgtttctgtctttggaacctgactcaaaataaggttcctcctgttggcttcttcctgagacacagccaacgctaatttgccgcccaggcaaatcatctatgcctatcattaggaaatcaaatttatgatatgcatagcctagaatactactctgtagtttttttgtttttgtttttgttttttgagacagaatcttgctctgtggcccaggctggagtccagtggtgtgatctcagggttcaagtgattctcccaccacagcctcccgagtagctgggattacaggcacacactaccatgcctggctaattttactatgtagattttttaaacatgaggtatatacacatgtatttgcattgagtattctctaagataaagtgacaaaaagcaaaatacagagtttggtgtatttgctgctatatatggaaggaacaacacccagagaataacatgtttgcatgcatacatatgaagtaactcaggagagataaatagtaggtaactagctgtccctgggaaagagtcccaaggataaggtgcggactaactttccacttactacatatcttttgtactgattcatttcaaaatttactctaaaatattggtattacaataaagaaaactggagtctagaactgaatgacaaaactgatacattcttactacaaatctgtggttaagattagcattaatctttcctaggcaaagaggaaaaagtttaacccaaagactgtatggatcttctctaccctacatctccaatctcattcccattactcagaaaatattctcactgggtatagaggtatgaactcccattggaaaacttagggtaaacgtccgtggaatctatggggcactgctgacccaggacacctgggatatttctgcagaaacaggattttttttttttttttttttgagatggagtcttgctccatagcccaggctggagtgcaatggcgcgatctcggctcactgcaacctccacctcccaggttcaagcgattctcctgcctcagcctcctgagtagctgggattacaggcgtgagccaccgcacccagccagattattcttaatcagttgattatttctggctccagaatgcttcaattattccacctgcccctatgtataagcgttaccaccctaattatgcttgtttttgtttttttggttgtttgagacggagtctctgttgcccaggctggagtgcagtggcacgatctcgactcactgcaacctctgcctcccaggttcaagcgattctcttgctttagcctccagagtagctgggattacaggcacgcgtcaccacacccagctagttttttgtattttcagtagaaacaggatttcaccaagtcggcaaggatggtcttgaactcctgacctcaagcaatccacatgccttggtctcccaaagtgctgggattacaggcgtgagccatcgctcccggcctcctaattatgtttcattttggttaatgtttcaataaatgtgctttccctaaacatactgatgaaaagaggcccaaatgcaaaactgatttgtcgagaaagtcagtctgagatgaaatatttattatgtctaaaccacaagtagaaaaaaattcaaaggccgactatttcaatgctaactcaatgcaatattgcactttgtttggtttacgggagaggtaatttacacagctaacatttgggttttcaagattacattgtggggagagaaggggaaaacaagaaaagtctaatgcttttagattctgtcagaaaaagtgtttgctaaaaagcaaaacaaaatgaacatgagaaaaaatgtgaaaaaacatgcattttaggaagctttcaccgaagcaggtgctcaagttcagactcaaatcttccaactcttgtaataaaaatgagaggtcagaataccacaaactaatcaaatcaatcaaacaaagcgggaaacaggtggctgacaccagactgggcagggttttcctaaattgggcttaccttcactaatccaaatcagttttcagaaatggcttctacaaaaactacccaaacatccccctaataatttgcactcctcctccacaatagggaagccaagccgtttatttcccagaaggtttactttctctttcaagctctgctggcttcttcctgccccgcatacggccaggaaaaaagaaaagcactgccttttctttcctgccttctctaaaactggggagatggggtgagagaacctgtttcatggacaagctgggtggttcttaactgcaacactgttctgaatacagattagtttgcaaaggaaagttacaggacaggaaaataaaggtctacccctccaactaactcatacacatgtacatttgcatgtacgcacacacacagatgtgagggcacatttaattcagctgagtaatgtgcagcaatcagctcccagcttcatacctggccaccgggatgcctcctcactcccaccttctttacctgactcaaaataaggttcctcctgttggcttcttcctgagacacaaccaactctaatcattcctcttcccctcaaaccttcaacactacctgcactttctgggtcgggagcaattccttgggtggtaatccatttttaatgtgttaaatattacttaaaataagggagaggtaatcatggactgtgggcaatgcagagatttatcagaagggcatttgtgtaaacaggaatttacagtttgccttacctattccttttatatgacagcctcaatttcctctaacagaatgtaagtcccccatccctattcatttagtttttttcccattaggttagaatctgctaattattctttctctcctttgggtcattagtggctgccatgaatcataatttgcctgactttgtaatatctaacagatattaccattttagtttagtttttgatatgacagttttttgttttttgtttttgtgacggagtcttgctctgtctcccaggctggagtgcagcggcgcgatctcagctcactgcaacccccacctcctgggttcaaaagcaattctcctgcctcagcctcccgggtagctgggactacaggcacccgccaccacaacaggctaaattttatatttttagtagagacggggtctcactatgttgggcaggctggtcttgaactcctgacccgcctcggcctcccaaagtgctggaattacaggcgtgagccaccatgcccgacctcctaattatgttttattccacctgcccctatgtataagcgttaccaccctaattatgctttttgtttttcggtttttttgagacagagtctcactctgtcacccaggctgtagtgcagtggcacgatctcggttcaccgcaacctccgcctcccgggttcaagcgattatcctgcctcagcctcccgagtagctgggattacaggtgcccaccaccacaactggctaatttttatatttttagtagagacggggggggtctcactctgttgggcaggctggtcttgaactcctgacctcaggtgatccacccgccttggcctcccaaagtgctgggattacaggcgtgagccaccgcactcggcctgatattatagtttttaataagagtaattcagcctaggcaacgtgacgagatcctgactcaaaaaaattagaaaattagctgagggtggtagcacacacctgtagccccagctaccccgaaggctgaggcaggaggatcacttgagcctaggaggtcaaggctgtcatgagctgtgatctcaccgctgcactccagcctaggtgacagagtgagaacctgtctcaaaaaataaatagtaataatagtaattattagcacttgaatgttacctgtctgcccggcactatgcaaagtacttgatatgcatcatcttgcttcatcctctcaattactctacaagtggacctcgtttccacaattgtggacagagaaactgaaaaccagagaagtgaaaacaacaggcccaaggtctaagagaaggcagaactgggattaaagcccaataggtctgacctgatagtccactcttttaactgctatagtaactttggaccatgaaaccctcaaacataccaaccaagtgtttcaaaactacaatagcaatcaccttaggaatactcaaaatataagttctttggctgacgcagttaaaaattcaaaggtcaggtaaaatttcagtgatgagcaaggtcatttattcttatggctgggggtagcaggaaggaaagccggatcgtcgaagcattattttcttgtaggggcagatttaccttccttattattcttttgctaggctgttaaaaggaatttggaaggccaggcgtgctggctcacgcctgtaatcccagcactttgggaggccgaggcaggcggatcacaatgtgaggagattgagaccatcctggctaacacggtgaaaccctgtcgctactaaaaatataaaaaaaaaaacattagctgggcgtggtggcgggcgcctgtagtcccagctactcgggaggctgaggcaggagagtggcgtgaacccgggaggcggagcttgcaatgagccaagatagcgccactgcactccagcctgggcgacagagcgagactccatctcaaaaaaaaaaaaaaaaaggaatttggaataaatatgtctccaagataacctggtaaacagaaagggctgcaaaaaatctgaataaaagcaagtcaattaacaggatacatgtaaaacacacattttatattcctacaagtctttttttttataatagcatgttattacttttctaaaaaggacaaaataacttattttaatgacatttaaacccaattattaacagaaaagggataagaactgtggttccttggcctcctttccccttggtttagttctcctaaattaagaacttctacttatagctccctgaacacacaaggctgttttaagcctctgcaccctcatgttccttcagccttgaatgcaactttttgtaacgcaacttcgtggaaagaattcctattcatcctataaaaccctattcaggtgttcccatctgataaagcccctcaataatgatgactttctctcactcctgaaaagaattaatctcttttcttggatatttagtaagaacttagatttaccgagctcttactatgtgccaggcactatgctaagcattttatccacattatcttattgaatcgtcaacagtacctacaagataagcactgttataatcttcttttacagataagaaaatagaggctcagattctgactaggaagtggcagatccaggattcagtcccagatctgtttgacttcagagccagagtcttgaaccactcactgccctgtcgtctcccctgtcctacttccatactggcatagcacacacctcggtccctgcaacatctccagtttcatgaaaacggacaatatttcattatccttggatcctgcctgacgcaatacctggctctcaacatgtttgctgatctgaattaaagagttgcggtaatccttttttttttcttttttttttgagatggagtcccactctgttgcccaggctggagtgcagtggcacgatctcagctcactgcaagctccgcctccaggactcatgccattctcctgcctcagcctcctgagtagctgggactacaggcgtctgccaccacgctgggctaattttttgtatttttagtagaggcggagtttcaccgtgttagccaggatggtctcgatctcctgacctcgtgatccgcccacagcctcccaaagtgctggaattacaggcatgagccaccacacccggctgggtaagagttgcagtaatcctaacatgacaaatgagaactgaccataacagaaattcattcttccatatgttattcccaggcctcataacctctccttcctctgaagacatgtagcattcagtgtagcactgtcagaatgtctcactctgtcccccagtctggagtgcagtggcaggatcttggctcactgcagcctccacctcccaggttcaagcaattctcctggctcagcctccagagtagctggaactacaggcgtgtgccaccacacctggctaatttttgtatttttagtagagacggggttttaccatgttggccaggctggtctcaaactcctgacctcaagtgatccgctcacctctgcctcacaaagcgctgggattacaggcatcagccaccatgcccagcctgtttttgccttttttttttttttaaagaaacaaagtggtctcactatgttgcccaggctggtcttgaactcctgggctcaagcaatcctcttgcctcggccttccaaagtgctgggattataggcatgagccactgctcctggcccgatatgctactccttttaaaaactggaggcatctcaaacaatttaccaccaaaggaccatgtggccatactgactaaagcgcactacactttacgcttacgtcttgtaagccaaggtgtctaacaaagagtatataaccaccatattaattctttacaccataatcaataagggctgggccagcccagcaatgccatcctcctggatctcactgaggctgctccagaacaccagaagttcttcaggattcggggatgtccctcaagtactctttcagtggtttttataaatgactcaaaagttatggtgaaatttttaagtgccaaagacataaaatatgagtggtggtttgtatccaatcaaaaatcctcaaaaaacacttctgcacttaagcacactatacttttttcacccaaagtaccaaatcaaactagtcaggatacctacctttgtacaatgtcagactccagttaataactcccctagggcagagggcatatgcactgatttactttgtacaaattaaccagcatcaggcaatcaggcctgtgcctaacacatagtaagcactctatgattaaacatcagtgcttcggctccaaagttttatttatttatttatttatttattttttttttttttgagacggagtctcgctctgtcgcccaggctggagtgcagtggtgcgatatcggctcactgcaagctccgcctcccgagttcacgctcttctcctgcctcagcctcccgagtagctgggactacagacgcccgccacaacgcccggctacttttttttgtatttttagtagagatggggtttcaccgtgttagccaggatggtctcgatctcctggcctcgtgatccgcgcgtctgggcctcccaaagtgctgggattacaggcgtgagccaccgcgcccggcgccccgaaagttttaaaagcttcccctacaaaagaacagaactgaaattccttggtcctgtattcaatgtcttttgtaagtaatcacttctcccctacttaccctcctagtctaccgggctaccaggaattttttttttttttggagacagggtctcactctgtcacccaggctggagtgcggtggcgggatcacggctcactgcagccttaacccccggggcttgggtgatcctcccaccttagtctcaccagtagctgggactacaggtccacgccaccaggcctggctaattttttttatttttaggggagagggagttttaccacgttgcccaagctggtctcaaactcctgggctcaagcaatcctcctgcctcagcctcccaaagtgctgggattacaggcataaaccaccgcaaattctttacacctatcaaattccacccattatttgggacccagttgaaatccctctttggcaaaaagactttctagacaactccaggcctcataacctctcctttctctgaagatctgtagcattcagcctagcactgtccaatagaacgttctatgataacagaaaagttctacatctgtactgtatgttcttttatgtagaacagctaccttgttagcacaagtgtaaagtctcaccatctctttgatgacaacatgttacattggatggttaaaacatttatcagctcccccagtagactgcaatttctgtgaacaagatacaacttattcttcatagcaactctgacaaagttgcaaaaggtatatatatgttggccaggcaaggtggttcacgcctgtaatcccagcactttgggaggctgaggtgggcagatctcttgaggtcaggagtttgagaccagcctggtcaatatagtgaaaccttatctctactaaaaatacaaaaattagccgggcgtagtggcgggcacctgtaatcccagctactcaggaggctgaggtgcgagaatcacttgaacccgggaggaggaggttgcagtgagccacgatcatgccactgcactccagcctgggtgatagagtgcaactccaactcaaaaaaaaaaaaaaaaaagtatatatttgttgatttgcacatcacctaagaaaaccataagctaagaaggtttggactcaggcgtctggaaagttggtcaccacctctaccccacctcatatctgaatgtcaagagacacgtagaggcagagaagttaaagcaactttctagagacagaaatgaccactgatcaagccacaatgcactctggtttaaatgacatttaggtcatgactgtccttaatctaaaacaaacctagattagtatttcttttcattagtaaatagctaaattctgatggtaaattatgctgaccaaaaacagttcctcacttcccaagttagacatagcaattagaaaaataatctaagcaagctccatttgtatttcttttttcacctgtttattgaatatttacctcccatgaagtctttcagcctattggtggtattttactgttcagatatatgttagaatttcactgatacttactgggcgcggtggctcacacctgtaatcccagcactttgggagatagaggtgggcaaatcacaaggtcaggagttcaagaccagcctggccaatatggtaaaaccccggtctctactaaaaatacaaaaattagctgggcgtggtggcgcacgcctgtagtcccagctacttgggaggctgaggcaggagaatcgcttgaacccaggaggcagaggttgcagtgagccaagattgcgccactgcactctagcctgggcaacagagcaagactctgactcaaaaaaaaaaaaaaaaagaatttcactgatacttttcacaaaatatacagaaggaggcacaaattccaccactatggcactctgctgcgttggccaagtgtcttgatcctttggcctcaattttcttatctacgatattagggtaattgttatgtgaactacccacctcacaagtcctttgtgggttaattcataactgtgctgtgggtatttctttttctttcctttcttcctcctttcctttctttctttcttaaagatgggttctcattatggtgcttagactagactctagacccaattcctggcctctcaccatgttgcccagaccagactcaactcctggactcaaggaatcctcccacctcagccttcaattagctgggatcagaggtgtgcaccaccatgcctggcactgtggatatttctaagtgattattcttctcaaatgaactacataaaaaacaaaagattcatgaatttactaatggttctttgtgatggatgtgctaatatagagactaaaatcaaggctccaacctctaaaacatttttttttaaattccagacttgtttccccatcccactgtgcaaactgaacaaaaactgggctagcactcctgtctggaacatgtaataaggaaataaatgtgctgactcagagaacacagacatatttaatataaaataagatagaaaactggctgaaccaagtcataacacagtctaaatccacatataaaagattgagatgattttctgctttgctttattcaagcccaatgctttatcagcacagccagccaaaaatttacaacccatacacagactatgtaaacctttagttgcacatacagtaagaccagcaggtacacactatacacatttttaattaaaaaaatgactaaccactgattttgtcaccacacttaacaacgacctgatatggcacagagtgatgtgtaccaaacatggaaataccaacttgggcgacggtttgaatcttgttaacttcagtgcaaccacaccccccaaatgcatgtaaagtttgcacacatggttttttcaaggccagcctgtctttgtttccctctcctctgcatttacccaagatcttggctctgagacagaaaactcccactctcaattggttcattccgtcctatgcaattaagcaacaccacaatccagtaaatgcaatggctcaattatttatcttctggccgactttaccaggtatttggaaaaggacaatgtcaagaggtttatttctctctctagagctggcttgacgggttgatggggattttattttgtctttttttctcttttttacaaggcggggacgtggggggagcataatttaacctagaaaaagatgcgagggaatttagaaagagtaccggtctgtcaatttccctacaggaaacttgattcttatgcaataaagcctacccacgaccagccagcccgtaaggctgcaggcgacagacacacctattcctgcctccaaaagggcacagctgtctcctgaaggagcgggaacagggcaagcggaggaagtggctcagcgggagccgccgaccgggcggggaggaggcgctttccgaccccccactcgcgccggtgatccccgtcggcgtgacagtcgctccggtggccggaacgtccccagggccccagggagcaggaaatcgggggactgtccctcactcctgccgccgcaaccgagtgcgccctcgccccacggtgccccctcgagcgcgttctgtttctccgaagaacgaaacttccctccagcgccccgagtcccttccgaggcccgctcctgtcatcccgaagagtcttccctcagggcgaccctccgcgtctcttcatctctcccggccccactgcagcgtccatcacaacatccccaaggtcccagaggccccctgccgctgcggagcccccgggtccccaggcctccccaacggccccaccctgcacccccttcacctgtttctccggcagaggccgagaggccggggctgcgcgtgtgccggggacgggcggcgaggctccctcaggccgaagggcctctccgagccgagggggagagacagcg

SEQ ID NO: 2054 - DNA, 77230 bp, Homo sapiens
  source 1..77230: mol_type = genomic DNA
tcccttcagaggaaggctttattgtaacataaaatacacaactttgtgactgtaactctgcataggatatatttcttttttttgaggcagagtcaaatttgaggccccaaattgtacacaatacttttttttggtggctaaataactaatctgccttgacactaaaatatgtatctgaaataatttcaccaagttttaaaaagaaaaattataaaaagtatactttcattttaagttatattcgattttagtctccccctaccccctagaaaaaacctgcacatctcacacacggagctgaaacttttgaggacttgtgtgtgtctgggagtgggtgagaggctgatggggtcgagacacaccactacctttatcttgtggtttgcaggaacaaggaggagagagaagatagaacgcagagagcgagcacacctttcatcaaaaatctccactctctaggcacagcctcggtaacaccgaggacagctcacaactggacaagcagggaaaccccagctcagggaagccacactcatcagctctcttcctccccaacccagtgccaactgcaaagtgagccaggacggcctggctgctctgtcctcagcaggccctggggtgggtccactcccaacctgaaagtgtatcaagtctgaccccccaaccagggttgctggaacagagagcgaggtctcagaggcaggtgctggtgaagcatctctgggagacgggcagggagtgactctacgagcctggatccctgagcaggcaggctctccttctcacccttccccgatgcacccatcctcatggttggaattttcatcaaatcttgaggggtagggaggggctgagtgggatgcgggtagcctgctcctcagaggcagagagactctactgcctggcatagaaaaataaatcagtgtatgaaaccaagccaaggcaaacggcagctttaaaaaagtcatcttccaataaataatttactatagaggaatatttttaacggcaaaacactgataaattcagaagttatttttgtaaaaaaaatatgtttatttactctcatgtataaaaataaggtttttggggccatcctctcctgggggtgcccatgcccttcttttggagagggggccgaggggtgaccttttaggccttacccgtaagctattttaatacacctgctcacccccctcttcctccactacctgctgtagcccattccttccttctggtgtaaagctacagaagaagtcgtggaacaaaattataccgaggctttttttgttttgttttatacttttatcaaactccccagcaaacttgctgactgcatttccacacattaccaacacctgccaggacttcacagcagggtgacccgctaagcaagctggcctaggttcagcccacactgctgctacctactcttcaagacattaggtgtgaacagagaaggggaatgaggtgacctgggtttgaatgacccagggcccaatgcacaagagagaattttgatgtcaaattagggtggcaaggagaaaacaaaaaagatccaacttagaaacagaaccatgattcaacatttgcaaaaagcatcatcaataagcctgaagaaggccacggactgtgcatccgctggctcagagaaaggctgggcagccggaacagcagcttcctgggtaaccaggcaacaatctcagcgcctgggagtcagggctgcgcactccactctggccagaacacaaacggcattggcactgtaagctctcagttacgtggccctcttttctctcctctatttctccaaacatatgtgcacacccagaggaactgagtggcaattccagggtgcgggcgggcaggaggggagagaggacaaagagagaataagatgagctaaatgttttgtgaaaagccaccgcccatccgaaagcttgtgacttcccttgccccaacaatctttgtaggttgccccttttcccattcctacccaagaacacaggggtgggggagagggaaggctctctttgtcaaaaagcagttatctacatttcagaagaaaagcagagacaatcacggttatatatcaattgcttggcagacagagtgacgaagactcactggagcacatgtgctttctcctccctttgtccttctcttattcaaacagccacatgtcaaagtccagccactcttaagacacatggccaacttccaggcttcacgaaactcactgcctttttgcacaaagtaaaaaccaccacagcttctgtctgtggcccctctgctacaactaaactctcagacagtgagagggagaaacaccataacgtgcaaacacgcacacacacacacacacacacacacacacaaacacatactcgcactcccttcgctggtgccaccatgcacagaaacactaaggtcacaactagtattaacacttcacattatgagtattgtttcaaaagagaagcgattcatggaattaaaacatccacaagagtgattcctctggtgaagatgaagaagctgaagatggagaggtcgcggggtcacgattgtgcgtgcgggatccactgactgtccattggccggcccaggagctcctccacacgccgcgctacgtccattgtgtcctccagatcgaagtccccatcggtgtcaaggactgagtcagggcttgggagggaaagaagagggatgaagggaaggggaaagcctgccagagaccaccccaagccccacaggccaccaggggagcagtctgagccagcctatgccctcagcctggggcttcatgggaaaagaacaaccattcaaacagctggctgtacagcaactcagactgaaataccctcccctgttacctctcacaccggctgtccagacacatcacaactccactcagtccttagagcaagaaaaatctccatattgagagaggggaacagatgacatttgcccaacccgactctaaaccaccaatcacttctggtcaaatctctccctcccaaaggccagagcccgggccagggctgtgtggtctcagacctagaggagctctggattcctttgaccccagccctccaggggtccagcctggggccaagcccccagttcctcccctgtggacccccacaagaatgccacctacttctgtgggtacatgttatagtgagcctggggacacacagctggggagggggcctggtccatgtacgtggcgctgccgcccccggcatctgcagatgcgttcacaaacctgcagaaggaagagaacagagcttcagctgccagggaggccagggcagctgacttggggaggggaccaaggggtatctttgtctttctcagggtgtagaaggacaaagtgccccactcggccctggggctccagctacaggagtggggcctcaggtactggcatagcatcaccaagcccaggtccttccccagggctgagacagtttccccgggggagcggaaagctgggccaggataaggatgggaggcagggtctgggggaggaggaaagaggcagaaggagagccacagccacctggacacttactcagggaccacttgcttgatctgtggcttcacgtatccatcaacagctttagctgccaagggaagaatgtagtaaatcaaagttctcaagtgaaacaaaaatgtgatcttccttatgaatcacatcttttcttaggacagaacacaaccacctaacttatctaaggatatgacacaagcacttaatatttttttgttttgttttttgaaacagtctcactctctcatccaggctggagtacggtggtgcaatctcggctcactgcagcctccgcctcccaggttcaaatgattccgatgcctcagcctcctgagtagctggattacaggtacaccaccacactttggctaatttttgtatttttagtagagatggggtttcaccatgtcacccaggctgttttctaactcctgacctcaagttatctgcccaccttggccccccaaggtgctgggattacaggcataagccaccgcacttggccaagcatttaatatttcaatctgttaggaagacctggtagaggagaaggtcagcactaaaactgaaattcaagatatcttccaaattggcttggatgtttcaataaattcttcaaaccatggaaactatgtacttcaatacaaatctaagtcaagcactaattgcatactaattaaaaaaaaaaaaacaccttgaaaagcttaaagtccaagatgcagcagagagacaggatttgttctacctgacccaggggataaaatcaggaccaggaggggcaggtcataagaggacaaatgttcagtcatgcagggaagaatgttctaagtagaactgccaggaaaagaaatgatttatcttaggaaggactgatttccttgtcactggaggttttcttttttttcttttttgacagagtcttactctgttgcccacactggagtgcagtggtgcgatctcagctcactgcaacctctgccttctgggttcaagtgattctcatgcttcagcctcccgagtagctgggattacaggtgcgcaccaccatgcccagctactttttatatttttggtagagatggggtttctccatgttggtcaggctggtctcgaacccctgacctcaagtgatccacccgccttggcctcccaaagtgctgagattacaggtgtgagccacggtgcctggccatcaccggaggttttcaagcaggaggtgcatacacgtcagggatctaatggaaaggcctaggcactggagagccgctgatctgatctgatgatgtctgaggttcctctaactctgagtgtctagtctttcaggaaagggaaggctacttttcccagcacctgcacgctccttcacgcctggtgtttctgcatttggggtactttgatgtcactagtcccagtgagtgctgttggtgccaagaatgcgatgtgtcctttgcttcccacagaatccccactgggatgtggcagatgagcagataaacctgcacgtgatctggtcaaccacagttaccttttcagaaggctgactatggaaatccaggtaagcaggtggtaagaatgtgattatctgacatgggagaatgaagtcttgtttctgggtacgtgaatatgggaatcagtacaaagttaattatactaggcaaggacgatcacactatgattataggacaaggagcttgtcatttaagtagcccaagagggtgaaacgctgcagggttcaccaattgcttattaccctaatcttcttctagggcttcaagtgtcaggagcgaccttttcataacatgttttttgtgctttacagtgtacagagtattttatagattggctaagaagttaaaaacaaagaaatgctgccagaaataggattttatttttttctgagacagggtcttactctgtcacataggctacagtgcaatggcacaatcatagctcattgcagcctcaaattcctgggctcaaccaatcttccagcctctgccttctgagtagctgggactacaggcatgcgccaccaagcgcagctaactttttcttttttgtagagatggagtctcactatgttgcccaggctggtctcaaactcctaggctcaagcaatccttcctcctccgccttctaatgtgctggaattacaggcatgagccactgtgcccaggcccaaattataagtatcttaaataaccaacatgtaactcaccatacagtgggattgtatgcagtcatcaaaatgaggttggaagattacatttactgagctgtaactctgcataggatatatttcttttttttgaggcagagtctcgctctgttgcccaggctggagtgcagtggtgtgatcttggctcactgcaacctccgcctcccgggttcaagtgattctcttgcctcagcctcctgagtaggtgggattacaggtacctgccaccatgcccggctaatttttgtatgttttttagtagagatggggtttcaccatgttggccaggctggtctcaaactcctgacctcaagtgatccacctgccttggcctcccaaagtgttgggattacaggcatgagccaccatgcccagctacctaggatatatttccaagtaaaaaaaaaaagtcacaaaaaattacatatgatatggtctagactccaacctttcaccctgaactccaaggctggagtgtcctgacctcagttcctaccacttatcttccctgctcaagaggctccagcctccctggccctcctgaggctttccagacatggccattctcaacccaggatttttgtacttgttctcttggcatacaatgtttttctctagatctttgtatggctagcttcctcacttcattcaggtcttttcaaacatcacatcctggctaggtagagtggctcatgcctataatcccagaaccttgggggactgaggaaggaacattgcttgagcccaggaatttgagaccagtctgggaaacacagcaagaccccatatctataaaaataaaataattaaccaggattggtggtgcatgcctgtagtcccaactatgtgggaggctgaggtgggaggatcccttgagtctagcagtttgagactgcagtgagcaatgtactccagcctgggcaacaaagtgagaccccatctcaaacaaacaaacaaacaaaacaacaacaaaaaaaacaaacatgtcctcagagaaaccctccttgaccactctagtaaaataacacctccactctcctccctgccacttctctatccctctaccttgctttatttgtcttcagggcgcccatcactaaattaatatatttgtgttttgtttgtttttgagatggagtctcgctctgtcaccagactggaatgcagtggcatagtctcggctcactgcaacttctgcctccctggttcaagcaattctcctgcctccctggttcaagcgattctcctgcctcagtctcccaagtagctggaattacaggcgcccaccaccacacctgactactttttgtatttttagtagagatggggtttcaccatgttggccaggctggtttcaaactcctgacctcaggtgatatgcctgcctcggcctcccaaaagtctgggattacaggcatgagccaccgcgcccggcctgaatatgtttccttgtttatggtcttcgttctgctgctagataacctccacacaggaagttcaagcaacgggtgatgcaatgtataatacatatctatatatagagtgcaagaatagtcactaaatcatccatagaggttaatctctagatgagagatgttgtgtggtatctgtttttttgttttcttttcttttgtttttgagacagagtttcactcttgttgcccaggctggagtgcaatggcacgatttcagctcaccacaacttccacctctcgggttcaagcaattctcctgcctcagccttcccgagtagctgggattacaggcatgcgccaccatgccaggctaattttgtattttcagtagaggtggggtttctccacgttggtcaggctggtcttgaactcccgacctcaggtgatctgcctgcctcagcctcccaaagtgctgggattataggtgtgagccaccacgcccgaccttccttttttttttttttttgagactgagtctcaccctattgcccaggctggagtgtggtggcgtggtctcagctcactgcaatctccacctcctgggttcaagtgattctcatgcctcagcctcccgagtacctgcgattacaagtgcctgccaccacacctaatttttgtattttttgtagagatagggtttcaccatgttggccaggctggtctggaactcctgacctcaaatgatccgcctgccttggcctcccaaagttctgggattacaggcatgacccaccgtacccagcctgttttcttttttatgcctttatgtgtcttctgaaaattttataataaatatgtaatacttctaaactcagaaagcaataaaaccatctctgtcatgaaaaacaaaattttacctaattttgtttgatctaagcttgtattaaaaagaatttgttttcttcaatttgatatttggggttagtggtagatgtgttttctgtatgactgaagaatccagcccaaggtttacatctgccctggaaaatgctcaaactgctctcactgaatggtaattgtgtgggttttcacacaagagagataacacacgcaggtatgcacacacacacacacacacacacacacacacacacacaacaaaatcaaatcagaatgcgaacattgttaccagtagcagactcgcagggaactggtgtgtagtatttggagtatacttcatcttttggccgatcaggaaacacgtagataaggtaattcaagtctcccaagcggtcggctagggaccgaatggagaagtctctggtggtaaaaggcatcagattccaaaacattctttcctctagatcaataaacagaacaatcacattctaaacatgatttctgaattaggaaatcttaaaaccccaacatactataaattcaagcttgccattataatggctccaatagaaatctccatttaaaaataaccatgggttatagatgaaatacttttatttatttacttacttacttacttattttgagacggagtctcactctgttaccaggttggagtgcagtggtgcgatcttggctcactgcaacctccaactccctggttcaagcgattctcctgcctcagcctcccaagtagctgggattacaggcacgcgccaccacacctggctaattttgtatttttagtagagatggagtttccctatgtcagccaggatggtcttgatctcctgacctcatgatccacccacctcagcctcccaaagtgctgggattacaggcgtgagccaccgtgcccggcctgaaatagttttaaaagccatgggtaggggccaggcatgttggctcatgcctgtaatcccacacttttggaggcctaggcaggtggatcacctgaggtcaggagttcaagaccagcctggctaacatgatgaaccctgtctctactaaaaatacaaaaatcagccaagtgtggtggcactcatccgtagtcccaggtactatgctgaggtaggagaatggcttgaagctgggaggtggaggttgcagtgagctgagatcatgacactgcactccagcctgggtgacagagaccccatctcaaaaataaataaataaataaataaataaaaataaaagccatgggtagataagcaggtaatacaaaaatcacttcccaagagatccaatgatctcagacgtttcaagttcaaacagtattctagccctcagtagaagaaacagtttttactggcccccaatccctgatttcccatacaaagatatataaaagctaggaagcatgcccacaaccagagaaagcataagagctattaaaagtgatgaattttttttttttcgagatggagtcttgctctgttgcccaggctggagtgcagtggcgcgatctcggctcactgcaagctccgcctcccgggttcacgccattctcctgcctcagcctcccaagtagctgggactacaggtgcccacaactacacccggctaatttttttgtgtttttagtagagacgggggtttcactgtgatggccaggatggtctcgatctcctgacctcatgatccgcctgccttggcctcccaaagtgctgggattacaggcgtgagccaccgcacccagcctttttttttttttcttttaagagacagggtcttactctgttgcccaggctggagtacagtgatgtgatcatgactcactgtaaccttgaactcccagggtcaagtgatcatcccacctcaccctccagagtagctgggactacaggcgcacaccatgagcaccaccatgcccacctaattaacttatttatttatttatttacttagagacagggtcttactatgttgcccaagctgggcttgaactcctggcctcaagagatcctcctgcctgaggctcccaaagtgctgggattacaggcatgagccaccgcacccagccaaaagttattaaaaactttaattcacagaaaatgaaccagcaagctacccttattgtgagggtcagaggagagaactaactttcctgatgccctggtgcagtggctcaagcccgtaatcccaatactttgggaagccaaagtgggggattgtttgagcccaggagttcgagaccagcctgggcaacatacaaaaaatttaaaaattagatgggtgtggtggtgcacgtctgtggtcccagctaatcgggaggctaagggaggaggactgcttgaggccaggaggtcaaggctgcagtgagccatgtttgtgccgctgcactccagcccgggcaaaagagtgagaccctgtttcaaaaaaagaaaagaactaacatcttgggtagaaatggttgatggcaatatccatatgttaattaggataaaggaatatttttactactgtaagaactccaaatcatcaaattcttcactgaaataagctttatgcagagtagtacaataaggcaaacattttaagagggaagcaactgagattctgcacggactcttgtatcataggtagccatgtcatggttaaatgttcatgtgtaaccatgctgccatatactttcatgtataaccaaattagcaattgtgtttcccataatagtatttttcataggctgccttattatgagtatgtcatggctatacatttatgtttcccataattagtactgacctcaacaaatagtaagtacccactaaattatttgttaaaataattttgtaacgaaagcagctaactttggacataagaagggaggggcactcacgagaatcaaacttccaagcaatggtgatgccgccaatttctgagtcactgaatctcaggaggaaggtcccatctggcttgttaatgagtaggtcatgggcctgttgcttgtttacaaaccccaaaatggccctggatcaccaaggacaaaggacagaagcagagtgtgacttacgatgccagagagaagaccttcagactctgtcggcgccttaagaaataatgattctcacccatcattccaatgaggcttgagatgtttttttaacacttccatcacaccgtcaaaccattgccagaaagtgtaattccgtcctggtaaattctcctggttggagatacaacagtgaacataagaacaccagagtaacacttggaatattatacacatatttaattggaaaaattaaatgggaaacaaacatctacccttgtcagaggcatacaaatatccccgcctacctgagttttacctaatggccccatggagaggaaaagagggaagaaggggaaaataccaaactgcagttaccagcacccagtgggctcctgctacagacactttcacctgggactgggctgacccgtcccttgctagtttcgatgtgtggtctgtgaccagaagcatcagtgtcacctgggagcttctgagaaatgcacgttgttaggctccaaattaaacatttaaaacaccttgggggtggggggtgtaggaaaagaaacaaaaattaaattcaaatcaaggtgatagccgggcatggtggctcacgtctgtaatcccagcactttgggaggctgaggtaggcagatcacttgaggtcaggagtttgagaccatcctggccaacatggtgaaaccccgtctctactaaaaatacaaaaattggctggacatggtggcgggtgcctgtaatcccggctactcaggaggctgagacaggagaatcacttgaatctgggagacggaggttgcagtgagcccagaatgtaccactgcactccttgtgacagagcgagacaccatctcaaaaataaataaataaacaaaaataaatagggtgggcacagtggactcacgcctgtaatcccagcactttgggaggccgaggcgggcagatcacctgaggtcgggagttcgagaccagcctgaccaacatggagaaaccccgtctccactaaaaatacaaaattgcggggcgtggtgccgcatgcctgtaatcccagctactcgggaggctgaggcaggagaatcgcttgaaaccaggaggcggcggttgcggtgagccaagatcgtgccattgcagtccagcctgggcaacaagagcgaaactctgtctcaaaaaaaaaaaatgaataaaaataaaatcaaagtgacgtctgaattagcagatgctagaggaggagtttctttcatcagcatccctctttgtgggttgagggtcccataggagcctgatctggcattacacatggggaacataagagagtaaaggggagagaggcccagagttcgcatcccctcaaaagctttgcttctcatgagctatgttaacatctgctttgctctatttcctttacaaaggaagaaaatgcattaactgtagacaaaggtcaacttatttaaaatatgcaaagatgtaattttctacacgtgacctgggtaactctcaagttgtccatctagtcagaagcttctattactttcggtacattttattagagacatgaagaataagggcccagggcagggagactcctgagagcatctggttgggaaggactgatctaacagcggctggcagctgggctcctcaccctgttgaactgggaccaggacacagacaggccactgtagtcctccaggtggctgctgctgttgttgaacagtttctgcgccaggaacacgaggttctccttggtcaggccccggttgctctgcacttcggccttgaatttcatgttgagcgcctcacacagctgtggccacagcactttgtcaggcacggcaaatggcaccctgccctgagagggagagaggccagaatctgatgagaaaacagttgcatgatttattccctcaagccacaaaagaaaaacgctgatggctgggagtggttacacacatttgtcttgcagggcctgaggataaattcagactctgctggggtacacggttctgtgaaattcagaaggttccgtttcaccttctttacacacaactagaaggtaacccatgctatccatgctgttttgtaaatgagctgctgaactaacagtcaaatcctatgttctaacggccacaaaccaaaacataaccaaggtctggctcttagattgtaaacaccttgggaatttagaaatctgaaagactggtcctctaggtacaaacagagagagtgtgcgtatgtgtgcacacgtgtcggcatgtgtgtacacacgtggaatcattgccctcgactccttctgccaagaattctagctcaaagtaaaacaacttggtatggaagagtggaaattttgagttggatggctttattgagaaataggttagaagattaacttttaataaactgcttttcaacccgttcagccatagtactccattttattttgttacaaacacttttttcaataggtgattttcacatgatttaaaattcaaaaagcacagacggctacacagtgaagtcactccctatccctgtctcccagcaacccagttcttttctttaaaggcacctaacacagtttcttgtgtatcccaccaaagatattctatgcatgccagcaatgacatataccttttccttttcttcacaaatgacagcacaaaatccacatgttctgcatcttcctcttttcacttaatcctctatctgggagacctcccatcagcacataaagaaatttcaccagacccccatagatgggcatcagtgttacagcctcatctttagctattactaacaatgctgcaatgttcttatgttatttgacccacaggacacataggcaaatatatatggagaataaatttccacaattatttttttttttaggtaaggtctcgctctgtcatccaggctggagtacagtggcccaatcttggctcattgcaacttctgcctccttagctcaagtaattatcctacctcagcctcccaaacagctgggactacaggcgtgcaccaccatgcctggctaatttgtgtgttttttgtagagacagggttttgctatgttgacaaggctggcctcaaattcctgggctcaagagatccgcttgccttggcctcccaaagtgctgggattgcaggcataaaccactgtgcctggccacaagtctttattatttattttttattttttatttttttgagacagagtctcactgtgttgcccaggctggagtgcagtggcaccatctcaggtcactacaacctctgcctcccaggttcaagcaattctcctgcctcagcctcccgagtagctgggatcataggcacgcaccaccacgcccagctaatttttgtatttttagtagagatgagagtctcaccatgttggccaagctggtctcgaattcctgacctcaaatgatccacccacctcggcctcccaaagtgctgggattacaggtgtgagccaccgtgcccagctgaaagtcttttttttaacatagcataaggtcggctgggtgcagtggctcatgcctataatcccagcactttgggaggccgaggtgggtggatcacttgaggtcaagaattcgagaccagcctggccaacatggtgagacctggtctctactaaaaatataaaaaattaattgggcgtggtggcatgcacctgtaatcccagcttctcgggaggctgaggcaggagaatcgcttgaatccagaaggcagaagctgcagtgagccgagataatgccactgtactccagcctgggtgacagagcaagactctgtctcaaaaaaattaaaaaaaaaaaaatagcataagatgtaagtagtcattaacatagctgagaatgttaaaaatgcttatttatttagacaagatacttgagtaattacatggtgcaggagatgccaaaggtacacagagagtgagatctgtggacaggcagggaaggaaacaagagatgtggcaatcttatctaggaggcttatcaggacaagaggcagacagacagtttcaaaaaggagcttctgattcagagtttgtaagtgaagtatggtaaatctcttaaaaatctcacctttgcagtaaaatactttttctctaaagaggagtgttgggaaacgttaagcctctccacgtgagccagaaggttccatttcaccttctttacacacaactggaaggtaacccatgctgtccatgctgttttgtaaatgagctgttgaactaacagtcaaatcctatattctaacagccacaaaacaaaacataatcaaggtttgttggatatacttagagaaggacatgctcttatgtcccaaatgataacccttttatcatgcttttatggactaatctctattggaaatatgtaacaaatgacctttgcctactaaaaaaatttttttctttgagacagggtgtcgctttgtcacccaggctggagtacagtggcacaatcttggctcactgcagcctggacctcctgggctcaggcgatcctcccgcctcagccccccccaagtagctgggactagaggctggtgtaccatgcctggctaattttttggtattttttgtagagacaggattttgctatgctgcctaggctagtctggagctcaagggatctgcctgccttggcctcctggagtgctgggattataggcatgagccaccgcacccagcctatgagatctttaaaatgctcatcgagcagcatgctagtgggattcagatagcgtttgggtgcataaatccaccaaattatatcttccttgaggcaaagtatctcattcttcatgagacctagaatgaatcacagaaactaaaatttggaaaagacatttaacagcatcttcatttattgaaaggaagagggtatgaagcaacttctatgctaaagtaagcctctggagagatctaacctctggagtgaacctaggagtcccaaatcccattcatagtttcacccaaggattcaaaataatatttactgagtactgactgtgtggcaagcattttctatgttatctaatttaatcttcctaacaatgctgtagagcaagagtatccctgtgctgcagacacttgctggaaactcaggctcagagaggtaaagtgaactgcccatgtggtcatggagtgaggaaatggtggagtctcagttcaaaccctggcccgatgtcaagcccatgttctttccactttccacattctttctattctgcctcccactaaagaaaacagcgtcttttttcctatgctttttttttattattgagatggagtctcactctgtcacccaggctggagtgcagtggtgcgatctcggctcactgcaacctctgccgctcgggttcaagtgattgtcgtgcctcagcctcccaagtagctgggactacaggcatgtgccaccacacccagctaatttttcggtattttttaatagaaacaggattttgctatgttggccaggctggtctcgaactcctgacctcaggtgatccaaccgcctcggcctcccaaagtgctgggattacaagtgtgagtcactgcacccggccttttcctatgctttttaaaaggataatacataaatgagattcatgacaccggcattgattttgggacccacatgcccgaggaatacactcacaggctctgcaaaagcattgtcccagagaacagtggccgtcgcattgttgtcctggctgccatgaacgatcaccaccactggcagggacagggtctaaaaagacacaagagaaggctgagcgcccacgagcctcaagttcttctccttctctcttttttttttttcttattataacaacacttttattttccaagtttcagttaatgttcctctcagacacagaatctaaatggccccaggaataatatgacttttcatactggcacaatcttagaaattttaaatattttacaagcaatgttgcttagatatttctgaaggataaagtttctcaaagttacatggagaacaggagagagaaaagactattggagatatttctgggaagaaaatacaaataacaaatttaaaacttaccacaacctttactcaaattcatcccaagtaatgtttctcatatccattttgtagtctacctctccagctagttcagttcattattgtttgttcatgttttattttttattttttaatttgttgttgttgttgagacggggtctcacaaccagctccaggctggtctggaactcctgaactcaagcaatcctcctgccttggcctcccaaagtgttaggattacagatgtgagccactgcactgggccttgcttgttcatgtcttttttttttttttttgagacagggtctcactctttcacccaggctggagtgcagtggcacaatctcggttcattacaacctcagcctcccaggttcaagtgattctcctgagtagctgggattataggcacgtgccaccacgcctggctaatttttgtactttttagtagagatggggtttcactgtgttagccaggctggtcttgaactcttgacctcaagtgacctgactgcctcaacctaccaaagtgctgggattacaagcatgagccactgtgcttggcctctgttcatgtcttaagagaacctaagtgaaacagttctcagggtgaggtcagtccattttcagtttaccaacagtcaaaaagaagaagatgctatgtgataaaaaaaaaatattttgtaacataaagtacaccacacacacacacgcacacgcacacgcagagctgagggaaggctttaccttgacttgaaaaaccagctcatttccaccaacactgaactgggattcaaacaggattgtaaatttttcttctgtcaccgactctgccccacgacggtctgacctcttaattcgtttcagggactacaaagaagaaacataagatgaaacgtaagatataagttgttcccctcaaagaccagggaaaaattcattcttcctcttcttccaccctcaccatattcctgaagtgggcactaagggtgcctgtggcttggtggtactccatgacgcagcagttgttcaagatctcgccactgtaatcactgcaaatcagagagagaccagctccaaacccatgccagggtctcaggacatgcggagtaaataatataatttggggtagcaggaaatagagaagtttgctaaaaatgtacgtcatttagaggaaatgttagctacataacacatacatgtaatcttctcggacgtatctctacaaaatgaaacaagatcaaactatcttcacagaaaacagttcctaagagaacttttttttttttttttgtgacggagttttgctcttgttgcccaggctggagtgcagtggcgtgatctcagctcactgcaatctcagctcactgcaatctctgcctcccaggttcaagggattctcctgcctcaggctctctagtggctgggattacaggtgcctgccaccacgcccggctaattttttgtatttttagtagagacagggtttcaccatgttggccaggctggtcttgaactcctgacctcaggtgatctgcccacctcggcctcttaaagtgcttggattacaggtgtgagccaccacaccaggcccaagaacttccttatattcctttgctgatgcccagaagaggccagaagggcaaacagggatctgacacaggaggcagaattctttttttcctgttgccaggacatgagacaagtagcagggaatgagaggaagctgcacaattacttgcgggtgttctcgttcttgagcagagacttggcctgctgctcactgatgatggtggccttcacctggggggggttcatgtgcacgttcagcttcccgcccaccagcaggcgcacagtggctgcaaacttggtctgggtcttcaggacctgaggaggctgcttctcaatgatgaacgtgctgcaggggacacagggacagatgcatgatgaggggctggtgcaggggaaagggctctcagtccctctgtggtgggggtggggctgcctcccgaggggctcaggaggtgaagagctcgggcacagcctctgttcctggggaagccgtgagagtccagggagaggatggagaggggagtgagataacacagaagctggcatgggctgcagcccaagggcatctcttgcagtgtccacaggagaaactgggcaagggccacagcaactggagatggagttgggagggatgagaggcaggaagtggatctgctggtctggaaggcacctgcggctccccccacgcaggcaggagctgccccaagctcctgggcatggcaaacaggcagcagtcacctggtcaccagggctgagataatgtccgtgatggtggcgttgacctcggccagcatctcctccactgggccggggatgggcagctgctggcagaggtgctcagccctgcggatctgctgccggttctgccagatgatctcggccaacttctcacacctgcacgagagccccaaggccaacaggaggacaatggctcctccgcacagacgccaggccccaagacacagctcccgttcccccaggaaggctctgtgctttcgccacacttcccacccatgggaagagcagagctccctgcctcccagaattagagacgtacacaggaggggcgaccctgactaggcccaaacagcccaagcatcaccccacacacccgaaccctgtcccatctccaggacagcagcccccttcctgggggaggtgcacaggatgggggccaaagtctgattgaggaaccaggctccctggagaaacaagagctgtcccaggatggagggggcctgctgcaggagccagcacaggacgcagaagcagccgggatccccaccagcccctcctgccctgcccgctggccgccccacaccattaccaggactgtagcacgtccaggctgccctcggggggcccgccgttcccggccagctgctgccgccgcttccactggatcagctcgtcatccaggatgatggtctgctgcttccgcagcagctgcagggtcttctggtgcttctcggccagctcctgagggaagggaggagagcagccccttctgggctcccagagaacaccgcagggcctcgctgggaaatggcagggcagggcccaggccgttccctctccccaagctgctctgcctcgcaaggcccccaggaaaaaaggcctcctgccctcccaggttctgctctcatgctggtcccagccctccctcgggtccccagagactgacttcatggcacccacgcccaggagaggcccaggaccccactcaccacgcggtactgctgcagtgtctgtgcctcacgctgcaaccaggcctccagagacacctgcttctgctggagggccgtctcccggctcagacgctcctgggggctcagctgggccagcgggccaaactgagctagaggaggggagaggaaaccatgaccatcacctcccagtgtccaacaggaggcccagagaagcccactcacccgttctggagcgagaccctcctgggctcagatactgcattaagggcaagtcggggttcctgacagccaggggggccaagatgaatgggtgccccaggaggcgcctctgggccctgctcgccagcctcctgactctgagccgtcccctctgggggcacacgggtgctggggcagctggggaggaggcctgcctgcctcctgcccgcctgcctcacagggctgccagccctcttctcgcggcccagcatgggtccaggctgtctggggtgtaagtgtgcccatgcccttgactgcaggtgaacctgggcaaatcgctttcctttcctgtgccttggcttccccacgtgtaaaacgggagattctcggcacctgcctcagtggggtgcattaagattaaatacatgaggacatggaagatgccagaaagctgcctgacatgggtgagctctgtgtgaggttcgtgcttcttggttaacggggaacaggacagagagaagaggtgacagagacaagcagctgctcggccccatccctcccgcagcaaggcctcttcagggaaacccagccccggcggctctgtctagtccctgagcacagcaatccctcctcaggggaggatgagattcttgagaggctggaaggggcccagcatgtttgtccaggtgagctcactgtgaacccagccaaccaaccagggaacacggacagacagacagaccgcagagggagagcatgtccagggccactggggatgcagagccaccaagattctctcaggaaagggaggccgaagggaggcggcttccctccacaccatctgtgaggagtctcattgatggcgggacagggagtaagttaggcctcattaccttttaaaaattattatgaaataggtaagacacagggaacgtggaacacaggagcacctgtgtatcaataacccaggctaagaaagtaaacatgtccacagttacaaccaccaccgcaggcccaccccaccctcccagcgacagcccgtctccaccacactgggactattaatcccttcccatcaccttctcaacagcccagagtccttgcttgagctgagtcagaagatgcgcgcaccagcatgtcttggtcgagctcctggctggcccctgagggccacgtcactctgaccccagccctgacccatgggatgcacaagctgggacagacaaaagcaactctatgtagccaggaacagcccagagctagaactcagaaatatggctccaatctcactgcaggtatcgagcaggaagaggatcatccagggacggacagatccaaggtatctgcacggctacctcaggaatcctgcccagccacagggagggtggtggtgatcccaacacctgggcccagccttcctatgcaagggacccacttagggctctcctggaaatttgcagaagcttttgggaaggaggccagggagacgggaagcaatttccctactccactggaggcagctgagccttccctggcaaaagcagatcaatagtctgtgtttctgctgagtgaacttgacaaatgggactgagaagacactgcgtgatagatccaaacccaacctgaatccaaacctaatccgccaccatgcacaggaaacagaaaagccaggcacgggatcagaaatactgttgacagtctaaggacttgggtaggaatagccatcccaaatcttccgtttccattctctgaaggagctgcccttcttctagggccagtctaggatggattcagataaaaaaggaagacaggctagaatcatcctgtcaacctttactcaataactgttatgtttcaggcattgtgctggcctcagggtacagagataaaagatatagtcccttctcaaagatttatattccagtggagaagataaagagtaaataagtagtatcactatagacataaaatggaacctacatacatggaattagaggagcatgtgctgtgtgtgtgtgtgtgtgctgtgtgtctatgtgtgtgtggtgtgtatgtgtggtgtgtgtgtgtgctatgtgtggtgtgtgtgtgctgtgtgtggtgtggtgtgtgtgtgctgtgtgtggtgtggtgtgtgtggtgtggtgtgtgtgtgctgtgtgtctgtgtgtgtgctgtgtgtggtgtgtgtgtgctgtgtgtgtgcactgtgtgtctctgtgtgctgtggggggtgtgtgtgctgtgtgtgtgtgtgctgtgtgtgtgatgtgtgtggtgtgtgtgtgtgctgtgttgtctgtgtgtgctgtgtgtgtgtgtgtttggaggggctgggtggttgagccaaggcttctctgagactgagctgggcatggaagcagagaggaaactattaaagctcaaactgccaaactgctacagggtcaaaagggggcgctggtggggctccacagcctcaccacagactgaagctctctgtgccccaactactaagcaggatttataccaggctagggaagctctgtccataagggctacctaaggggcgttaagtgtactctgtttcaggaagacctctgtgaataactgcatagaacattagaaatcatatacaggtccttagtacttacacgtacctgcttagaaaggtttcttttcccccttagagatagggtcttactatgttgcctaagctagtctgaaactactggcctcaagtgatcctcctgccctggcctcccaaagcaccaggattacaggtgtgcaaaaccactcccagcttagaattttttttttttttttttgagacagaattttgctctttttgtccaggctggagtgcaatggtgagatctcggctccctgcaacctccgcctcccgggttcaagagattctcttgcctcagcctcccaagtagctgggattacatgcatgcgccactgggatgcccagctaattttgtatttttagtagagacggggtttcaccatgttggccaggctggtctcgaactcctgacctcaggtgatccgcctgcctcagcctcccaaagtgctgggattacaggtgtgagccaccgtgcccagccagaaaaatttttaaacatgtaattatataatttcctatttatcatttcaataaagctccacttataatatgcctactatatacaaaagtattgtttgctagtatttatttagactgtgagctccttctcaaaagaagaaatgtcttccctggcagctcagaagctccctggatgtggggacctgagtgagatatgcacttaagcggggggtcctgtcatctccccttcctaaatctcatcctctcagcactgtcttcaatgcaaataagtccctgctactcagagaaaggtcgctgcctccgaatggaaagtgtgctttctcccaaccccaccagagctgctttccagtccccaggcccaatcctcaagttgcacaatgtgcctccaccgcgcctcaccttggatcctcaggctctcctggtactggatgatgaagtactcctgagtctgctgcagcttttttaactcattctctgtgtcctgcgtgaccagtcgcagctcctcaaacgtctggttgatctggaggtgtttctgggacatggcatcagcaaggcttccagctggagagctaccctgggaacatatggggggcagtgcaaggcagtgcgaatgggaggaagactgaggccttaatccccaggaaaagccagctcctacaaccagggtaagaccccaaaaggtaaattttgagtcgggaggaaaagcaaacgtcatcatgagacacagggtggagtgggaaaagtgagaaacaggtgagcggacagatcatggctcagatcacaaagcatgggagaagcttccatttcagatctgacctccaccagagtattccaaacgaggtccattgaattacctttggagaaactagaacgtaacctggtccagtgtcacctgggttttcctactaatgaggaggtggagtgattcctcttccactcactgacccaatgcaaggacggcattaagcattagggaggccatggggagcagggccatgtgaacacacatcatctgtgtcctcactcaagatattctcgtgatggaatcatttgcttccaccatggaagaggccaaacctcttgcaggcatcctggagaccccagggtgaagtgatgggggaggcataaacaaggtctctgtggacccagccctgtaagtgacctgatcagaccactccttccacacctgattcaggggctagggaaaagtctttcctaagtattctcacctgaatatgagcatgcctttactaaaaaattattcagctgaggttgaattactttgcacttgttcacattgtcttgtggttgcaatctcatcaaggttataaatcagttaagatcagagaccacatcttctatttcatttttttttttttgagacagggtctcactccatcacccatgagtgcaggggtgcgatcatggctcactgcagcctctacctcctgggctcaagggatcttcccacttcaggttttcgaacagccaggactacaggcatatgccaccatgcccagctaatttttttgtatttttggtagagacggggtttcatcatgttgcccagggtgctctcgaactcctgggctcaggcaatctgcctgcctcagcctcccaaagtgctgggctgcactcagtcaagtctcctatttcttttgtgccccttaggatgaagctctctttaaagagacaccaatagtgcaccctgagtcaccttgacaaaggtgggtccagagggaggtgggtaagaaaagacttcccgactgccctccccatccctatgggacactcacattgttggcttctcggaccaacctctgttcattgtacaatatatggcggatgcagcggaccagctccatggggcagcggtcatacgtgttctgaaagaatccaacagcagacatcactttgtgccactccacactatgggccctaaccatgcctcaggatggggagcctcctgagggacctcctgaatcacaggaggcactgttcctccaataccaacaggaacaagaaggcacatcatggaaatccaattgcagtgaaaaggtaagattgttttacttcttttttctttttttgagactgagtctcactctgttgcccaggctggagtgcagtggcacaacctcgggccactgcaacctctgcctcctgggttcaagtaattctcctgccttagccccccgagtagctgggattacaggggcccgccaccacgcctggctaatttttgtctttttagtagagatggggttccaccatgttggccaggctggtctcgaactcctgacctcaggtgatccacctgccttagcctcccaaagtgctgttttactttttgcatcttaatttgcctaaagtatccggggaacattcttaaaaacggaataaataagttttaaaagcctcgcaagaggagaaactggatgccactctcaaatgggcaatcaaaactactaccaccaatgaggggacgagggacactgcccccctctggatgtgatacccgagaaggacaagtcacctacaattgtcccttggcatctgtgggggctggttccaggacccacttggataccaaaatctgcagatgctcaagttccttatataaaatggcatcgttttgcatagaatgcatacaatcctcccatacactttaaaccacctatagattgcttatactatctaatacaaaagaaatgctatgtaaatagctgttctgtcatatctttatttctatttgtttttactttttttcttttcctgaatatttctgagctgcggttggtggaatcaggatgcagaacccatggacatggacagccaactatatttagaagtctgctcggagatgtgcaatgttaacgtaatcatgaggaaacatcagacaaaccccaaatgaggaacattttatctttaaaaagcagggggtacatgaattattattattattttttgagatggaatttcactcttgtcacccaggctggagtgcaatggcacggtctcggctcactgcaacctctgcctcccaggtttaagagattctcctgcctcagcctcccaagtagctgggattacagttgtccactgccacacccagttaatttctgtatttttagtagagatggggtttcaccatgttggccaggctggtctcgaactcctgacctcagatgattcacccgcctcagcctcccaaagtgctgggattactggtgtgagccactgcacccagcctacattaattattttaaaatgccaatgtaatgaaagacaaagtaaggttgcaaaatggttccagattaaaggagattaaagagacatgatgactagatgcaatatgtgatcttgggctggattctggactgcagcggggaaaaataccctaaaggacatgtttgaattagttgacaaaatggaaatccagatgagtacctaaaagtattatatcaatgctaaatttagtgaagttgatcagtgtattataaccatgcaagacaaggttcattcttagaaaatgcacagaggggctgggtgcggtggctcatgcctgtaatcccagcactttgggaggccgaggagggtgaatcacctgaggtcgggagttcgaaaccagcctgaccaacatggagaaaccccatctctactaaaaatacaaaaattaggcgggtgtggtggcatgcacctgtagtcccagctacttgggaggctgaggcaggagaatcacttgaacccgggaggtggaggttgcggtgagccgagaccgcgccactgcactccagcctgggcaacaagagtgaaactccatctcaaaaaaaaaaaaaaaaaaagacaatgcacagagggaccgggcatagtggctcatgcctataatttcaacactttgggaggctgaggtgggcggatcacctgaggtcaggagttcaagaccactgtggccaacatggcaaaaccccgtctccactaaaaataccaaaaaaaaaaaaaaactgccaggcatggtggcaggagcctgtaatcccagctacttgagaggctgaggcagaagaatcgcttgaacccgggaggcagaggttgcagtgagctgagattgctccactgcactccagcctgggcgacagagcaagactccgtctcaaaaataaataaataaataaataaataaataaataaatagaaaatgcacagaggtacttactggtgcagggacacaaggtatgcaacttactctccagtgactgaaaaacgtgtgtgtcgagagacagcgaggagtatatgacaacataaaagtcaacaacaggtgaatatgggcatatgtggggaatctttgtatgattcttgtaactttctggaagtatgaaattattctcaaataaaaagtaaaaaaaaaaaaaaagaccaaaaccacacaacaagaaccttatgcacgtgtaactcaacaatgctggactgaaggagagaaagaaagtctctacaggaagaagacccccaagggaaggtaattaagtgtgaccccagagcccacacccacctggagctgtgtggcatagtgccccagcttgatcttcagtaaaaacccatcttcccccacctggtgctctgccttcttctgcagctcctgcaccaggccctccaggagctgggtggccttaatgttctcctgtggattatcaagatctactgagtccctaggggaaaaaaattacataatctgtatacatacatgcacgtgagcctgtataaatacagcctcaacacatcctactttttcttcaactaaagtgatgtttttaatcctcactgcaaattttaagaaacagcccaacagaaatggactcaatgcctatgttaatctatttgtaatttactaaatagttggattatacagtagatttccttcttttaaaaaaaaaaatttttaacaatgtgctgcccttcttcctttctctcaatgatgtgcttggtgcttatgctatttgctccgagaaatgcaaggaaaaggaaagggttctgtgtactctgaaggaaataaggacttggataatttcctatttatagttacccctcatgggtgtaaaggaggcacaaggccaagactcttctacatgtcctttccagcctcaaggagtttggtatctgtgggtttcttaggtagagacaggtgaaacaagttattgctatttctaagaagccctggaaatgagacattcaggcagagggtgcctacaagaatttatacgagtcagacattcatgtcactagttgcagacccaggacctgaaggcaatgccaacttttccagtaaacaaggaaaaccacgctacagactttgcattgatttcaagctactgaactggtgacgggggttggatggtctccctccctcctttctttccttctttccttctttccttccgttccttccttcctttctactacttaggcaacaattgacactgggaagtaccaaattacttactcactgaagaaaccaaacagctgtcggactgaaataacattcaataactgctgactgggtctggagccaaacaagatagtggtagctaaaaggctctgccatccctaaatccctgaagatagcaactaatttcaaaaaagaggcaccaacaagtgtatcaaaacagtgagaccggccgggcgtggtggctcacgcctgtgatcctagcattttgggaggccgaggcaggcggattacctgagctcaggagttggagatcagcctgggcaacacggtgaaaccccatctctactaaaacacaaaagaaattatccgggcgtggcggcatgtgcctgtagtcccagctacttgggaggctgaggcaggagaactgcttgaacccaggaggtggaggttgcagtgagccaagattgcgccactgcactccagcctgggtgacaaagcaagattctctctacgaaaacataacaaaacaaaacaaaaaaagcagtgataccatagtccatcaaatagtacaccccaatctgcgccttgagaaggcagttaaggcaagtcagattctaaatatgtgtgccctatgtattaaatagaatacgtattaaatgaaaggctggaaggaatgagggcagccctgcacctctgtttcaactggcaacaatgcccttggtctggaaacccactctttttctttgagacgaagtctcactctgtcacccaggctgggatgcagtagcacgatcttagctcactgcaacctctgcctcccgggttcaagtgattctcctgcctcagcctcccaagtagctggaattacaggcgtgcaccaccacgcctggctaatttttgtatttttaatagagacggggttttaccatgttggccaggctggtctcaaactcctgatctcaagtgatccacccacctcagcctcccaaagtgctgggattacaggcgtgagccaccgtgcccggccaggagcccactcttaaaaggatccagtctctgagcaaaactcacagaagtcaggtattggttctttacttgaaaccttaattctctgttaaaaaaaaaaaagacttgcttagatggcttaaacataaagaactaaagatttggctgggcccggtggctcaagcttttaatcccagcactttgggaggccgaaatgggcagatcacaaggtcaggagttagagaccagcctggccaacatgatgaaaccccgtctctattaaaaatacaaaaattagctcggtgtggtggcgggcacctgcagtcccagctactcgggaagctgaggcacgagaattgcttgaacccgggaggcggagattgcagtgagccgagatcacgccactgcagcctggtgacagagcgagactccatctcaaaaaaaaaaaagaattgaaaattcttcattaaaatctttatattctgaagaaaaccaaagctaaaaaatttcaagttttccttaatatcaacacaagtcttttaattcattcagtgagaacaccaaatgagaactctgctaagtgaaatctgaaattaacagcaacttcctactcatgtttttctaaatcctccacatcagaaaacaggagagaaaatgaaaagggagtggaaagcactaaacgaggtacagctgacattctcatatttagctaatttttttccctcacttaattacatgaagttgagtttttttttaattgcctagaaaattgcctttctttggtgatctttagtttctgaacagaaatttgctactaacacgcattgcgattattctaaggcaacattacagacaggtatatggccctttgcaaatagcagcatcaaagctggttctctcagggactgtcaaagaggacccatggctaagacggtgaggcttgaagtatcaaatgaatatgtcagatcgactgacagactgtaaccaaccagcaacctcccagaccttgagcagagcagtgtacatcctgctgcctggtgtgtaataatgataccaattaaaaacctgtgctgttagtcgactgcactgtactaattctaaaagaaatttaaaacaactctcccctcccccaagtatgtaatcagtaatctggaaaataaagaaaaattaaaatgcttatcaaatctaccaccagaatgtaattagtgttaacatttgggtatattttcgtttagttttgttttttttttttaaaggcagtctcactctgttgcccaggctggagtgcagtagtgcgatctcggctcactgcaacctctgcctcccgacttcaagcgattctcatgctttagcctccagagtagctgggattacaggcgcccgtcaccacgcccaactaattttttgtattttcagtagagatgggattttgccatgttggccaggcttgtctcagaactcctggcctccagtgatctgcctgccttggcctcccaaagtgctgggattacaggcatgagccacaacacccactcaattttcttttagtctttatgtgtatatataaaatacatataaattaaaaacaccaatgtctccactgttaaattattaatttttagttttttgttagatgtaaacttattaagaaatgtaaaataatttatatttaataaactataagaaataaattataattaaattatatgcatattcacacctatctgccccattaaacactaaattattattattattttttgacataggatcttgctatgttgcctaggctggcctcaaactgctggggtcaagcaatcctcccacctcagcatcctgggtagctgggattataggtgtgcaccaccatgtccagtgaaacactgaattatctggagatgagggctttaattttgtttgtttgtttgttttgagacagggtctcactctgttgcttaggctggagtgtagtggtgtgatcatgggttacagcaacctttgcctcccaggctcaagtgatcctcccacctcagcctcccaagtagctggtactacaggtgcacaccaccacacctggctaatttttgtattttgtacagagacagggttttgctatgttgctcaggccttccttgaactcctgggctcaagcagtacacctgccttggcctcccaaagtgttgggattacaacacaatgttgggctttaatttttttcatataaattctactacttaggacactgctaggcatcccatgggcactcgaaacatatttgttggctgctctttcttagcagtaatattctaatgcttttagacagtatttactattaaaggggaacaaatcctgttttaaaaatcccaagagttattccatcccctcaatctaagatgggcttaaatacctttcacctataaaaagaaaaaaaattttaaatacctttttatggatcacatttaaaaatgtttaaaaatacaactttgaaagttgccatcatgacatctttctaaacaaactccaatattcttgtgtttcacaaaatatgatgcaaacatccttgttcacctaccatgcttggctttcaatccactgggataaataatgccgcacctcaatgggaaaatgctggccatataacgcttgcatctgatgaagggcttctccttggagctgctgagcttgtatccacacagccatggtttacaatctgttgaacaaacaatcagtgctttgggcgttttttctttattttccccttacatccaccagagtaaatattcacttagttaccaaggtaaatgtttttattttattatttatttttatttttatttttttgagacagtctcgctctgccacccaagctggagtgcagtggcacaatcttggctcactacaacctccgcctccccggttcaaatgattctcctgtctcagcctcctgagtagctgggattacaggggcacactaccatgcttggttaatttttgtatttttagtagagatggggtttcaccgtgttggccaggctggtctcgaactcctgaccttaagtgatcctcccacctcagcctcctaaagtgctgggattacaggcgtgagccaccacgtttggccaaagtaaatgtttttagcccttttggtagactaaagacaatattcttgaactgaattttaactttaaaatgttttcaaaatgtagacactcagcctggccatggaaagatacacagctgggtctatgaagctctgactatgaaatgtactaaggtcttataagcaaaagtacaaaaggagaattagggaaagaattgctaactttgacatcgtagacatattctttacttttgttcaaaattgtcagccatggtaagcagcatttcaacagtaataaataattagcagagagtttttttttttttttttttgagacagagtcttgctctgttgcccagactggagggcagtggcaagatctcggctcactgcaacctctgcctcccgggttcaagcaattctactgcctcagcctcccaagtagctgagattacaggtgcccgccaccgcacccagctaatttttgtattttcagtagagatggggtttcaccatgttggccaggatggtctcaaactcctgacctcaagtgatccatctcagctcccaaagggctggggttataggtgtgagccactgcgcccagctgagagattttttttaaaaaatcacttgttttagatttggtattttgacttcagaaatataataaacatatgccattttgaaaaagcccagtaaaagaaaagtgaaaatatctgaagtgttgattgaaccctatgcattatcactagttacctaagcagcaatgctttgcacacaaagagcacagatttatctggaaaaatgcccgaaggttcacctcctgagttactgctaaggaatttatgaagcaatgttgttaaattatagcatttacaaatctttcagacacaaaaacaatacattccacctaagagttggaaatatgaaccattatactccaatagcaggtagtttctttttttttttttttaatttgagacggagtcttgctctgttgcccaggctggagtgccgtgacgcgatctcagctcactgctagccccgcctcccgggttcacgccattctcctgcctcagcctcccgagtggctgggactacaggcgcccgccaccacgcccggataattttttgtacttttagcagagatggggtttcaccgtgttagccaggatggtctcgatatcctgaccttgtgatccgcccacctcagcctcccaaagtgctggaattacaggtgtgagccactgcacccagccggtagtttctttttttaacatgctcttgattttttaaagaaaggctttataaaactaccatgatgcccccctcagactcacctgacaatttttaactcatctggcagatgctctttgagtttaaccagattagggcagaaacatttgggtagactgggaagggacttcaggtaactctaaggactgaaaatgaatcttgctctaacactattttccataatgtagagtttggtataaggcagggttatcttgaattccatcccacatgatttggctactgatttgcacaattcttctaagaactaggttacagttaggggccggtgacttggacttggattttgtttactaccagagactgtacaagtgtgtcaggaaataaaaatctcttctgttagttgtagttgtctgatcacgtaacactgggctatttatgggacaagtcagttagccaacaatgaggtgtaggggagtgccagttatctattttagactagtgcaatgctatagaacacttgagaagtgtattatttagggcttttaggcattaaggctgggatcactgtagacccaatttgacccaagacatcaaatttcagtggttgtgagttcaccaaaacacttagataaaagagctctctccagaagcaattccactttataatcaaacactggaagtcacttaactgcacaatgtattttttaatcaaataaatcatatcgcaagattttggaaaaccagaacagataccaaatcatgatttttggatgaaggataaggaatggatggccaggcatggtggctcacgcttgtaatcccagcacttcaggaggctgaggtgggtggatcacctgaggtcaggagttcgggacaagcctggccaacatggcgaaaccccgtctctactaaaattacaaaacaattagccaggtgtggtgccatgcgtctataattccagctacttgggaggctgaggcaggagaatcgcttgaatctgggtggcagaggtggcagtgagccgagattacatcactgcactccagcctggcaagagagccagattttgtctcaagaaaaaaaattatataagggatggatgaatgaaggtgcttaggcacttaagtatatggaagagtgataaaagaatgaagagaagaatctaggtgttagtattcctaagtagtaaagagtaagaagtaggccctcaccatagctctcaatgaatatgtgagtgataccaacagatacaaaaattctcttgcatctgcattcattaggtgaattgacttcagagacaaaagaaggaaagctatgaaaacttttatctccccagagactccttcccagcccactcaaataaaacggcattctggtcactctctatcctcttaatctgctttatttttcttatcatttatcaattcctgatattgatcatatatttgcttactgacttcccaccagggtgaaatcaccatgaacacaatgactttgttttgttcaccgtgctttctcctgggtctagaacggtacctggcacataagcatcataatttttttgttgcataaataaatgtatacacacaatttgaccgattctattggctcttttcaaagttataattgaacaatatatcagtatgaaacaccaaggcatgaaaatggaacagatttccatttaaataatcaattacaattttttttttttttgagacggagtcttgctctgtcgcccagactggagtgcagatatctcagctcgctgcaggctttgcctcccgggttcaagcaattctcctgcctcagcctcccgagtagctgggactacaggcacacaccgccacgcccagctaagttttgtatttttagtagagatggggtttcaccatgttggccaggatggtcttggtctcctgacctcgtgatctgccctcctcggcctcccaaagtgctgggattacaggcgtgagccaccacgctcggccaggagcacatcttattcacgactgtgtccccagtgtctagtacggtggcttgcctatggaaagtggtcaaaaaatacttgcggagcgaataaatacacaaacaaatatttaacattccctgctggtcaagcatatttaggagcctattactgttttaggaaagaaatactgtggtgatatactatgcatgtaggggtattaaaaaatgtcactctattttgccttaaattttagattatttcttagttttcatcaaagagtagaatgctgagctcttagaatttgtagaatatttttatgattctagttatgaacatgccataataattattttctaaaatagcatcccatttgaaggataatagctggtaaataccaagtggcaatcaccttattttgataaatacaatatagtttcactacacataagtgctttgatagagctggagagtagattctgctcactgctattcaaaagtgtaaaataaaagtacactaactagtacagagtcatttttattttactgttaaactgaaaattatctatatgtgaaatatgagatgacttactgagattatcattataaattctaaacacccagtttaggaaaaaaccaactgttctcccagttacgtgaataacacctagaagctatgtagtggttttttgtttgtttgttttttgagacggagtctcactctgtcgcctaggctggagtgcagtggcatgatctcggctcactgcagcctctgcctcccgagttcaagcgattctcctgcctcagcctcctgagtacctgggactacaggcactcaccaccacgcctggctaattttttttagtagagatggggtttcaccatgttggccaggttggtcttgaactactgacctcaggtgacctgcccgcctcggcctcccaaagtgctgggattacaggcgtgagccagcgtgcctggcagttaagtagtatttttcttcatacatgtcacaactcttcaccccattatcaggctatgtccacatgcctgatatgagtagcattcatctaaccggcattcatccttctaactggcattcatctagccatcgaacgctactctgcatctacaaagactgtacctctgtccccagtacccgccatcttctgcttatttacgggcagctccaatttcagtgcgtgatgctcagacaagggaagtagtttgttctttggtaaatcatcacaggggattctctaaagactgggaaatggattcacaatcttatttttaggccaaagatgagaactatttgagctcggctgagttgcactctgtgttcacagacatttcagaacaacctaagacagccctggatgcagaaccctgtactttctgaaggcataaagcacctacctcaaccttatatatctggatatacccatgggcttggagagccaaataaatcagtcgggccctcaggcacttgttaataaaagtttcaaagtctaatagctcataatgttacaggcttactgaaaaccataaaaatgaatgtccaccacataaataaatgatataagtgagtgggatttggaataattttgtctcagtcataaatatcttttctcagatgcttttcctttctaaaagtaaaatataaactataacaaagaaaaacattactctctctctgaagacttgtagaacactgtgaccaaggtcttgccctagctaaactgcagtggagagtagtgtctgacattagaaggcccactgtgtatctgccaactcagtgaatgaattctagtgtggggtgggagtagggggttaatatgaataatattatgcataatatgaataatatgaatccagcagatttggtctgctggattcatatgtataatttaaagcattttgtaattccgattctccatcctaccccccatcccagggccaaagtctctaaactggggttaaacttttagagatgatgctgaactcacctaaatacggttctgccaaagacagcctgttaagcctctctgtgcctcagttttcttatttgtacaatgggaataataatacttatgccccttagggggctgctgtaagaatgaattagttttatgtacatacctaaaacagtatctagctaagagcaggtgctctgtaagtactcactactgttcttactgttaccttaaacttacaaaaccggcttctttctcccatctctaattttaactcaatttaataaactttccaaaaatcaatcctccacaaatagctcttgctatccttctccttaaccaatatcctccagtataaacttttctatccatccatccatccatccatccatccatccatccatccatccatccatccatccgagacagggtcttactccatcactcaggctggagtgcagtggtgtgatcatggttcactgcagcctcaaactcctgggcttgagggatactcctacctcagccacccaagtagctaggactgtgggcacatgccatcacacctggctaattaaagaaaaaaacttttttttttttttttgtagagacaaggtcttactatgttgcccaggctggtctcaaactcctcacctcaagtgatcctcccaagtcagcctcccccagagtgctgggattagaggcacaagccattgtgcctggcctttttttttttttttttttttaaggcagagtctcgttctgtcacccaggctggagtgcagtggcgtgacctgggctcactgcaacctccgcctcccgggtttaagcaattatctgcctcagcctcctaagcagctgggattacagctgcccgccaccacgcctggctaattttgtatttttagtagagatggagttttaccatcttggccaggctggtcttgaacttctgaccttgtgatccacccacctcggcctcccaaagtgctgggattacaggctgtgctgggcccttttaaaagatggcattcctatttcttaatcaatttcactggcacaaggacttctgcagacaggaactcttgggaggtggtggtggaaaggcaccatgaagtctgttctctcatctttgaatgaaagaatggagaattgtgaagggtgagggtggtacagtaacagcaaggctttgattttgccctatgcatactaaactcttaaaaaaaaaagaaaaaagaagaggccgggtgcggtggctcatgcctgtaatcccagcactctgggaggccgaggtgggtggatcatgaggtcaagagatcaagaccatcctggccaaaatggtgaaaacccatctctactaaaaatacaaaaattagctgggcgtggtgccatgctcctgtagtcccagctactcaggaggctgaggcagaagaatcgcttgaacccaggaggcagaggttgcagtgagccaagatcatgccactgcactccaagctggcgacagagcaagactctgtctcaaaaaaaaaaaaaaaaaaaaaggagaagaaaactacctattccattccttctaatatgttgttgaacagagaggactaagccagcagggagccatgcctttacctattccttccaaggacatatctgacttttaataattaaagtacaaaaaacaactaatgaaatttgaagttttcatttattatactgctttatgaattattagcaacaaatatttcaattcatctaataaataaaaataaacttcagaaataggataagaaataaataacatttatcagtgttattattatcccccatccagatttaagagctagctaagcacttagtatattacttataacaagtgcttttatgaatctactctttatcctaaatccctcagacgtaggcactattattatccccgttatggatgaggaaattgagggtcatcaagattaagtagaattgtaacatggtgaaacagttttggaaaactatctggcaattctacaaaagggtaaacatagagttactacattatccagtagttccactcctgggtatatgcctaagagaagtgaaaacatgtgtccccagaaagtgggtacacaggccaggtgcagtggctcacgcctgtaatcccagcactttgggacgctgaggcgggtggatcacctgaggtcaggagctcgagaccagcctggccaacatggcgaaaccccatctctactaaaaattaaaaaagaaaaaaatgagccgggcacggtggcgggtgcctgtaatcccagctatttgggagactgaggcaggggaattgcttgaatctgggaggtggaggttgcagtgagccgagatctgtgccactgcactccagcctggatgacagggcaagcacagcaagactctgtctcaaaaacaaagcaaaacaaaaaacaggtacacaaatgttcacagctgcattattcataatcacctcataatcgccccaaagtggaaacaactcaaatgtccaccaaaggataaacagataaatatggataggaatggataaatacaatgaataaaatggaatattatgcagatgttaaaaaggaatgaagtactgacgcatgctacagtgtggatgaccttgaaatcattatgtaaagtgaaaggcatgcaagggaacatactgtaaattccatttttatgaaatatccggaataggcaaatccatagagacggaaaatagattgttggttgccaagggctgaggggagggagaaatggggaatgattgctaaaaggtaagggctttttgaggggatgatgaaaatgttccggaattagatagtggtgataattgtataactctgagaatatacttcaaagggtgaattttatagtgcgtgattatatctcagtaaagctatttttaaaaagagaaagaggtgaaacacttgctccagggtcggtccatactactaaggggtactatctgggctggacctacctgagaacctgcacttacttgcaccactgcaccaggctgcatgcatgttgaggacttaaggtggtttgccattttctatgtacttttctgcctgtttgttatatttcataatttaaagagagcaaagaatgaaaaattaaagtaagaaacctaatactgaggggctctgattttggcaaaggctagggctgggtgacagatcaaagagatgacgtttaaacattgcttctgatctgaaaagtacaaggcaaggagccagggttcaaaactgttaaacctatcagctccagtgaatgactaaggattctgtacagaatataaagagcaagttccagccaggcgtggtggctcatgcttgtaatcccatactttgtgaggcagaggcgggcagatcacctgaggttgggagttcaagaccagcctgaccaacatggagaaaccctgtctctactaaaaatacaaaaaattagccaggcgtggtggtgcatgcctgtaatcccagctacttgggatgctgaggcaggagaatctcttgaacctgggaggtagaagttgcggtgagctgagatcgcaccattgcactccagcattggcaacaagagtgaaactccatctcaaaaaaaaaaaaaaaaagagcaaattccctaattatgtttactgctttctgttgataccaacattattaaatatattaaatggtggtggtcacctagtacagcaatttttttttttttttgagacagagtcttgctctgtcacccaggctggagtgcagtggcatgatcttggctcactgcaacctctgcctcccgggttcaagagattctcctgccttagcctcctgagtagctggaattacaggcatgtgccactgtgtctggctaatttttggatttttagtagaggcagggttttaccatgttggccaggctggtcttgaactcctgacctcaagtgatccacccacctcggcctcccaaagtgttgggattacaggcctgagccaccatgcctagcctagtatagcgattttgagggacggaaaaatattcaatagcagcaataaaggattaagacttcattcatattaaaattggactaatatcaagtaagaaggctatcacatctagaagcaggttaataccagagccatctgctctttaattttttttttctaaatactaccctatatgcaatcaggaagccaattctctttttaaaaaatcacattattaaacagatgggaagagaacagaaagaataaaagcatttggctcacaaagaagcaaacaaggaaaaatgtgcccaggcaacatagagatgatagtattctgggaagacaatccgccattaatctttatgtcacagccaaatcactgcatattacaataggaagaacagagaatggaggaggggaaaagggtaagggagggaataaaggagaaggtagagaaaggatctacttactaaatataaaaatcaggtttcaatcagcaggttactatatatttaaaactctcatctaaatataggatataaagtcttggccaaagatgcacaatctcaaaaataaagagagtagactcagacaaggatcatcacagctactaaaaccattaggtgacagttgttggggaacagcatttagtctcaaagtactactcacatattacttattattcaaaggggaaaaggtgcatttctgtggataaatctggcggacaatgccttaaccgagtgatcaaacatccccaatcatggcataaactgacattatgtgcctccagatatgatttgctgaaaagaatacacaaactaaatcatgaagaaacaatcagacaaatccaaattgtgagactctaatcaatgatcccaccccccacccaaaacaggtggaactgttctaggttaaaggagactgaagagacacaaccaagagcgtaattcaaaaacaaaaacacgactgggtgtggtggctcatgcctgtaatcccagcactttgggaggccaagcccagaggatcactcaaggtcaagcattcgagaccagcctggccaacatggtgaaaccctgtctctactaaaaatacaaaaattgtacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggccacagggtccctctgcctaggaaaaccagagacctttgttcacttgtttatctgctgaccttccctccactattgtcctgtgaccctgccaaatccccctctgcgagaaacacccaagaatgatcaattaaaaaaaaaaaatgttaaaaataaactttaaaaaatatatgtgtttatacttaaaaaaaataaataaaaaaaaaatataaaaattagttgggcgtggtggcacacgcctgtagttgcagctactctgaaggctgaggcacaagaatctcttgaacccgggaggcagaggttgtggtgagctgagattgcgccacttgcactccaggctgggcaactgagtgagactctgtctcaaaacaaacaaaaacacccacagctctaaaggccattatatcattatatattagatattactttatcactgctaaatttcttgagagtgacaatggcattcaggttgcgtagaagaatgcccttgctgggagtagatacactgtcaagtatttgagggtaaatggccatgtcgtctgcatcttactttggcaggagaaacggaagagtgacagtggtggggagtgtgggaaagtaaatctaacaactgtgaacactggctcaacctaggtgaagtatatgcgagtactcattgttctattctttccacttttaagtcatgtacacttttttcaaaatcaaaatgaagggcaaacattccaaaaaagaaaaacaaagcaatgaaagcagaggtttgactctcactttgaaactgtccctggtggtcaataaaaatctggacttcttaggcgttgtgctgcagcttgcaggccaccagcatgcaagttgggctctcttgtgccatggtggcccacagtgtacatgtgttatcattatctccatgtccaaatccatggagataatggatttgcgatccctttgggaagaagctacatctgtatcactttccagatgactaaaagcacttgctgtagcccaaaattaatgaccatctgcattacggaaaaataagaaatgatttgaagctgccatgtagtcctatcttaccttcagaatttttttctttcttttcttttctttttttttttttgagacagggtctcactctgtcactcaggctgaagtgctatggcgtaatcactgctcactgcagtctcaacctcctgggttcaggtgatcctcctcccttagccccctgagtagctgggaccacaggtgtgtgccaccatgcccggctaatttttttttttttttttttagagatggggtcttgctatgttgcccaggctggtcatgaactcctgggctcaagtgatcctcttacctcggcctcccaaagtgctgggatgacaagtgtgagccaccacacccagccagcctcagaatttctagtgaaggtttatatttgtactgtaattcaagatcaactcatcttagaatctgtctcttggacaattcaaatcttttagttcaggaaaaaaactcctcagctactacaataccctgtttctatactgcttaaatgaaatataatccctttcctcttgtttgaaagttaaaaacaaacaaaacaggcaatttattaataaatccacacatgttaccaatattttccctattaaagttcatggcctccctcttaccattgagaattacagtgtttagtttctacctagcaaaattttctttgacaagtgccttgattcaggccaattcccagggatatataccgtcgggacaaacagaaataaccaaaatgtccaaaatagggggatgattagactataatgtattaatctaatgggatatggtgcaaccagttaaatgaaatataaaagctatgttgaaatataaaaaccatgtagacgcatttttaaatttttattttatttatttatttttttgagacagagtcttgctctttcaaccgggttaaagtgcagtggcacaatcttggctcactgcaacccccaccgctcgtgttcaaccaattctcttgtctcagcctcctgagcagctgggaccatagataggcatctgccaccaatgcctggctaattttttttttttttttttttttgagatggagtctcactctgtcacccaggttggagtgcagtggcgcgatctcggctcactgcaacctctgcctcccaggttcaagcgattctcctgcctcagcctcccgaatagctgggactacaggcacgcgccaccatgcccagctaatttttgtagttttagtagagacagggtttcaccatgttggccaagatggtctcgacctcatgaccttgtgatccgcccaccttggcctcccaaagtgctggaattacaggcgtgagctaccgcgcctggctgagtcttgctctttcaacagggttaaagtgcagtggcatgatcttggctcactgcaacccccacctctcgcgttcatgcaattctcttgtctcagcctcctgagcagctgggaccataggcatctgccaccaatgcctggctaattttttatttttatttttttgagacggagttttgctcttattgcccaggctggagtgtaatggcgcgatcttggctcactgcaacctccgccccccaggttcaagcaattctcctgcctcagcctcccgagtagctgggattacaggtgcccaccaccatgcccggctaattttttgtatttttaatagagacgggttttcaccatgttggccaggctggtttcgaactcctgacctcgggtgatctgcccacctcggcctcccaaagtgctggaattacaggcgtgagccaccccgcccagccctaatttttgtatttttagtagagatggggtttcaccatgttggccagcctggtgtccaactcttggccttgtgatcctcccacctcggcctcccaaactgctgggattacagatgtgagccatcacacctggcctgtagacacatttttttagagtagaaataaaagaatgttaaatgaaaagtgtatgcaacacgtatgcaagagggcaaatagagaaaggtcaaagagaagtgtaaacagttgttacatttaggtgaaggggctttttggtacaatttttgtaaagtttttgattaaattgtgtttaaaatgtaaaacttaagatataaatttaataatcaatggggaattggtactactgactatcccacaggaaccaagtttaaagagacataaaacacaggaagaaatatttcctaacatgataatatccaggttatgacactgtcttacctgggcagccttgatttaagtagaacattcagaattataaagtaaaaattcagaattataaaaaaattttaattttaagtagaacattcagaattataaagtaaaaattcagaattataaaaaaattttttttaaaatgcaattctttcactttcaaatatatagtgccttaaatgtgttttcaaatagtgatttaagactgttaatagcagattaatttgtaattctgacatatatttatatatattagtggccctctttcatctttgatgtgactaagcaaacttgtaccaactgtaaatagaacgaaatacacagaaagtcactcacaacggtaccagaatttctttaaaataaaaaactttctagctgggcatggtgactcacttctgcagtccaagctactcaggaggctgagacaggagcgctcccaggaggtcaaggctgcagtgagctatgatcacgccgctatgctcaagcctgagccacaaagtgagaccccatttctaaacacaaacaaacacatcccttacctctaatcacatacctgaacacaactggcttacgtgaaggccgttgacagttcaagagtaacaattcaaggtgtctagaaagctatcattacaagagcagatcacaggaaacctcagctgttggttcctaacttcgctcctactcaaaggccaacagaaccggggagaaatcttcctgttttgttgatatcaatttattttgtgccaagaacctatacctaaaaccaacgcagggtttgtattccccctggattcttcattaccccaggaaagtggaacagatcagaccagtttccaagaacagaagcactgcagggcaatcttgctaagggggccctgagatgtttctctctgtactaatctctatgtcttttatgtacatcaacacaaaccttcacccaaccatctctgccatcaacagcaaatctagggaagagaccaataataccttagaaaagcacacctatccaccgaaccaaaactaaatacagaaggatatggcagtttgccccgttttccaggtagctgtgttctcttaatttgccatgaattaaaatgtttcatttttacttagacataacttgaatatgtcatttcaaataacaaaataaaaactgaactgaatatgttttagttaaaacaatacaaaactgaaatctcctcttttaagagagaaacgcttcatcagctggttagttcccttgtttgcttactgggtgatatgaaacccaactacagctttccaaaaataatcccaagttgtggggtgtcctactacctgtgtttaagtaaaacaagtcctgcagaaaaagtggatccaacgagtagcaggtttgttaagaagctaaatcttggccaggtgtagtggctcacacctgtaatctcagcactttgggaggctgaggcaggaggatcacctgagctcaggagttcaagaccagcttgggcaacatatcaaggctctgtctttacaaagaaagcaaaacaaaaagtagtagcgtgtggtggcgcacacctgtagtcttagttacttgggaggatgaggtgggagaatcacttgagcctaggagttagtagctgcagtgaactatgattgcgccactgcatgccagatggatgacagagccagactcattctctaaaaaaaaaaaaaatgtatgagaaaaagaagaagataattctgggccaggcacagtggctcatgcctgtaaacccagcactctgggaggccgagatgggaagactgattaggccaggagtttgaaacaagcctaggcgacatagtgagactccatctctacaaaaaatttacaaattagcccagtgtggtggcgcatgcctgtagttctagctactcaggagacaggcagaagaactgcttaagcccaggagtttgaggctgctgtgagccgtgattgtgtcgctgcactccagcctgggtgacattgtaagatcttgtccaaaaaaaaaaaaaaaaaaaaaaatcttattctaattctgagaagaaatgacatttaataagagctcatgtcttagcaaatcaaaatgtttgtcctgctggggaaaaaaaaaaaacaacaacggttatccaggtataaaaagcaattaccaggacatttaacattaagatgaactaaaattgtgcacaaaataattgtccacatttactacagcactcatagtgggagtaaataaaatgcaattacttttgctaaagcaacctactttttctggtaacagaccgtctctcactatacctctaatagtagatctacacacaacttagcatggtgtaggaacttgagtgcatgctcctacagcacacaacagatgcactgaaaggctcccacctcttaactaacagcttatgctgcaaggcatcagccaggataacggcagagcccttctgtgtatgtgttctttcacaggcggcactgttaccggaagaagcgaagagcagcgatttccttccaaaaggtcagctgcctcagacagaccaaacagaaagcagcgaattcttgccaacttcccctcctgcttctgcagctagtacgcaatagcatttagtttccagtaaagctccagataaaaacaaagcaaatgtgagacccagaatctacacaatgtcagtgtctcgcttgactgaacgaagggcagtaagatcatatggagctacgctttttcaacgtggtggaagtgttaggaaggtgagattaaacatgaagaaaaggtcaggactggaaccatccagattttataccaatgtccagaagtctccatctaaaaataagatggtaggctgggtgaggtggctcaggcctgtaatcccagcactttgggaggccaaggccagtggatcacttgaggtcaggagtttgagaccagtctggctagcatggtgaaaccccgtctctaccaaaaatatacaaaattagctgggtgtggtggcgcgtgactgtaatcccagctactcgggaggctgaggcaggagaattgcttgaacctgggaggtggaggtagcagagagccaagattgcaccactgcactccagcctgggcaacagagtgagactctatctcaaaaaaaataaaaagaaaaagaagatggtattttagagataataaatgcaacaacagataaggtccctagtcaactgataaaaaaagaataaattttgaacttattctcaaaataaagtcaagtcagtcattctgcaacatgctagggcacaggcaaggttcaatgctgacaaccagtagatatatatacaatgaatatataagtttcttagattagacatggagaaaagactgtaaaacacataacaaaaaggggaagaggatagaaaatataatttttttttttgagacagggtctcaccctgtcacccatgctggagtgcagtggcgtgatctcagctccctgcaacctctgcctcccaggctctagcaatcctcttgtctcagtctcctgagtagctgggaccacaggtgtgtgccactatgcctggctcattttttgtatttttagtagaaacggggcttcattatgttgcccaggctggtctcgaactcttgaactcaagcgctccacccacctcggccctccaaagtgctgggatgacaggcgtgagccactgcaccaaacccagacttctttaaattaagagagtgttaaactacatgaaagcctacgcattcaatcttcccagaggagcaaaattagacccttttgagtataaaagtgaaggagaaggaagggaaaatgatgattttaaacatttttctcaaccagatcggttcccggcttaactatctacacaaaacttgcgagaaaatgttacgagctcctaccccatgtcgttggctctatgtggtttctaactcgttagtttcaggttgtggtggcaacagagacaccaggctttttgtgagacaagctcttgttctaaaatgtctgggctttgatgatggagagtattttaaccccactctgagaatacctagtttgaaatgaagatagtatggagttcaaggaaaaacgtattagtttgttatgttaaattaagccacccacacacccacactagaaactgttttgtgttggaaacaaaataaatgacttcatttccaagcccttcctatacttcatcaccaaaccttaaataatagcaaaggaataagcatgggaaatgagaaaaataaagtactagcagcagtagtaatagaattataataacagtagtagtaataaatattcaaggagttttgtccaccttcggagctcaggctgtgaaccacagtggtttacttattgaaaatcatcacgaggccgggcgcggtggctcatgcctgtaatcccagcactttaggaggccaaggcgggcggatcatgaggtcaggagatcgagaccatcctggctagcatggtgaaaccccatctctactaaaaatacaaaaaattagccaggcgtggtggcaggcacctgtagtcccagctactcgggaggctgaggcaggagaatcacttgaacctaggaggcggaggatgcagtgagtggagatcatgccactgcactccagcctgggtgatagagggaaactctgtctcaaaaaaaaaaaaaaaaaaatcatcagctagtcaaatgagtttctcctgacagtgatacctgcagtttaactcctttataacacgagccacaaaatgaattatcataaaatgcaattcacaaatgaatacaaaaagattatttgacaatccaaaaaaaaaggctttaaataagactcccttccctgagggttagcactaagaagacaaaccttcaagcacaaccaaaggatgccatatttggggggtgggggttcaccttcattcttttaaatcaatcagaaattagccaaaagctttagattgtaaaagtgagtgggaggagaataacgagaactgtcctgggcttgggtaactttcccataaggccaaaacctagatcctgaccacttgtggtcagaattagcaatgcaacatttcctataagaagctgagttgttaactttgttaaacttgttcgcaaattccttaaggggcttccattagttacattattatccatcaccaatatttatcacagaacatctgaaacttaggctttctaatggcagaaaacattttacatacagggggaaatgtcattaatagaaatgagaaagcaacttgtaaaacaccccagtgtgtaagacaggataacaaaggatactgaagttagctgccatctggatacctgttcacatgatacctataactaaacagcaacttacctgatgctactgtgcattgggttggagacaaggtatacatgataaattcctactataattaataaatgttcaaatgaaaatatacaaatagattgggtgcggtggctcacacctgtaatctcagcactttgggaggccaaggtaggcgaatcacaaggtcaggagctcaagaccagactggccagcatggtgaaaccccgtctctactaaaaatacaaaaaattagctgggcgtggtgatgcgtgcctgtaatcccagctactggggaggctgaggcaggagaatggctcgaacccaggaggtggaggttgcagtgagccgagatcgtgccactgcattccagcctgggtgacagagcaaggctccgtctcaaaaaaaaaaaaaaagaaaaaaagaaaagaaaatatacaaataactatgttactgttgatgtacattaagtatgagttgaatgctagaagatcatctgggttctccaagctatgccatcaagaaatagacactctgatacagaaggcaacttctgaatttaacagtgctgtgcgatatatcaaggggaaatttgggacaaggatgcctggcagttccacaagcctaggaaaagtgcctcaaacaatctttaacacctttaggtagaaatagaatcagtacaatatttgtatccaatgtctttgatcattttgataatcttatttttaaaagatgggatgttttcctcctctagaattagaatttaccctacactctggacataagaaccaaggcaactaagttatctgctggccaactaatagactgtaagccatcctggagcaaggaccatgtctctctgattcattttgatttccccaatatagtacttgatatacatggttggtatttagtaattgtgtattgaatacaatttttatagacctccatgttacaaaaaggacctaaattgggggaaatggatggtaggtcagttatttccttcaggatatttttaacactgtggaggtcattaatctgaatccttattacaggaataatgggagtgaatcacactttatagaaaccatgacggaggttttgactcatcattggtgctaatcaaggtaaacataatagcaagttgtgccaccctcataaacatcgtgacaagtttgtaaaatagagctaacactttattgcagcaatttcaaagagaagaattacatgaaatatgatgatgctaagatgagctaaaattccaaagaaaggatcttctctaagcaaactaacctttcttttaattatatctcaagaaagaagctgagtataaacgaaaagcacatttgtcaacaattcactcattcagttaccatgtatgccactaactacaatccagaaagatttatgattgtgccaaaacaagatgatgaggttctatacccagaatgtagattaatgttagaaggatgactcaggacttatggcatcagtctgatagacgttgaacctttctttctttctttctttctttctttctttttttcatctctgtgagttcttcaactacaggacagaatgccaactcaggaagataattcagtaaacacagccacctttgactacagactattttttatccaagatgtatttccatgtagcaaagtaaatttagcaaatgaaaatatagtcttgacttgctatggatgtcccctatctctgccaaaaatgacaagctgcttgctcaaaagctgtcactaattagcagctgctgctgtaaagaaaaccaaagtaagtgccaataaaagcatattgaactcaaagagggccctatgacaagagatgggaaatgcaagaatctatttgtgactagtaaacttacataaatactagcaatctaaatttgggagatgtaggggcagggcaataatggcaatacatatccattcatatttaaacaggaaggactgaaagagtctcctaacatcctgaaagtcagaaataccaaggtattggtgttgctgaattccatcacaaccatttccacctttccaataggagccagtcttggttttggatgatgatgattatttttagagacagggtcttgttctgtggcccagactggagagcagtggcatgaacacaactcattgcagcctgtgactcctggcctcaagtcatcttgccacctttgcctcccaaagtgctgggattacaggcgtgagtcaccgcgcctggcctggttttggataatttctcattgtcaatacttctgtctctggcactttaacaactgcatttgtagacattgtaaaaataaattttaaaaataactttcatattctatgggcttcggcctaaactctgatggttccgaatctacctgttgacccctcatgttataggttgaaactatgaagtcaagcagaagtgatctgcccaatgtaaatgagcacagatacagtggtagaaaatcactttactagccctatttcaagaggctctaaaggagtccacaacatcccagcactttgggatgctgaggcaggaggatcacttgaggccaggagttcaagaccagcctgggcaacacagcaagacctcatctctacaaaataaaaattaaaaaattagccaggcgtgctggtatgtacctgtaatcctagctactcagaaggctgaggtgggaggatggcttgagcccaggagtttgaggctacagtgagccatgactgcaccactgcactctgtctcttaaaaaataataataataaagtagtctacagcccaagatcctgctttaaagctaaattccatagattacttttcaaatcatccttcgaagctgtcctctctttgttcctatcagtcagaactcccagtatatttctctttttcctcaacaagttagtttctgtccttaaaaaaaaaaaaattaagaatatttccccttcattttggttctcttactctctttttctctctccctccaggtgaactgctagagagctatgattgtttcatctatatttggacccctagggtcaggctgtgtcttcagcaactactcagaaaaatgagaatgaaaaagaaagaaaaaaggaagaaagagagagagggaaggacaaactggaagggaagggaaggaaaagtagggagaaaggaagatgtaatgagaatagaaaatttttaaaaatggaaaaaaaaagaaggtcggtgcggtggctcatgcctgtaatcccaacactttgggaggcctaggcaggcggatcacgaggtcaggagattgagaccatcctggccaacatggtgaaaccctgtctctacaaaaaatacaaaaattagctgggtgtggtggcatgcgcctgtagtcccagctacttgggaggctgaggcaggagaaccacttgaacccaggaggcagaggttgcagggagccgagatcgtgccactgcactccagcctggcaatggagcgagactccgtctaaaaaaaaaaaagtttcttaactgtcgtttcttaatgacacgcaatcagaacctcccctgcagctgaggtcccctgtggagagtatgtctcattgtctgtataaacaattacaacaatgtacctgtaattttccagttcataatcaggctgtaagaatgagaacaatttgttttatgaaacatggagaaagactaatctttgctattactctcagtgcaggtttatcagcaagacttggagtagataagccacaggcatacagatgaggaatcacattttgaaagctttaataactccctagtggtatgcaacaagctgctgaattaacttgtctttgcatactcattgcacatgcatcactggccaggtctaggtacaaagcaaaaactaaacaatcaaaggaaagaaaaactgtgaagtctccaaccaaaagaattatgttgcaaaaaaaggaataaacacaaaggggcagatagtgtatgattccactgatataagatgcctggagtagtcaaactcatagagacagaaagaatgaatggcggttgtcagagcctgcggggaggggcaaatggagagttttattctcattactgtttaatgaatacaggattttagtttaggatgaaaaaattctggagatggaccaggtgctgacggtcacacaacaatgtgaatgtgcttaatgccacggaactgtactttaaaacagtgaaaatggccgggcacagcggctcgcgcctgtaatcccagcactttgggaggccgagggcggttcacctaaggtcaggagttccagaccaccctggttaacatggtgaaaccccacctctactaaaaataccaaaattagccaggcatggtggcgtgcacctgtaatcccagctactcaggaggctgaggcaggagaattgcttgaatccaggaggtgaaggttgcaatgagctaacctccagcctgggtgacacagagaaactccatctcaaaataaaaggttaaaaatggtaaattttatgatatatatacgtaactccacaatctttaaaatggggttaaaaaaccagtttttgcctaataaactcacattttttctatctttaatgctgaaatccaaaggaaacaaagagatatttgctgtctcctctctcttctcccccatccccccaactttttttgagacagcgtctcactctgtggcccaggctggtctctaactcatgggctcaagtgaccctcctggctcagcctcccatagtactgggattataggcatgagccactgcacccagccccctctcttttctttcttccacagtaaaaggcacactttcagtccttctgagggttgaagttctctggatacacctgctgtattgagattaaaggggaatacaatagtctttccttatctgagattttgttttctatggtttctgttacccacagtacagcatagtaagatacagtattttaagatagactacattcggccaggcacagtggctcacgcctgtaatcccagcattttgggaggctgaggcgagcaggtcacgaggttaggagatcgagaccatcctggctaacatggtgaaaccccgtctctactaaacaaaatacaaaaaattagccgggtgtggtggcagatgcctgtagtcccagctactggggaggctgaggcaggagaatggcatgaacccaggaagcagagcgtgcagtgaacggagattgcgccactgcactccagcctgggtgacagagcgagactctgtctcaaaaaaaaaaaaaaaaaaaaaaaaaaagactacatacttgttctattttattatcattgttcttaatctcttactgtgcctaatttataaattgaactttatcataattatatatgcataggaaaaaacaatatatatatgtagggttcagtattacctgaggtttcaggcatcccttgggataaggcaggactactatacttatttaacagatacttattgagtaactattacatgttgggctctgttctaggtactaagaatgtggcagtgaacaaaacagacatgctttatgtaacttagattctggtatgtaatattaaatactttaaagtttaaataaataattgtgcccctgctacactttctagtttttgtttttattcttcttctctttatttctgttgggagaaaacagataccacctgacaattgaatcttacaggtcaatgacaaagtctgtgtgttcaaaccagtatctgggaagaagttttaaaagcacctccacaacatcaaacagggggattactggcttttgtgaagtcttggtgatgcaaaagcaatttctgataaaaccagaacatctgttcatccctgctgaaagcctatcatctttatggagctattgtatgtgcaaaacaaatcgggtccaatcaaggattccacagttaagatcatttcagtgtggcattattccagctttggtccaggacatacagttttatttacaggataactttcatgattgccacaatcaaatcaaatcctttgtctttcaaaggtgatttgcagattcaatcttcacaaagcactaaaaatatagagcatggagttaaaaattcacaatgggaccacacacaaatagcagtacagggtggtagatagctagccaatgtttactttcttctttttcccatagaataaaatataggtcaaattctactaaaacaacaaataccaccacagtgaaaacctaggtataacaaaaatattttgaaacacttaaaaatgtccatgtgtttcttaatccaacacaatatacttttatagaatcaatataatgaattttatgagagtgctgaatcctaaccactagacaaccagggaattataatgaattttaaatcaaaagaatgactccttagagcataacaactttgtgtccgctctttaattttcatctttagggacatattttaaatatttcaaaataggctgtcacagtatatttggaagaaaggaatttgtttccctttatggaaatcatcctcaaatgtattgaggaataattttacattcaataaattacatcaggatgtttccaatgttataatgaacctacttttggcaacatagtaaaataaaggggttcctaaagcccacccattagtaaaagttattgaatattttatttaacattaaaaggtcaactaatttggcttagatgtcaggcaatatccaaagaaacacagaagttctagccatttcttcaaaggttccttctgaaatcaggtatcctttaaaaagaccattaaggctgggcacggtagcttatgcctgtaatcccagcactttgggaggctgaagcggaaggatcacctgaggtcaggagtttgagaccagcctgacgaacatggtgaaaccctgtctctactaaaaatacaaaaattagctgggcatggtggaacttgcctgtaatcccagctatctgggaggctgaggcacgagaatcacttgaacctgggagacggaggttgcagtgatctgagatcacgccattgcactccagcctgggaaacagagcgagactccgtctcaaaacaaacaaacaaacaaaaccattaagataaactaagtaggaagtggcattacctagattccagaatctctgcaagtctcccttctgaagctccgtttgttcagtattcctcacacagtggtgttaccagtcatggtgtgaacttggcagtttagggaggctaccacctcacctagggggaactaaaaatgattcccctcccttaagtatctcctaagactacagcaaaactggggggaactctcttttgaaaggaaaaatttcatctgtaactagatccccaattttaagcatcaacttgatgtattttataaaaatgaagagtagctaagaccaaaaggtgaatatgattcttttctagacaaattcagtttcaaaaataaagttaaacaacactctgaaacaaaacaaaaataacaaaacaccctgcctaaaagtgatttgacagttgaggtatacctgaaacagggtgggctgtttatttttattcagaattttgttttcagagatgggatctcactatgttgcccaggctgacttgaaactcttgggctcaagcgatcctcccaccttggcctcccaaagtgttgggattacaggcgtgagccactgcacctggccagagagggcttttctactcccaagaaatgagaggtcctctgaaagcaggagcttcaaggacatgggtaatgcttcagccatgcaaggatgcagcagttttcaaacaagagggtgcatctgtgggtgtctgggtgtgtcttgggggtgagggaatggtaggaagctttaagggcatcactttctttaggtaagagacacttttgtgctgggcgcggtggctcacgcctgtaatcctaacagtttggaaggccaaggtgggtggatcacctgaggtcaggagtttgagaccagcctggccaacacagcgaaaccccgtatctactaaaaatacaaaaattagccgggcgtggtggcaggtgcctgtaatcccagctacttgggaggctgaggcaggagaattgcttgaacctgtcggggggaggcttcagtgagccaagatcatgccacttcactcggcaaaatagcgagattctgtctcaaaaaaaaaacaaaaaagaaagacacttttatttcctacagagcagtggcttcagttcccacagggcaagagaccctatttgttttgttttattttaagttccaggatacatgtgcaggatgtgcagatttgttacacaggtaaacatgtgccatggtggtttgctgcaccaagcgaccctatttgtatttgttgattgtaagccagatgttataaagcaggagacagccctatatttcatttcccttcgttagaaggcctatagccacactgtttattatggtagcctctagcagcatgtgctacctaagcacttgaaatgtagctagtgcgactggggaactgaattgcaaattttatctcatttgaattaacttaaatgtaaacctggaaactggtgttcaatttaatacttggaaaacctttcagtacgtttggaacaccttcagtatgtgaatctactttatcaactgaaagttttatgaaatctgaacacagttcatgcatttctggtgaaaatttggtggctaaattgagagattttataactgtaagatacacaccagattttgaagcattcgtacaaaaaaaggaatgtaaaatatctcagtgtttttgtgggcttttgggttcgtttgtttttttttgagacagggtctcactctgttgcccaggctggaatgcagtagcacgaacacgactcactgcagccttaacctcctcggctcaagtgatcctcccaccttggcctcccaagtagctgggactataggtgcacatcaccatgcctagctaattttgttgttgttgttgttagagactgggtctcactatgttgcccaggctggtctcgaactcctggactcaagtgatcctcctgctttggctccccaaactggcccaaaatacctcattaatcaataatttttatattgatcaaatgttgaaatgataatttttatatattaaagtatattgttaaaattaattttatttttactttttattgtgatacagactaagaaaattacaattggagctcacattatatttgtattgaacagtgctggtctagaacataaatattccacatactgtacacaattattgcttagtttcctagtttatatgtcttaccttttttttttttttcttgagacagagtctcattttgtcgccgaggctgaagtgcagtggtgcaatctcagctcactgcaacatctgccacctgtgttcaaatgattctcctgcctcagcctcctgagactacagacatgtgccaccacgcccggctaatttttgtatttttagtagagacagggtctcaccaagcgggccaggctggtctcgacctcctgactcaagtggtccgcccacctcagcctcccaaagtgttaggattacaggcataatccaccatgtatggccagaaaacataattttgaattaaacgagattatcatgtttttaggaagtagaggaggtaagaggtgataagcaaaaaataaccaaaaagaagagaatgatttatttatgtaggcatattgaacaatatatgtttatagttttatctttaatacagaaaaacacttatttacttcatgcattttaattaactactttatggatttaggttttaaaagcactaaaaagtactacgtgatttttaaaaatgttttggtattccccaaactggcttaaaataaaattctgttatagcaatttcactataataaattacaatgcacaatccaagttaagatagattttttattttttatttttatttatttatttttgagacagggtctcactctgtcacccaggctggagtgcagtggtgcaatctcagctcactgtaacctctgcctcctgggctcaagccatcctcccacctcaggctcccaagtagctgggactacaggcacacaccaccacgtctagctaatttttgtatttttatagagatgaggtttcaccatgttgcccaggatacttttgaacccctgggctcaagtgatgagcccacctcagccttccaaagtgctgggattaaaggcatgggccaccatgcccagccagatttttttctaatataaaaataaagatgggatctcattacgttgtccaggctagtctcgaactcccggcctcaagcaatccttccccctcagcctcccaaagtgctaggattacagatgtgagtcatctcacctggcctaaaatagatttttacttaattaaattttacatgaaataagtaagtctactgggctcaaaattgtctatttttaaggttgtaattttatttaaattctcttaaagtatcaactcataatttactttcattcctcttctttaaactctgtcaagtgttaaaattcttttatttttattctgagacagggtctttctctgtcacccaggctagagtacagtggagcgatcacagctcactgtatcctccacctcccaggctcaagcaatcctccgacctcagcctcctgagtagctggactataggcatacaccagcaccccgtgctaatatttttatttttcgtagagatggggtcttgctatgttgtccatgcaggaaaattcttttaaacactaattctagttacaaagaaactatttaatgtaaatttaattaaggcagaacataaatctctggtattaggaatgacttatacccaagagaaaatatctttcactagagatttcctttaccagatattcccaaatgagtaccataataaacatttagagaagtcattaagtgtgactaatggaattataagaaaaagaaatccatagcctagcagccttcataggtatcaccatgaaggggaaaagccaatgcagaaaatatattgaaataatacaaagttcagggttaaaacaaactcaaccatttttttcaaaacatcttcaatatgaaatgaataacttagcagagtgtgtatatatatgtgtgtatatatatacatatatgtatatatatacacatatatatgtgtgtatatatacacacatatatatgtgtatatatacacacatatatatgtatatacacacatatatgtgtgtgtatatatacacatatatatgtgtgtatatatatgtgtatatatatgtgtgtatatatatatgtatatatatgtgtgtgtgtgtgtgtgtgtgtgtgtgtatatatatatatatatatatatatatatatatatatatatatataaaaaaacaaaaacaatttttttttttttttaaagagagacagggtctctgtccattgcccgggcttgggagtgcaatggcaccattatagctcactgcagcctccacttcccaggttcaagcaatcctttcacctctgtctccctaacaatttattatattatataacaatataattctccataagcttctgtgtaaaaatatacaggctaccacgaagcacaggaaataacacagtcctgaagttcaaattatttaaactctaaaaatgttaaatgaaattatgatgattttaacatagttcaacaaaagatgtcaaaaaacaggatactataccaaaaaattaacaaaaacatcacaaactcttttttctgcttctaaaaagaaaacactgataacaaaaaacaaattctacgttctaagacatatcaatacacacagccattttaaagataacttttttttcctgattacaaaaggattccctgtattatcatctgtttttttgtttgtttttatttgttgtttttgagacaaggtctcactctgtcacccaggacgaatgcagtggctcaatcacagctcattgcagcctcgaactcccaggctcaagtgatcctcctacttcatcttcccaagtagttgagaccacaggcatgtgccaccaggcccagctaattttttaattttttgtagagatagggtcttgctatgttgcccaggctgatcttgaactcctggactcaagtgatcctcccacctcagcctcccaaagtgctggaaatataggcatgagtcactgtgcccagccataatctgtttattatagaaaaatggaaagatactagaaagcgcgcacacacacacacacacacacacacacacacacacacacagggaactccacgacccagaagaaatcttttttcagcgcctgttcttttttccaggcacaattgtatatgattgtttgtaatttcatttttcatttagtaatatatagtgaattttgtgtaggtcattaaatattgttttataacataatttaaatagctggacagtattctattggacagctatacacaggtgtaataaatgatttagtttattaaacctctaatggaaataccaagatttttccaatttattgctattttaagtaacactccttttgtacaaatcttttttttttaatttatttattattatactttaagttttagggtacatgtgcacattgtgcaggttagttacatacgtatacatgtgccatgctggtgtgctgcacccactaactcgtcatctggcattaggtatatctcccaatgctatccctcccccctccccccaccccacaacagtccccagagtgtgatgttccccttcctgtgtccatgtgttcccattattcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtgtatgtgccacattttcttaatccagtctatcgttgttggacatctgggttggttccaagtctttgctattgtgaatactgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtctaattagatcccatttgtcaattttgtcttttgttgccatcgcttttggtgttttagacatgaagtccttgcccatgcctatttgtacaaatctttaaacatatttcagatgtcctagaatgaaattcatctaaatgaaactgctaagtcaaagggtatgtactcttcttttttttttttgagacgaagtctcgctctgtcaccaggctggagtgcagtagtgtgatctcggctcacagcaacctctgactccctgcctcagcctcccgagtagctgggattacaggcacgtgccaccatgcccagctaatttttgtatttttagtagagacggggtttcaccatgttggccgggatggtcttgaactcctgacctcgtgatccgactgccttagcttcccaaagtgctgggattacaggcctgagctcccatgcccagcttgagtatgcactcttttaagctctcaatacatgtatcaaactgccatccaaaaaaagcacccatttacatttcaaccaatgagtatgaaagtgccagtttcccacattcccaagcaacactgctcttatttttcaatatttttagtcttcataaatctgttaactgaaaaaacttgtcatttttatttgcatttcttgatttccagtatgggtgaacactgtttcatatgattatcggctatttgtagttcttcttttgttcattttctattatgggaatcatctttttcttactacttatatagattacttatatattacgaatatttacccataatgctttgtcatatatattagaaatatttttcttattttgtcacttagctttggtttctggcattttttggcataaagaagttttaaatatttatgtatacatataaaaagacatatgtgtatctataagatgtatcttcttttattagttattaaagccacttatatcctgttcaaatttaccaataaaactggaatgtaatgttaagttctgtgcaaactagacctcttcacatttgggtaataaaaattcaaaactagccaggctcaggggctcacacctgcagtcccatctactctggaggctgaggtgggaggatcacttgagctcaggactttgagaccagcccgggcaacatagtgagaccccactctttaaaaaataataataataaattaaaataataaataaaattcaaaaccataaattttgagaatatcacatttttggacaaaattttaaatgtgtgtctaaagtaatacgttttcttacttaaggacccactcctggcacacttcactcatcctgggcaacagagcaagacactgtctcaaaaaataaaaaaaaaaaaaaaaaaatcattcccttaaaattatatgctttttggcccggtgcagtgactcattcctgtaatcccaatactgtggaaggttgaggtgggaggtgtggaggtggaggtgggagggatcacctggagacatagcaagacccctgtctctatttttttttaactatgtgcatttttctggtattgcaaagtcaagggatcttgcctcatcaccaactcagcatgtgaattgtagccatgccactcaggaagccaaatattttctattttgttttgataccttcaacatgaggagaaaggccaatctcttcatacattacaatgaaattagtatttttacttgatatttaaactcactgcaagataaactcatttgtaaaacatgactacactcagagtttccatatatgtagtcaggcaccacataatgacgtttcagtcaatgacagaccacatatatcactgtggtcccataagataataaaacgtagctgaaaaattcctatcctctagtgacgctgtagccatcataatgttgtaatgcaatgcatgactcacatgtttgtggcaatgctggtgtaaacaaacccactgcactgccagtcatgtgaaagtctagcacatacaattgcgtgcagtacatacttgataatgataataaatgcctatgttactggtttatgtatttaccatactttttatcgttattttagagtgtactccttctacttaaaaaaaaaagttaactgtaaaacagcctcaggcaggtccttcaggaggcattgttatcacaagagatgacagctccatatgtgttactgcccctgaagacctttcagtggaacaagatgtggaggtgcaagacagtgatactgatgaccctgaccctgtgtaggcctagactaatgtgtgtgtttatgccttcacttttaagaaaaagtttttaaagttttgaaaaattaaaaagtttttaaagttttgaaaaattaaaaattatttaaaaagagaaaaagtaaaagaataaaaacataaagaaaatattgttgcacagctgtacatgtttatgtgttaagctaagtgttactacaaaagagtttaaaagtgtaaaaaagtaaacagttggccgggcacggcggctcacacctataatccgagcactttgggaggtcaaagtgggtggatcacctgaggtcagaagtttgagaccagcctggccaacatggtgaaaccccgtctctactaaaaatacaaaaattagccaggcgtggtggcacacgcctgtaatcccagctattcgggaggctgaggaaggagaattgcttgaaccgggaggtagaggttgcagtgatccgagatcacgccactgcactccagcctgggccacaagagcaagactccatctcaaaaaaaaaaaaaaaaagtaaaaagtttacaaagtaaaagtattacagtaggctaaggttattattgaagaaagaaacaattttcaaaatacatttaatgtagcctaaccagacagtatttttaaaatctacagtaatgtacagtaatgtcctaggccttcacattcactcaccattcacccactgagttgcccagagcaacttccagtcctgcaagctccattcctgttaagtaccctatatagatgtaccattttttatcctttatgccatgtttttactgtaacttttctatatttagatatgtttagatacacaaatacttacccttgtgttacaattgtctacagtactcaatacagtatacatgttccacaggtttgtagtctaggagcaataggctttatcatacagcctaggtgtgcagtagggctcaccatctacgtttgtgtaagtaccctctatgatggtaccacaatgacaaaatcgcctaatgcatttcttagaactttgtcaccatgtatcattaagtgacaaacgactatagttacgtaacaataaccaaagaaaaatacaaaaagagggactatttacattgtatccttacatattaaaccttccatgccttcggaataagaatctagtatccagttctcactatacatagctttccctcactttctatcagaaatgagataggagtcccaccttcctggcatcagaaacagatcaccaatcctgcaaacaaattcacagggtgaactgtttcatttttaaagagctgtagatttctgtagatctctaatttgctacttttcctaaacctaaaagatgaccaaaagatttttagaaacattaaacaaaaaaacagaattagcattatttctaacagaacattttacctatttaaatatactgtagaatgaatgctatattacaaagctgatgaattccaatttttagtactttaagagatcaagtgttcaagtttctttttatataggctacaatgacatgtatgaatgtaacttaacatttagcccaggttagattttttaaaatcccactccttcaaaaacagtgacttgccaccagctataggctctgaatttatttaatttatttatttttttgagatggagtctcgctccgtctcccaggctggagcacagtagtgcgatctcggctcactgtaacctctgcctcctgggttcaagtgattcttctgcctcagcctcctgagtagctgggattacaggcgtgcaccaccacacctggctaatttttgtatttttagtagagacagggtttcaccatgttggccaggctggtctccaactcctgacctcacgtgatccgcttgcctcggcctcccaaattgttaggattacaggcgtgagccactgggcccgacctaggctctgaattttagacaacaaaaaatagtttctcacaaactttttaacttactctcacctaaaggctggaaaaccccagtgaaggcttttaaaactcatcagacatagaaaaaaagaagcagctttaattgtaggatctcactgacacaaacataaggaaattctgagttatagatacctcacattaagctttttccactgacattgtaacttctgtcaacattcaaagaaaattcaaccctggtcaaaggtgacagttgacaatcctggaagctaacatcctctgtttatttgaacaagtttatactctgcacagggaattgaagttcttcttgtctgtgacttgatctcccaaagttaaagcactacgctttagggttgtgaattctgtttccaagacttaacttcacaatccactcccaaggaaaagtgctgagagaaagtaagcatcataaatgaaaaaaaaaaaaaaatctgagactattttctaatggcctttgcagagctctagacatacaatagttcagttgccttaaaaattcgcccaaataggctgggcatggtggcttatgcctgtaatcccagcacttcggaaggccaaggcaggaggatcacctgaggtcaggagttcgagaccagcctggccaacatgtcaaaaccccgtctctactaaaaatacaaaaattagctgggcatggtggcacatgcctgtagtcctagctactccggaggctgggcaggagaatctcttgaacccaggagacggaggttgcagtgagccaagatcgcgccactgcattccagcctgggtgacagagcgaggctctgtctcaagaaataataataataaattagcccaaataagtaaaattcttaaatctgtctcagaaatcatgactaatgctctaaaaagctttaatgcaacaagaataggacagaaatccccgcaaaataaagttgtaaataaaatgagtgggattgttgagttctcagtacagacgtgcatgtcaacacaaacccactacattggcacaaatgatccctttgtttgtaaacagaggccaaggagacagcttatagctcttcttctatgatgtacacggtaatgctaggggaagaagaatgaaagacaacttataataaaaattaagactttctcttctttaatataatttccaccagaagtatatactttaattggaaaaatatttatcaccatcttcatcaacatttaaaaaaatcctaaacatataaaaatattttctattcaaaaaccaacgagactccatttgggaacacaaagaaatacaagcctcaaagaaacaaaatgtcttataacaaagtggcagtggccagctcgcttttgctgtacactagttagggatgcagtctctggaatcagccccgccaagaacagtaatgtgaccttggacaaattacttaacttctctgtggccatttcttcatcttccatctgggaataatacccactcctctgagaatcacgagttaacacaaggccagagctgaaaacaatgtctgcccagcacactgtcagtgaacggtaagcattaggtaatgtttttattatcttcacacttgaaggcgttggaacattttctcaaactctgggttttgaacataatttgaaggacttgttaattgtctgctcacctctcgaaaggtggcatcataatgattagatacataatcagaatatcttcccaggtgagccatggtaagcagagctctagcccagaatgatgaatagttatttttaatacaaatcatggatgtggctgttactggcaacttcggcctgatttcccatatgcaaagaaatcccctaccaggggaaaacaagcaatgttagaaacccgttgggtttgtcctgttatcattacagggtaaagccaaattcacatttagtagcctgatgggcattaaaaatattagtcaccaaattaatcccaacaaataacaataattgattggctcattgatgtatttccccttgtcttccccaacctttctctaactagtcagaaaggaaagttttcatattttctgagaatctcattactgctctcaaaccatgctctatatcttagtataatttaaaaaatgagtcagcacaagcacctcagaaaactagcatagaatatgaagctacttctcttcatattagaaaagtacaaaaatttttaaaaggttattcagggtaccaaaggtaatagaaggatacatgaagagtgaatgttgcagtagattttgcaagctagcttccaaaagtaggtagaaaaagataaatgttcttcatcaatcaatcaatacaggtattcatcatctcagtggtgtcatccatgtgaaaatggacatagttattaagaataaacctaaagaagaaaccatcttgtatgtgacaaattataacttctcctttcttgaatattggggcagcaggggaataggaagtcaagatactccaagtattaacttcatttgcaaattgaattgtacataattgtgcaccatgctaatgcaatactgcttttagtaatgggatccaaatgaaaatttagaagaggtaaactccccctaaactgcaaacacatctgaatgtcaattcaattaggagtctatttagttattacacttcttagcataaagcgagttaaaggccaggaaaagaacacttgctttaatcactgaaacaatctacacatatttctcaaggctccacttaactcatcctgcaacatttatattaaaagtgacctatcacttaagtgatccaggagagtaaaggaagagttttaaggctgaaggtgattcctcctgagctctaataccataccctgaatttcaccttgttcttaactcttttccatgacactgtgtatggcttttaagcgagtccagaaaaacggctatcattactacttaatataaaccatggggttctgtatcatgtaaacccagagcaactcctctttgaagcaccgacattcaaggctctacataacatgtttcaactctatcttagtgctatacattttccaagtacctgcgaggaaacagatagcagcacctccatttttctgtaaattgtgcttttgttgctgttctaagactccttccaaggctgttaaactttgaagagagttgggaaaagacaagaacatcttgccttcccgattgggtattcaggcttcactcagtaaagctgtcatgaagtagcgcaaagggtcagagacaaaccacatggcatctgatgtttgtctgtataagtttaaaataaaaatgtgacactacaagaaggttaacatgtggacctaattttgaaaatacaaacaggaagcacccccaccccaatattaccatttaaaaaaaaaggaaaccaaacctcaaagataccttccaaggaagtgatgggtgtgacccaaactaacaaaagtaataaaacgtcacttcaactctgaaaccatcaaaagtgagggtctcattcaaccaactaaaaatctaacacctgtaaattgctcttctcttttgattagtaaaaacagcatagatttagatgtgcaaaatcttctccaaactgacataggcttttcagtagcagaggatcatcattaataaaacacccaatgtcaagattttacttcaaataaggccactataattaacagtgaatacaattttaaaaagtatttatcactctgatgcttagaacttaaatttaagtacaaaaactgtctgatcaatggaaactagattgttaagtttgactttcttattcccagaaataagcataaaactgttgtgtttccaacactgcaggagaaaaaaaaaaacttctgattttagaagagttctattcacaaagctcagaattaaaaacattttcttcctttaaataccacacatttgaggacagcgatagtgcagagctaactttgaagcattatttttattaagttgcacagttaaagtattttgatactttgatattttatagtatcaaaataaaaggatattcttctcaagagtccagtaacctggaattgccagatagctttttaaacgaataagtttcaaattatcagaaaaatcatacaaactagggttattttgcttccttttgtaggaataatgcagtaatctgcactcttaacagaaagggaaaaaatgtgtcacagatagaatgtccagaaatctgtgaataactttatgagatacagacatttttgtagggcacgaaaatagttaggcttccttcgattccacctgtaacctgcatctaatcttgagcatgttatttacctatctataacgtcttccttttacaataagactacctgtgtcacctacctacataacaacaagccaaataaaccacaacaaatggattcataatatataagcctaacaaaaattacagacaatttgaatactaacaatactatgatttgaaaaaactcgacttaagtatcaaaaagtaataaatggcaactttagtcttgatgtggcttttacatatgtaaatgacataaaaacaatcaagagaggaagaaaatggagatgagatgaaaagtcagagcaggataggaagtgttgaccaaaatatttatgttgtaacactccaaacgatgatagcacatttttctcctacaatcatacatactatgaagtacacaccttaaatttctgaacacaatccatattaatatcccgtgggcaaaaaatacaagcaccgaaaaggtgagaactgatgagaaggtgggatagtttacctagttgggtatatagcaaagattattttgtgcagagtttagcttcaagttatgcaataaccaaactactggtgatagaaatcaactttttttttctgatggtttgctttacaaaaaaaaaaaaaaaaaaaaaaaaaacctctccattccttccctgtgtctcaatctggagcttgaaatttcatcttccagaggctacagtagcaaacaagtcatctcctagataacgcgcttacctgacccaaggtgtggacttgtttgaattaaacgtaacagataccacaaattgtcacataggaagtttttcttaaaatcagcagccccttctcttatttagccatgtccattctaacaactgtgatcttccatgagatggaaactggtacccaaatgaataaacaaaacaacccaaagccttaaaataaaatcaatcaataagattctccccatttgaagtgatcagaaccactccaatatttacagtgttacaaaatgaaattttaaaacatgaaaggcacactcaataaaatacatcctcacctaggaactcacaggcaatgaacataacgcaatataacataagcaaatggacaacaatagaatgttggggagagaggcacagttctattaccttaattgaaagataacaaaattatttgaaataatgtagacccaacagctgaaagcttattatggcccaggcggctatccaacagctttggaaacctaagatccaagcagaccataaacaccacttgaagactgaaaaaaatgacataagcccaagtatgatattcagtgtcacgctggccctttcaaagggcattccctgaggacactgcagagaaaatgtatggaattgtatctaggcaaagatctgtatactgcacgatgctttgggaagagcacgaatctcagagtccttgaagtttcaatccctggatactcaacaaacagccgtgtcacctgagcaggccacttactccacctatctgggcctcagtttcctcatttgtacaataaaagaatggcatcatcgctgggttcctttccagctctaacattctttgacccacttttggcactatttatttgatacgaggtatggcgggatcacagggaccaagaagaaaagaactgactctggctctttggcaaagagagaatcggtatctcttttagtctttaaaattcttgtgcttttcattaatcccgtctttctaaaagctgacacttggttttcttctttggcttttccatcactgctggctacaagtgtttgcaaccgcctcttgctccgtgtgagttctttcctctttgttcaccccgaccatcttgccagattcctttagcctcagaccagcttttgtgatacaactccccttccgactctccatatctaccccccgacaccaggagcacttttaaccctttatccctgactagaaagaaaaagcacactgcatcccacggccacacgcacgagcccaggcctggcgggtcctgatgtgggatcccgccccccagagtcttatcgaaacgttcgtatttgttgtcttgattccttataaggccctgtttcttgaagctttgctaataccccccaccgcaccaggcacccccgcaggctcatcccatccccggagtcccgggaacctcttttgaaagaaagaagttaaagcaaggaagacggctggggatattcggaattgcaacgtgaaggtgtgaggcggctgacagcagccccctgagctcctatggggtcggcgcggggtccccacacacccactcagcacacgcgcacgcagcctttaaagcgcacgccccccgcggcgccgcggcgttcgcaagtccccctcgcgcaccccgcattgccctcagcctccccggcagccaacccggaccccctctccccgcgcgcgcccctcgcccagcgcgcaaccaccgcggcccgggagtgatggcggcggcgcggccctgacgggcggctgagcggctggagcgcgggccccgcccgggctggctccccggcctggctcccccggccccgggcccagggctcgccccgcagctcctacctcgctcggcccctcgggcgcccgcggctgctccggcccagctgtctggcttgcccgcccgcccgctcgctccctccctcggccgggccgccgcgcggagttgcctgcgctgggtccccgcccggggtgacggctccggccgccgactctcctcccgcc

SEQ ID NO: 2055 - DNA, 237508 bp, Homo sapiens
  source 1..237508: mol_type = genomic DNA
ctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgccgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcaggtaaggccttgctgcgggctggactgggctggaggctttggctcaggactgagtggcccgaagtgggcaagttgaaatctaggtttgtacatgtgaggttcatggaggattcacacatggcactgcctgttccaagtagttcaagaagttctttctggtcagtagtcatggcaaatgcctgtatctttcctgaacaactttcctcatcccccgcactcaggattttttttgttggcagtaagaagaagcctttggggcaacttgaccttttagatcagcaaggaaagaccccatcttaggcctacttgtctggaagaatggcctggtgagatgataagttcattgctcctattcggttttagtactgagcagcatgggggaggttggggccacttatgttggaaagggaaagttaaggctgggccacctctgttgcctgaaagcctggtgttcaggtgtgcctattccaacaaccgtgggaaccctagtcccacccttcccttaggtagtcttgtctctttgctgtgcgcatttgaaatatccaggcggtttcttagatggaatcctatttacaactagggtgttaaatggccttttcttgacatagacatgatataattcctgggaccacttgttgacttattctgtttcttctgactgatgagggtgggaattccatgctacaggtttttttttttgtttttttttttttttccctgagtctgcttgctagggaaaccatgctacttttgatctgtcatggtttttcctatgcagttgtgaaggcttatcaggcagcaggagccctggtatacttttgcagtagaaaggaacacttttatgttttgttttgtttttttgagacagggtcttgatctgtcgtccaagctggaatgcagtagtgtgatcacagctcactacagcctcaaactcctgggttcaagtgatcctcctgcctcagcctcccggtagctgggactaaacacaagagccactgggcctggctaactttttttttctttctatttttaattttttgaacagacactgtctctctgtgttgtgcagggatccctcccaaagtgctgggattacaggtgtgagccactgtacccatcaaggaactctattaaaatccagtcattttacataaggcttacgagatcagttctcttttcccatttctctcaccctttggctgtgatctgcccaaagctgtgacctgcagtgtggggagagtttatagatgagttgtttctgagcataagcaagttcaaatgagggaatggctcagtgggcacctgctgatacaagtcagaaaaggaaatataggtcatggtggctggggagtttcatggatggatccagaagctggctttggtggtagaccctttattgggcaatacccttttaagttccagatgttccaagaggtctggtttccaaatgaggccagggttgcccatgtgtaagtaggatacctggctgttgctttctagatagatcctttttgcctattaatcctgtctctccatagagagtctccttgacctttgagacctggctgaaagcttggttcttattgggctatgaagggaaagactagtgggcaaatgtagattgaactgtgaagtagacctaattatcatctcttcctgtccctgtgacattcctatttataactgataatatgtcttttttcactccaaaatatgagtgcctgacataagatgaatattttttggagagtgggtgttctatattttagacataagctaaagggatgaaattttgaatgtagacattggctggctattaggaaggtttttttttttttgttttttgtttttcgcctgaagtaaaaggcattctagccttcctcaggaccaccccatgacttgagcttttggagacaattcttcacacaacatatatttcagaggcctggctatgctgattataccacttaggcctactcatgctcagtttagaaactggtttctgttgtcacaataatagtgaattccagggaggaaagtctcagagagaccctaggtgctgtgaatgcctaaggtttgtggaaacctggaggttctagcactattgttgtggtaggttttccccttgggtctacctggggttttgtctttgactcagtcagggacttgtttttgcaaagaggtggttcatatagactgggatctgcaaaagagtttggagagaaactttctatgcaactaggaactcttgcatcctttccagcctctctgtatccccagaacacaggaggagctttacttgctcttaaaactactacttttaaaaatcagattcaacatacccagtcaatttgtgtgttctctgcagtttgtattttacaattacatagctgtttttccaacagagtctcacaatagccctgttacaatgcagggcaagtggtattgtccccatttttatgggtgaagaaacctggtcctgtgcttggtctttcttataggcaggtcttctgatgcttaagtcttggatttcttccatcttctcaggtcctgccctgttaaaggagtgctaggcagggctggagaatgttgctttccttctgacaattaggcaggccttggtgactctgtagctgagagccaagaaaagggctgtactttttttctgctctggagagtcttttgcaggggcccagagaatttgattttttctcttttggatgtatatacccatctgtctctttttagttagttaaaatatttgatcctaagattgatttagttaaaatgcttatggctttagcatgcatacaataaacactatgaaagcctgatcctgcagtgaaggcaggtgctctacaaggaggatctctcactgggccgtggagaggccattcctgtcaccctttggctctttaatacctgtacacccagccatgctaggtcactttctcagtaaagatctgtgcctgcctgtgctactctggggcttgcgtttctgaagctggcctgatacggatgcttggaaccgtccttagactctagaaaacaacaatggtttctgtagaatgtgcatgagggacctcaggtggagtctggagttatggctgccagtgttggaggtattgagggcctctaatcaggaactgtggtttagttcagtgtagctaggacagggccttggaggataggcatctaggcagtgtgcagagtgcaggctggcttctcaatcaacctctgatggagtggcaggccagaaccctgcctccctcccccagctagttgctgctgcctccaaggctataaatggcctggccatcttggtagctatgctaattttagctgagggtggctcccggaactgggctggggccaagagcaggtaggtggggcttggctgaagctaatactggggcctggggagagggacacactaagcctggggtagccaggatataatctgctcccaggcctcagctttgacaatcacccttagctaggttaattgattcagcaaacattgaacaatgccagctcatgtggtatttattaaacaagtattaatatttgagtgccttctctgggctaggtcatatgttcctgtggggatttaaggatgaacaaaacagacatgttccttccctcatggaagttacagtcttgttgatgagacagataataaacacataaataaatatattatcttgtggaaaatgtcatggaagaaataaacaggatgctatcatggagaatgagaggggaacagagatctagttaaagcctgaacctaattgtaggacagattaatacaataacatcaatgataataatagcaactaacttttttagagcttactatatgtcaggcactatttaaacattttgttttattaaattcttattaccatcctgtgttatattgtccccattttatagatgagaaaattaaatcatagagaggttaaataacttgcccatgtttacacagataacaaggaagccagagtttgaatccaggcagtctgattcttctctctacctctactttagccactctcaaaactttgtgataaatctgcaatagaggtattatatatacatgcagaaagctgtgggaagcccagaggagtaagtgactaaccctgcctgggagagctgggggaggccttacagtttctttgtaatttttctcagatcttgagatgaaaagcggctgcctaattcaaaggttacgagatagaaacatcagttagttcatcccacctatttttacatatgaggaaactggcatccagagaggcattagaggtttcatggtgggttattagtagaactagactaggaaatttgagtcagggaccttaacttaaatcagtttttcattttataagtgaaaataatgggtgctcactgcttgcttttcactgtggaaggaacttagggctactgaagaagtctacgttttgtagggccacatgtatttagggaatattaaatacaacataatgtacaggcttaatgatgtgcaaaatcaggcagtatagacattgtaggctaagggttaaaagcgatctgtgtgggctgggctagactaggtggctgcagagggcttcctggaaaggaggggttgggtggaggcagaagagaacaggagagagtagtctgacttggggaggttggaggaaaggaggcattgtaaatatctggtttcactgtttggtagctggatgatcattaggcagagttgcttcattgttggctagctacctcacatgagcacccataggtaggaagattgcagtcatgtgtgatctagtagtggttctattttttttttttttttgagatggagtcttgctctgttgcccaggctggagtgcagtggcccgatctcagctcactgcaagctccacctcccaggttcatgccattctcctgcctcagcctcccaagtggctgggactacaggcatccgccaccacgcctggctaattgttttgtatttttagtagagacagggtttcaccttgttagccaggatggtcttgatctcctgacttcgtgatctgcctgcctcggcctcccaaagtgtgggattacaggcgtgagccaccgcgcctggcctctattttttaccgtaatttagaagtaatgatgagtgtaaataatactttgagatatctgtagcaatgtaatgtgatatgaaaacatctgttgatttctattgatgacaaaatcacagttattgctaatattattgtggttggttgctccatatgtaattgaaggaaatgctaactttcagtaagagaatattgaaaacaaagatgtaatttcattcccatccaaattcacaggcctcctgaattctatctatgggccccttagggatatggggccttcgtgttaagaacagctctttggcaaggaagtgatgagatcttgtggaggggagtagtttcctaggtctctacaggacttgagtttcagacccaaggggcccctctggtttcctgctgggtaacctttgatatacattgctgagtggctttgtgggcatgctgtggtacatttccctttgtggaaaatgattctttgggaaactcagcaggtttggttgttgtcaggcttttagggagaaaaaaagagaccaaactgggcctccagagctttgttgttgctgttgttgttactgttgattaaaaaaatcatgaaatattaagatatacaacaaagtataaataataataaattgaataccctgaaatgactttgaaaaaaattgtggactaaaagcaggaaatcatcccaagaccttgtcttaccctaaattccccctaaaaagtaagacctgggataggaacttgcagagagtttatttcggagaagtgacttcaagaaatgaggggtgggagttgtgaagaatgaaacagggaatggacaggtgtactatggagctaacaccactgtgagcatctgaggctcagtgtcacttagagaccctctgagaagccttgtagaatgctctgtagaattgcattctacaggtgatagaggaggggagtatttatccaccacctcaccttcactcgccaagggttatcccaggaggtgctacctcttctgtactccagagttgcatatgcatcagaatgaccgagcaggttcctttaagtactgcatattggccatcacacccggctaattttttgtatttttagtagaggcagggtttcactgtgttagccaggatggtctcgatctcctgacctcgtgatctgtccgccttggcctcccaaagtgtttggattacagacgtgagccaccgtgcccagccaagtagtcccctcttatctgtggtttcagttacctgaggtcaactgaggtctgggggtaaaaaaagtatatatgtgtgtataagatacatacttatacatatataagtatatctgtaagtacacacacacacacgcacacacacacacacacacatatttttttgaggtagagtttcgctcttgtcacccaggctggagtgcaatggcgccatctcggctcactgcaaactccacctcctgggtttaagcaattcttctgtctcagcctcccaagtagctgggattacaggtgcccgccaccacacctggctaatttttgtattttttagtagaaacagggtttcactgtgttggccaggctggtcctgaactcctgacctcagataatccacctgtctcagcctcccaaagtgttgggattacaggcgtgagccaccacgcctggccacacacgtatatatttgagacaatgcatgtgtgtgtgtgtgtgtgtgtgtgtgtgtgtgtgtgtgtgtgtgtgtatgtatttgagacagggtctctctgtcacctaggctggattgcagtggtgtgatcatggctcactgttgcctcgaccttcctgggctcaggtgatcctcccacctcagcctcccaagtagctgggactgcaggcatgtgccaccatgcctggctactttttctatttttttgaagagacgaggtttttccgtgttgcccaggctggtcttgaactgttggactcaagggatcttcccagcttggcttcccaaagtgctgggattacaggcatgagccactgtgccccagccaaatctgaaaatattaagtggaaaattccagaaataattcataagttttaaattgcacaccattttgagtagcatgatgaaatctcatgctgtcctgctctgtcctgcccaggatgttaatcaacccctttgtccagcgtattcgtgtaccataggctacctgtgctttagtcacttagtagccatcttagggatcagatcgactgtcttggtgtcacagtgcttgcgttcaagtaatccttattttacttcataatggccccaaagtgcaagagtgattgctgacatattgttacaattattccgctttattaatagttattgttgttaacatcttactaatttatgagttaaactgtatcataggtacgtatgtgtaggaaaaaacatagtgggtataggtttggtgctatccgctgggagtcttagcatgcatcccccgagaataaaggagggctgctgtagtttcattgtctcacttcggctatacccagccatcatgcgtaactctggtgtggccaaaccaggcttttattcaaggcttactgtgggccatggggagactgttaataaagtctgggtgctaatatttgacctcagctccagctgtactctcttattgagtataaccacctccctagcttcacctgcagtcttgaaatggctgagcaaatgggcctggtccccactgtattggttacttattggtgtataacaaattatgccaaaacagagagggctaaaataataagtatttattatctcatagattctgtgcatcgggagtctggatatagcttgactgggtacctctggctcagagtctctcatgagatggcagtcaaactgttggctggggctgaagactctatttggggggagagtgtttgcttttaagctaattcacatggttgttggcaggccttggttccttgccatatgggcctctacactgggctatactggacatgatgattggtttcccctagaacaagtggtccaagagagcgcaagagagagtgcctaagatagatacctccatctttttatcatctaatcttggaattgataggccatcacttcttctatattgtgtttgttagtaagtccagcccatcctcaaggtgagggaattacataagggcatgaacactaggagggcaaggaccgctagggatcatcttaaaggatgcctctgagattgcccaagggccatgctctggggaacaatcacttctaggttctgtggccttttagtttttctttgacttcctttgcttatgacctagagtcttgtggagtctttttatactcccttttatgttgtgtctcttggttcatgcattacttcattgctttgacatgacctatccttttttccttctccccggactcctgggctccaattagaaactagctttttatcctaggctgcagtcctgcctaccaactttttttgtttcataccttctattctggagcccattgtacagccactgactttggagcctttactactccaacttggcttctgagagttagatttgtagatggcattgaattgggactcacaatgacagatgaaaaacttcattctgactttttaggccattggtgttaggtgctaggactgaaatcctagtatgtgaaagctggaaggggttttagagaccatctctcccaaacttcttatttacatatcagaagaacaaacttacccaaggttttggtaagccagggctagaatataattttctctgattctcattcatatgttgttctcactctgttgtggagcctgtctaccctaatggagcctgtttgggttgttaggaggtctgggacctacacagaggagaaccaggaagcagttcacaatattatattatgttcaccgaaattggtctgggtacaattagggatatacaaagtcaaatgtcaagtgctgcttctttggacctatccagctagaaagcttttttattaggcacagaaaaagaagcccagcaatatctgtttcctatggtgcctaatatatgcaccctataccactctcttgacaatatctgttcagagcaatgaggaatctgtttgctgggatgtacagtataggcatctgaaggagacaggtcagagccttatgttgtatgtctcaccactgagctgttcagctggctccattatggatttggggcctccacaggcagggtaaatgtattaaaaactttgtggggttactcgtggccacctggaaagtgccaaggggaggttctctgggcattgagaatttgacaactttgcctgtgttgatacaacttgctagagcaggcaagacttgaagagggatggctgtggtcctgtcatgtttatcagagtggagcagatttcttttgtgtgagaagtcatgcaagaaaaatccggaaatgagccaacagcacttaaacttttgttttctgctggggagcatggaatagagaaggtgcaggttctaaaatttctgtatgggtggtggttgctttcctgacacagagttccagccccagaccactttactcacttcatctccctctgttccccttgctgcattcttggcaagccaagcatttttctttgttctgatctgcagaacaaacttttatttatactgcttcacttttgtttttacttatgtcatttaacttccttcagaatgtctttattacctgtccttctttatttctacttccagtcctctatgaagtctttcctgacactaattctagctgtgagatactgctgacctgtgaacaaactctggtagcacttactatctgcagtgctctctgtgcacttcacaccctgcttacgccacaagaggcagcttgctatgtcttttttttttttttttgtgacagagtcttgctctgtcccctggctggagtgcagtggcgtaatcttggctcactgcaacttccgcctcctgggttccggtgattctcctgcatcagcctcctgagtagctgggattacaggtgcgtgccaccatgcccagctaatttttgtatatttagtagagacggggtttcaccatgttgatcaggctggtcttgaactcctgaccttgcgatccgcctgcctcggcctctcaagatatgtcttttacagcaagccagtacctaagagcactgggcattggtttgagttcttggtgacagtatgacagtgtgatccaaactgtcaaatgacagtttcctcacttgaaaaatggagttatcagcaccataagagagggtaaagaaagaaagaaaagaaaagtaaaaaagaaattaaaactgtgctttatttattattattattatttttgaatatttccttgtctcttaagggcaagagccatgtctggtttgttggctgtagtacatatcctcagtacctatgagagtgctggtcagagagtatgtgcccagtagatatttgttgaccaaatgaataacaatgaattgatctttggattgagtaggtggggagggagaataccaagtacttgacatcagttcctgtaaaactgttagatgagcatgccctgggattgggatagaattcacatggtgagttttctgaggagttctgtagggattatttttctgcctgacctagtacttcatccctatttactaagcacctactgaagctgtgctcagtgacagttatcagtcataatgagggatggtttggctattgactttggttggcagtttttgtttgccacagcaatgactaccctgagcaggtggctgcagtaggagtggagaactgtgcttgaagaggacatgaaacctgtaggcaaggccttcttgggtcttcctgctccctgtctttggttccatggcccacatgggtttacctcaggtcaaatttgaggcagctgaatgaacagaatgaactttcactactttgctgagactagcttgtggaacggaggaggaaacctttcatggttcccactcctgggcttgttgtgcagcagagagataggatagtcctgtgaagattgctggctttttaaatgttatctctgatgctgagaactccagcctgagcaggcatcacatcagctttccttcaagacgctggggaggggcctcttgggagatgtgatggaggagacaaaagaataaaagtaactgtgctgtcagcacggcccagtaagggcttatctgaccctttcctcggttggccatatacacagagcccctggctgccttgtgttgatctctggcctaggtaatgaccagaaatctcactggcaggcaggcaggcaggcaggcaggcaagcaggcaggctttcaaatctcatgtgcctctaattttctcagtgtgattcagtagctctgctcctgtttggcctctctgggttatctcaggcctctcaggaagctctcagaactctcgtcactacagtgtatgttcgaacaaatgtgtctgtgcttgccaagttcccagagctggcttctgaaatacagcagccaggggagatgggtggccttcaggtgtaacacacacacacaggttagaaagcagtgtgtgtctgtgtgtgtatttgttgctgggtggtcgaatttgtggaggtcttgtttcaagaaacttttgctgacaagagcaaaggtcactggaactcacacttcatatctctgaagagataaatatgtaattaagacaactgaaataacttcgatggtaagaatgatgatgacagctactatttattgagcacctttgtaggtgttttacatctgcaaaacaactcttaagggtggatatagctctcattttactgatgaagaaattgtaactgagaacttaaggttattttcccaaggtggcggagccaggatttgaaattagctttatctgatcccaagaccaaaattgtttctatttttgtttaataacttggtgtggggtggggtggcggggaagaaacagctatctgagtttagaatttaggtggagataggcattttgattaaaaattatacaatttataggactgttaagtggtgttagtttattctatcacccaagtggcctgggaaactaggattagaggtgggatgggagatggaaagagaggctgtattttacttatgaattctgagtaggtagtacctagctacagagtggtgtatattcagtttatattttccaaaactatcaccctggttcaactgttctgaatttaagccttggggtaggggctgtgtctttgtagttagtgttctttatctcttcagtcaacatttagcatgtttattatgtgttataagacaatccctgcccagtagaaggactcaatatagcaggagaattaagatgtatggtcacattttatattataataagagcttctatttattgagtacctattcttttctctctctttttttttttgaccgagtctcactctgtcgcccaggctggagtgcagtggcgccatcttggctcattgcaagccctgcctcccgggttcatgccattctcctgcctcagcctcccgagtagcggggactacaggcgccagccaccatgctcggttaatttttttgtatttttagtagagatgggttttcaccgtgttagccagaatggtcttgatctcctgacctcgtgatccgcccgcctccacttcccaaagtgctaggtttataggcgtgagccaccgcacctggcctgagtactattctttatcaggactgggctaggtactttcacatgcattattttagttaatcctcacatcgggtctctcactttatagctttttgtacaaggcaatcttggttcagtgccctgtgattgatactgatagtcttgttggcagttgtgatcttctctgctgagggagatcagagaagctttgtagaggaggtagcagcttagtgggtcttcagatacttcaggtagaaatataagggaatttgtgggaagtattccagtcataggaaatgttatgagtaaaggtctggagtgggaaaaagtaaagagtctttggggggcagtagtttagattggctggagagtggtagctgtgccagagagtaccataaaaagatcaaggagggcctaaattgtcaggctacttgattccatagggaataaatagtccttgcacgttttgacaaggggagagacctgacctgagttttgctttagcaaggttaatctcacagaatatgcacagtacattggtaaaggtgagattggaggcaatgagcctagataggagactttgcaactgttcatgagcagaagacatcagggtctgcattgtggaggtaaaatcagtaggactcagagtttaaatgtaggaagggaaggaaagaaagaaaagagtcaaagatacaccagtgttttgagtgtgggtcatgaagagactggtggtgccattagcagaaaatatatggcagtcagaaggagggtcagtgctaggggatgattagtggtggggtagctgaacttatttgaagtgctgggcaaggggctacactccacaggacttcaggaaccaaataattctttctatgcttatttcacattgctacattttacaaatgagttttctggggtccaaagaaatgaaatgatttgcctaaagtcatacagtaactccatggtggaatctaagtctgagaacccaagtctctttgctttttagctattaaacttcctaacaaagctgagccttgactctaggaaaatcagagacagtcttggagacagacaaacctgacttcaattccagatcttgccagttttctgtttgtaagatcgtaacaagattgcttttcctctctgagcctcatattcccttttgtccacatttgcaaaaaagggaatattaatttttacctcatggaggcattggaagtaaatatgctttctataatactctttttacttttttttggttttgttctgagacagggtctcattctgtcgcccacactggagtgcagtggcaccatcacagcccactgcagcctccacctcccaggctcaggcgatcctcccatctcggcccaacaagtagctggtactacaggtgtgtaccaccatgcctggctagtttttatattttttgtagagatgggggtctcaccatgttgcccaggctggtctggaactcctgagctcaagcaatccacccacctcagcctcccaaagtgctgggattataggcatcagccactgtgcctggctacatctccgattttctagtgggatatggagtggctgacagaacaccgagtgaccatatcctatcagctactcttttttttttttttttttttttgagatgaagtcttgctctgtcgccaggctggagtgcagtggtgcgatctcggctcactgcaacctctgcctcctgggttcaagcgattctcccacctcagcctcccaagtagctgggattacaggcgcctgccaccactcccaactaatttttgtatttttagtagagacggggtttcaccatgttagctaggatggtatctcttgacctcatgatctgcttgcttcggcctcccaaagtgttgggattacaggcgtgagccacgacgcccggcctcctatcagctactcctgaccagagagaagatgattaatatccccttccctcagggtcttctgccaaccttcatgtgggctcaaagtggaggcaaagtgatagctgaatttaggctatgcttggtgagaacttcctctagactagggtaagtcctggcttgggacagaggaaccagggtggacttgctgatcagagtgcttggagtccttatctggtcgtctctttggtttagtacacaagttcctaagttcttctcagaggggaagtcagctgctctagtaggggtattgttaggtagtagggctgtggttatgtcagctctgtgtcatgggggcaggcctgaaactagctgttttgtccaatatctagtcacatactctgagtgagtggaggaggaatacaagattttctaattttaaaaaacaactggttactattttgtagcttctgtcttaatgccttttctttccattgttttcttgaaacttttttcattttcttccctcttcctaggttggttctcttgagtgttcacagctttctttagggaaaatctggtttaataaaaagaccatgagactaagaattaggtaggcttagtttagcctgggttctgttactcttgacttttctgggcttaaatttcctcatcccaggtattgtggggataacagaatctatcttacaaggttgatgtgtgcagatcttatgaaataatgtgataggcatttattcatacacaaatttgagtaatttatcattactgtattggtttttctcctctgaattgtctgatgatctgttctttgcaattctttggtttatccctctctctttagtaccctgttctcctaggttctcactcttccttataatcttgttttctaactctcgtttttttttgaaacagagtctacctctgtcgcccaggctgaagcacagtggtgtgatctcggcccattgcaacctccgcctcctgggttcaagcgattcctgtacctcagcctcccaagtagctgggactataggcgtgtgccaccacgcccggctaagttttgtatttttagtagagacagggtttcaccatgttggccaggctcatgttgaactcctgacctcaggtgatctgcccgccttggcctcccaaagtgctgggattacagacgtgatccactgcacccggccttgttttctaactcttaatgacaacaggaaaagtgtggctacactggcattacaccagttggaagggagtgggtctgagctcttggggaaatgtaaaagttcattggcttttgagtacaatatgttgtcattaacttgaacaagtctctttgcctccattttctttttttcttttttttttttttttgagatggagtctcactctgttgcccaggctggagtgcagtggcgcaatctcggctcactgcaagctccggctcccgggttcatgccattctcctgcctcagcctcccgagtagctgggactataggcgcccaccaccacgcccggctaattttttgtatttttagtagagacagtgtttcactgtgttagccaggatggtctctatctcctgacctcatgatcctcccacctcagcctctcaaagtgctaggattacaggcgtgagccaccgtgtctggctctttacctccattttcatatgtgccatctggtttaccattatagctcaattcttttgattctcaaagtcacttccatttctgaaaactcccctttaatgcacaagtattactgtgtttatgttactcccactttttttttttttttgagacagaatctcactgtgttgcccaggcaggagtgcagtggcatgatcatagttcactgtaacctccaactcctgggcgtaaatgatcctcctacctcagccttccaagctgggactatacgcaggtgccaccacactccactgatttttaaaaattaaaaaacttggccgggtgcggtggctcacgtctgtaatcccggcactttgggaggccaaggcgggtggatcacctgaggtagggagttcgagagcagcctgaccaacatggagaaaccccgtctttactaaaaatacaaaaaaattagctgagcgtggtggcgcatgtctgtaatcccagctacttgggaggctgaggcaggagaatcgcttgaacccgggaggcgtaggttgcagtgagccgagattgcgccattgcactccagcctgggcaacaagagcaaagctccatttcaaaaaaaaaaaaaaaaaaattaaaaacttttttttttttgtggagatggatttgcccaggctgttcttgaactcttggcctgaagcgatcctcgcacctcggcctcccaaagtgctaggattacaggtgtgagctactgtgtctggccatgtgtttacctctgaactgaggaccaaaactagctttttagtatggattaggttcagtatagccactggggaatggattgcattctggagtgaggggtggagcctggcaagagggcagttctgttagctcagtttacctacgcaggaagggtgttagggcctccaggcatacttatgctgcttctgttatagctgacacctaactgctcctcctgagctgagcgtatgcttgtactcttagccagaagtcagagcttggtgaggcctgattccccaaagaattcagtgataaaaattagggcacttgagcatatctaattggctgaactgtgtgaagggcagaggctttccctgggggctccttttaatctctgtggttatagtcttttaaggttggactaattaaaatgtgttgacagttggactcactactttccttgcactaggtcctgctccggcctcctagagtaccagaagttggcacagagctatttttcctggggagctgaggagtgggtttccatttcctaatctactaaatctacagtgatgtaatgtttgtccaaaatggactgccaaacattttatggtggggagaaatttaggctgggacttggatgtggcctgggtttctgcacttcttaaggtgtcttttcaggttgattgtctgttctagtagccctcaaatggccttgctctgtgagctggcaagtcatttctattgccctggagtatccttctctggtatgtgttcctcttctaaccagaaaaagggataaggaaaagatatttaagtcccaccatttgccagatcagggctagtgttttacacacctatcttttgaggtatgcttcataatgcccattttgcaggtgaagaaatagattcagaaaaggaaaataatttgcttgattgtcattacaggctgtaagcaactaaatcagtattcaaatccaggtctctccctagcttcaggttactttcctaaggtagcacaaatgatttcatgtcctcttatccttttaagccgctaagttctcatatccagagagtcttcttcggttcctttagccagaatgacttcttgccctgctttttcagactactctgcctctcgctaatctgtctgatatttaagtcactgaggcatgaatctacctccctcatctgactattcccgctcctgcaagatttggtactcagggtgtatttgttaaagaacagaatgaagttatagtgctggaatttcaggtgttatgatagactggcaagggtaagggttttgggcaaagccttggctagtttttcaaataaggccccctgtgtctttctgatttgcccagaatgtgctgttattttcctggacatctggctttagagtttgtatctttttttttttttaatttttattttctcctcctcttcctcttcttttattgtttgtttgtttgtttgtgtttttcttgtagttggtttgcaacctacagagctaggcttaatgctccctggactggagtgatatgacaaaccctcagcttcgtcttggttgctggaatatgcctgttgaccatggtgcttggattttgtttgtttggttggttttttgcaaagagcatgccaagatactaaccttgcatttggggcttatactttctgcaacctctgcctaccagtgtatgtcacttcacaggataaaggctttcctggcaaaggcaaacacatgtaaaggcatccctataagttgaattatttttctcactgacttgaaaacaattgaaaaactatctcagacctttttctgtgcatatagtgtatacttcgtgtttaacataaaaagttaaacttcaatggcaaattggaacataacaaaatataggccaggcacagtggctcatgcttgtaatcccagcactttgggaggccgaggcaggcagatcgcttgagctcaggagcttgagaccagcctgggcaacatggtgaaaccctgtctctacaaaaaatacaaaaaattagccaggagtggtagtgtgtgcttgtaatcccagctacttgggggtagaggcaggaggattgcttgagcctgggaggccgaggctaaattgagccaagatcatgccactgcactccagcctgggtgacaaagtgagaccctgtctcaaaaaaaaaaaaacccctaaaaacaacaacaaaaaaatcaaaccaacaacaaaatatagttaaaacgcctttagtggaagaactcataaaatattaataatcaaaataaatactgcaataggatgaaacatgcatttttgctttgtattgttttgataacataggcaacctgaaatagcttagtcaaatatattgaactaaataaggacgcaacattccttttggtttctgtgctatggagaatagatatgaaatgttcttaggagaaggggcaaataatgcattctgggactaggaagaactgtgctgtggctcagttcctctactcagtggtgaaactaagctttctggttgtctgttcccctatgtgttaaagggaataatacctatcttgtttaattttatgagggttaagtaagataatgtatgtgaaagtcttttgtaaactatgaaatactattattgtcatacttagtgggtggctggagccaatttgctagcactgtaaggaagcttttggtttaagatatggctagacctaggtaggaagaaggatgcaaaattaatggataaacagacctaggtaggaagaaggatgcaaaattaatggataaacagttgaatgctgtttgggtagcagctgagaggaattcctgtgagttgagggaaaggactacattcatttcttttgtttttgggagacagggtctcactctgttactccagctagagtgctatggtatgatcgtggttcactgcaaccttgagctcttgggctcaagcaatcctcctgcttcagcctcctgattagttgggactacaggcacatgccactacacctgactgattttatttttattttttgtagaggcagggtttcactgtgttgcccaggctggtctcgaactcctgggctcaagtgatcctcctgcctccatctcccaaagtgatggaattatgggccactgggtctggccttcaatacatgtttattgagtcctgcctggttgaagataaagaaatactgatatctacctactaaatacatgatgtggtaaaatatggaggcagtttggtttagaatgaaaaccccataaagatagggttcttgtctgtctcatgcactgttatgtattcaccaggagtagtgcctggcatgtagtaggctctcaaaaaatatttgttgaaagaaagtttacgatttggaatcagacagaccaggttcatatttgggttctgcccagcccctttactgagtgcgttgctcagtttcttcatttataaataaaataggactaggattagctggttattgggagagttgtttaaaaaaaagattaaaaccttttctataaggctttacagtaagcgcttaaggaaagatagtttctttcatttccccttgatggtttgcaaagtgtgatgggagtgcaggggaaaaagcagttagagctacctgggggagtctagacaatggcttcacaggcttgatctgttagtgtcttcctacagaacaacattattattattattattattatttcctcacaaaaggaactccctgggattaagcaagcatcttggaattggtatgccttgcttctctacatttcccatggtcttcatgggagggctggctcttgtctttctagcaaggtcacatttacactgtaggtttgttcagaggttgttgttccagaagaagcagctttcagtggagactctggacttagctgatttgcatgggcttttgtagccagccgtcaatcccctatccccaccctgccaaatacctcaataattgttagttatagctttgaaaacgtgtactcagcttgacttctgttccggatcagttgtaaattctcacataaggtagagcagagtgtgtttgcttgggttaatcaggtatttataagttgacctttactagtgaatacctaatttttccctcatgcctaagtaactctagcaggccgagggccttgttctcaggcattcccagaactgttgggagttgcagcaggtttgcctgcccttgtcatatatgcacaagggccagtaggatttatctgtctcccagcaagggtgcccaggacctctccttttatcctatcattctaaagcactgggaataccagtctcctctctctgatcagcattttagacactgatgctttctcttctagttagtttcttgggagaatgagtaagcagggaggaattgtttggctttcaggtaaaaaggacttcttgcttgtgaattgaagtcactaggcgagaagtgagtaaagaacatgttcctggataggagtggtcaagcgttggtaagttagacttggtttggggttaaatgggcctggtgctctctaggagtggaatcagtaagggtcctggctgtgtcctcattgccctccttcgggagctgagcattgctgtaggggagatctcacatatggtctggggagaagggaaaggaggagggttaaggaacgaagagacagagggaagaaaagggaacttttgctgagctgtttctctaggctaggtgctttacaccaataattttctttaatcttcacaacaactttgtgaggtagctataattagtcttgttttacatatgatgaaactgaggcccagagaggttaagcaacttacccaaggtcacaaagctagttaatgataataagttattatttatcatgtgcctgaaaagcacatatgaagtttctttttttttttgatcctatgaaagataattattacttcttcaatgcaaatgaggaaactgggaattaaagagctttggttacttgtggaaggtcactcatctggcagtgtcagtgcagggatttgaaaccaggtctgtctcattacagaatgtgttcccttgatgtccatgttgctctgcaaatggaagagctgggattcaaatgcagagtcatgagagcagggcttatgtcttacctatctttgtgtcaccattccctatgacagtgcttaccatgttgttagtgcccaataaatgcttgctgtaaaatctagctctgccctccccatagctcatgttagctgcagtgggttcctattgctagctgcgtcctgccccagctgctcggctgcctatcttcccccgacagtttggccttatcgtgcctacccattgtggcctccttgacatcccaacacacagcatctcctctagtactgttgctttcctcttcttcatacctctttttttttttgagacggagtctcgccctgtcacccaggctggagtgcagtggcgtgatcttggctcactgcaacctccgcctcccgggttcaagcaattctcctgcctcagcctcccgagtagctgggactacaggtgcacaccgccacacccagctaatttttgtatttttagtagagacggggtttcaccatgttggccaggctggtctcgaactcctgacctcaggtgatccacatgcctcagcctcccaaagtgctgggattacaggaatgagccactgcgtccagcgtttcatacctcttttccctagctatacattttcctctggctatggctttccaaaaccctccaatcctgttcattcttttctctgtagtttttctgacttattccagggacttccctttctagattataatcttcttagtctgtaccatataatttgtcacctaattatctactgtttcactttctgttggtttcgtggacattaatcttctccccagccaactgatggtagtcatattataataactccccagattggtttgtgctctgcactttacaaatcactccactgtttaagacctgtctttttgcttatcatgcccacagctgctctgtgaggtgggacaggaggggattgttatctccatattattgtaaacaaattcaaagaaagcaggtgacttcccaatgtcatatatgtaattaggggcagaacagaaactatatctcaggtttactaatttctggcttagaattttatctgcaggctcttctacatttgtttttttccttaccatttcccctcttgccttcaagggtcactcaaggcagaacatctaccttgtgggtttttaggaggtttggttggtgacccagtgaatggtaaagtagcccagatatcaatcttaggtacttctcagtggcatcagtgttctgggttgctattgccgagagaattctctttctgtggctattaggattaatgttgaactaagaagcattagattattatgaatggtcagaacacactctcatggagatccaggaagcaggacaggatgtgtggtgctgggcacttttgtgttgtggcaatggcatgagtttgcaagcagtcaggccagagtttgaaatctggctttgctgttgtttgctggcctcatgacccttagtaaatcattaatctctctgagccttagggccactgagagaatgtatttaagggccacataatggcctgtgaaaacagtatttgttgttggtttttattgccaatactactttaagtttaaggtgcctgaagggcattagaagcctgctagcacctgtgacccttgcaggttacttctcgtgtcttgatttccaagcattagtgatgactaccttggaagctattggctgatagaggatgagcttgaatgctgttcccaaagtctcccgtctcccaagtttccagtgccttctcagggcaatgaaaatagtttgtggacagctgggggatggtttcagtgtcaaactttgggagtaaaatctttcatgtttttctgaagaactttggcattagaattgttggttctggaaagtcaagaacacagttgttattgagagattttagttatttctgaaaccagatattgctccaaagctgtttgttaaatacttccctactcttcctaaacccctgcccctccccaaaagaaaaataaatcatattcagaccatcgtgcgatggttatatctctggcctccctggtcacccagcctctagctctctgctagcaccactccaaattgctgcttcaaaagaggtcagtcagcccctttcccttactcctcaaccatgacctggtctgtctggaaagaggatgagatacatggaccaatacatcctatttaaaagggagcttgctttctcactagggactttagactgcctgacacacaggaaatgactagaaaatctgaccagtggagcataactcattgctaaaatggcaggtttggacggctgcaggatgggagagcaggcttcctgaagaggcaggaaggggcagctggatgggaaaacagtgacttttgagtttttccttttagagtatggtgacgtaggccgtttattaaaaaaaaaaaaaaaaaggaaaatcacataacataaaattaatcattttaaagtgtacaattcagtgggatttagtactatcataaatgtagttcaaaactatttcatcaaccctaaggaaatccatacctgttaagcagttgttcctaattccccctctccctttcccctggcagccatcaatctgtgtatctgtgttttgtctgtatagatttacctattctggatatttcatataaatggaatcatatgatctattgatcatatgattattttattttatttatttattttttcaagatggagtctctctctgttgcccaggctggagtgcagtggcatgatctcggctcactgccagctccgcctcccgggttcatgccattctcctgcctgagcctcccgattagctgggactacaggtgcccgccacagcacccggctaatttttttgtatttttagtggagatggggtttcaccctgttagccaggatggtctccatctcctgacctcatgatctgcccatctcagcctcccaaagtgctgggattacaggcgtgagccaccgtgcccggccgattattttatttttatttatttatttttttgagatggaatctcgctctgtagcccaggctggagtgcagtggtgtgctttctgctcactgcagcctccgactcctgggttgaagtgattctcctgcctgtagctgggattgcaggcatgtactaccacacctggctaatttttgtatttttactagagacggggttcgccatgttggccaagctggtctcgaactcctgacctcaggtgatccacctgccttagcctcccaaagtgctgggattacagatgtgagccacggcgcccggccttgatcatatgattataatgggatcatatgatgtattgtgtctggcttctttcacttagcataagggaaagtaagttttagaggttcatctatattgtagcatgtatcagcacttcattccttttttttttttttttttttttttgagacagagtttcgctcttgttgcccaggctggagtgcaatggtgcgatcttggctcaccgcaacctctgtctcctgggttcaagcgattctcctacctcagcctcccgagtagctgggattacaggcgtgcgccaccacgcccagctaattttgcagttttagtagagacggggtttctccatgttggccaggctggtcttgaactcccgacctcaggtgattcgcccacctcagcctcccaaagtgctgggattacaggtgtgagccaccatgcctggccactccattcctttttatggctgtgtaatatttcattgtatgtttatacaataatttgtttatctattcatccacacgtgggcaatttgggctgtttccaccttttggctcttgtggatagtgctgttaagaatttgtgtgcaccgtttacctatgtaccaaacctacacatcctgcatatgtaccccggaacttaaaataaaaagaaaaaagaatatgtgtgtacatgtacctgtttgagtacctgtttccagttcttttgggtacatacctaggagtggaattgctaggttatatggtaattctgtttagtttttgaggaaccaacaaactctttttcacagcagctgaaccactttttacttataccagcaatggactaaagttctagtttctctacatcttcaccaaagtttgttattttttttattataaccattcttgtggatatgaaatagtgcctcactgtggttatgaaatagtacctcattgtggttttgacatgcatttctctaatctctaatgatattgatcatcttttcatgtacttgttggttagttgtatatcttctttggagaaatgtctaagttctttgtctattttttaaaactaagttgtttgtttttttgttattgtaagagttctttatatattctggatactagacatttatcttttttaaaaacattttggggcaaacctttcttgacttaaaaatcacccactagcctttaaatatacctagctctttcatgtctcagcctgtgctcatgcttttctctttgtctagaatatccttcttttctctggtggttgaaattataattgttcctcaagactcagctcaaatgtcacttcctccgagaagctctcttaattggtttctcctccttcttccactagttaggtgctcccttctatgaacatctctataatgggacaccattttttttgtttgtttgtttttgttttttgagacagagtttcactcttgttgcccaggctggagtgcaatggcatgatcttggctcactgcaacctctgccttccgttcaagcagttctcctgcctcagcctcccgagtagctgggattacaggcatgcgccaccacgcccagctaattttgtatttttagtagcgatggggttttaccatgttggtcaggctggtctcgaactcctgacctcaggtgatccacctgcctcagcctcccaaagtgttgggattacaggcatgaggcaccacacccagccaatgggacaattttttattgtctgcttcaaaccactaagttatattttctagagtcagggattatatttgattcatttctgtctttagcatttagcatatgacctgacatttagtggatgttaataaatgctaaatgaaacttgagtatagactgaagacttacttgatagtaatgacaccagacaccatcactgtaggagggatcagttgcgggctgtactagatgtattcatataataaatatttaagaccctactgtgtgccagaaactctgcttggtatgcagtaaagaataatagtccctattgttttatattcaggtaggaagataggcaataaacaaggagataagtaatataatgcttggtaatcataagtgctaaaaaacaaagtaagcagggcaaaggattagagagtgatgggggtgctattttaggtagaggggtggggaaggcctctcattggatggcccttaaaatcacctcacaagggtctggatcaggaatcagaagtcttgggttcttcttctatctctgtgctttgttacttagcaaaattacttaacatttcaaggttggagtttctttgtctataaaatgggtacaagagtccctgccctggtattgtgggagtgttgtaaggattcagtgagttaatggacattgaaagtgctttgttgtatggtgaacagcatgatgtttggctttccctttcccaagttgagaggatgagtgagcagtgtgggagccagccagatgtttccagcactttgaagacaaaaggaactggtttctgctgggagctgtcatgctagcttgcctgggacactgacttatgcagtcctgatccaggggctgagagtgaaacccatgccccaagtggttctccatgtacactggcaaaagggaatagccttgggaacttggggcctgttctgtttagccctccaggaggtagactgtggagaccactctttctctcagttcagccttatttcttgctatgtctgaacctaacccaagggagtaataattagcagtccccaagaagcttgggaggtggaggttgtggtgagctgagattgcgccactgcactccaccatgggtgacagagccagaccccatctcaaaaaaaaaaaaaggggtatgtttgtataatggaatcttatttagccattaaatggagttaagtgttgatagatgccacaacatggataaaccttgaaaacattatgctaagtgaaaaggctacatattgtatgattccatttacatgaaatgtccagaataggcaaatctatagagacagaaagtagattagtggttgccagggtgtggggggagagggtaatgagaagttacttctaatggatatggggtttctttttggggtaatgaaaatattctgaaaaattagattgtggtgatgatgggacaaccttatagatatattaaaaatcactgaattataaaatctaagaggattaattatatgtcatgtgaattatatttcaatataaacatagataatttttttttttttgagacagtatctcactctgtcatctagactggagtgcagtggtgcagtcatggctcactgcagccttgacctcccgggctcaaccaatccttccacttcagcctcccaagtagctggggctatagacgtgtgctagcctggccaatttttgtattattattattattttttgtagagacagggttttgccatgttgcctaggctggtcttgaacccctgggctcaagtgatctgcctgccttggcctcccaaagtttgggattacaggcatgacccatagtgctctgccaaacatacataatttgagtttgctgagaactattggtttaacacaattgtagataattataattttcttttctgattggaagtcttctcccggtacttcagctcacaaaggtggacacattccagttttattttattttattttatttattttatcattttatttttgagacagggactcgctctgttgtataggaggctgaaatatggtggcacaatcatggctcactgtagccttgacctccttggctcaagtgattctctcacgtcagcctgctgagtagctgggactgcaggcatgagcaaccacacctggctaatttctctattttttgtgtagacaaagtcttactgtgttgcccacgctggtgtcaaactcctgggctcaagcagtcctcccgcctcagcctctgtaagtgttgggattacaggcgtgagccactgtgcgtggccccattccagttttcgatgtgagtttgagcatgatcgtaggcaagggcccatcaatgaaggtgttgaggatatagcattgtcctgctttggctcaaggggacttttcctgcctttgattaaggattggcatgggtgagtcatttcccatagtctgagggatgtgggatataaagaatgaattgttatctccgatgatatcttgaatatcacacattataggccaaatataggtgctaaaccatttggcttgaattctttatagaaaattcactgggaacccaatgataaaatagagaaagacggataacctaagagggaggagcaatctggtgagacattcttttcaccttttcacacatgagcaattaaaaacttgagggaagttgattttttttttaactctgtaaatagctactggtataattccttgaggctggtattgtattttgtgctataagaagagagacttggctgggcgcggtggctcacgcctgtcatcccagcactttgggaggccaaggcaggcagatcacgaggtcaggagatcgagaccaccctggataacatggtgaaaccctgtctctactaaaaatacaagaaattagccgggtgtggtggcaggcacctgtagtcccagctactcgggaggctgaggcaggagaatggcgtgaacctgggaagtggagcttgcagtgagcagacatcacgccacctcactccagcctgggtgacagagcgagactctgtgtcaaaaaaaaaaaaaaaaaaaaaaaaggtcttatttggccgggtgcggtggctcatgcctgtaattccagcactttgggaggccgaggcgggcggattacgaggtcaggagatcgagatcatcctggataacatggtgaaaccccgtctttactaaaatacaaaaaattagccaggtgtggtggcgggtgcctgtaatcctagctactcaggaggctgaggcagtagaatcacttttcactcaggaggcggaggttgcagtgagccgagatcgcaccactgcactccagcctggcgacagagcaagactctgtctcaaagaaaaaaaaaaagaagagagacgggccatatactcaaggagtttccaaatatatccagaggtgaaacaaacatctaggatgaaaagggtccagggactagtattgtacacagtcagaggaggtagagggctgtgagtttggtaataagagaggaggcttgggaaacccagcctgagtctaggtccagagggcagcatgcactgggtgagggcctctagggagagtaaagcaggatacattcttgtccttatacttccttccctgtttctgtacctgctcacttttgccctgcaacaaataaacctttaagcatctgttctcagcctggccttgcactgggcaaaactggaaacatgggcattatgaaacctgggccatacatctagaagtgcttaatatattgtgagaggtgaacctggaaacaatggactgtaatggcatgggtcaaggtatgtaatagacagagatggatttgatatatcagagtgccgacctactgactctgtcttgggattaggtaaacctacctttaaaaaggcattgagacagggcctggttagagaaacctgttaaggttattgccagaagatgaagcggaggtacagaatgctacttttggggtatggctgctttagggcctttcatttcgttttcagatttgatgaaagaatagggcatctgtggccaggcgcaatggctcacaccagtaatcctagcactttgggaggccgagacgggcggatcacgaggtcaggagattgagaccatcctggctaacatggtgaaaccctgcctctactaaaaatacaaaaaattagccggacgtggtggcatgcacctgtagtcccagctacttgagaggctgaggcaggagaatcgcttcaacccgggaggcacggaggttgcaatgagtggagatcgcaccactgcactccagcctgggtgacagagtgagactctgtctcaaaaaaaaaaaaaaaaaataggacatctgtgtccaggaatctttttatctccccaccacccctcaagcagtgctgggctgactgcagaaggctcttccctgttctgcacttgttccatttctgtttttgaaagatgaagcctgggaggtgccagagctatgccagctgctatggggccagaaacaggtgaggcttttaggtctgcttgagttaaggagtgaggggtttgtcctcttcagctagcttaaggtctctgctatgaaactagataagtattcacatagcttgtttttcatttggggctattttcagccttggaggccagcaaggtgaatgattgagatgcttttatggggttcaagcttttgctagatcctatttgccaggataggtgctcagccattttccaggacatcagcttttctgaacaagcagcactgaaaggaagaagcacttcccttttctttcagggggcagtataggaaatgtgagggtgggtggtcagtttaatattataacccaggttttaagtagagaggctgtatagtttggaacattgccatatagtctttttttttgaatttttgagacagagtctccctctgttgcccaggctagtgtgcagtggtgtgctttctgctcactgcagcctccacctcccagattcaagggattttcctgcctaagcctggagattacaggtgcacaccacctgggattacaggtgtgcaccaccatacccagctgactttttgtatttttagtagagacggggtttcaccatgttggccaggctggtcttgaactcctgacctcaagtgatccgcccgtgtcggcttcccaaagtgctgggattacaggtgttagccaccatgcccggccgccgtgtagtctttaatgcagttttgagggactcatctgaattgttcttgtgtttttcttgtcatcttgactgccaggctttactatgggggtggagctctgtaaatgtatagatctgctgctgtccagagacttgatctcttttgtgcttgcacacctctagggctaacaaagcagatggagtggcctgtacaaagaggtgatgcatcagtggtctgtatccaggagtgttcttgggagttccctgtttagtgagtgcttactatgtgccaggcagctgtggcaacagcagtcatcatactagatgctgaggttttatcagagatacctaaggcaagatcattatcttatccctgaggcccaacaaataaatatttgttgtttaataaatgttgatccaaggaataaactatattttaaaggaacccagacacagggggtgtgagaaggaagctagcagtcattgaatgcctactatgtgccaagtactgtgttaagtgctttcacagatatttaatttttttttttttttttgagatagagtctcgctttgtcgcccaggctggagagcaatggcacgattttggctcactgcaaccttcacctcctgggtccaagcgattctcttacctcagcctccagagtagctgggattacaggcacacgccaccgcatctggctaatttttttatttttattttttagtagagatggagtttcaccgtggatacttaatttttaatacggtcttctgagattgttaatgttattgatatctttgagatggacaaaataagaggttaaattacttgttaaagtcactttctattagccgtatctaggcgcttttttgagggtctggcctctaggtttggtagatgcctaacagggtaaccttgtttttagtattgttgggtgagtggggctagtctgagtcttttcaaagttgcaggagatgcagttttctaggcttggtgctgaaaatatagataaggataatataaggtacataaactggaagaattactattgagtggggagacaggtaaataggcattacagggtagtaaatattaagcaaagacgggcctttttactttgtgagaggtacattgggcagggacttttactctgagacttcaactcttgtccttctttccatacctgtagctcctcattgggatctcccttattccctgaccatgtgtttcgacagtttcatgagtgttactttttcatcaagattgcttactccttgagactagatattctttttttctttcttactgcctcttagatatctgacctaggccatcacgcttaccctctctggaccttagtggcattatctgtaaaacaagcctaatgataggtgttttgcaatctgagagcaggggccagtccaagtggtgatctctggaggttcatctagtttttccaaatctgtgatttctgtgatcatcctcttttggtccttatatagagctggatatccaagaggctttaagtttgtcacagagattgctgaaggtaatttatggtacctcagaagtcttaagaacttttctgtatcacccctgttagagctacatacccagtagcactgacagagactcatggcttctcctggccagtcccttggactgaaccagttttctcagcctggtatggaagatttgactgaagttttaagctcaaaaggatattgtggccgggcatggtggcacacgcctgtaatcccagctactcaggaggctgaggcaggagaatcgcttgaacctgggaggtggaggttgcagtgagccgagatcacgccactgcactccagcctgggtgatggagcaagactctattgcaaaaaaaaagaaaagcatattgtatttaagtgtattttctagtatggcttatctcattatcagctaggtcaactagaggtagtgctttcctgattttgcttctagaaggcattctttgagcagtgggataggaccccatccttaggactttcacctctccaggtattgggccagaagtctaaagctccatgaaatactgtttatgtacaataccagcttgagctctaaacttgtaaaagaatcaactttgatatgacttagggtcccatgggacctaccaggaagtcacaggaactctgagccacagcgaagtccaccactaattagacagttaataataatgctaattgttatgataagaaatgtatgttgaatacttatatgtcaggtacaattacatatttatttaattctcacagcagtcaatgacatagatattgttattattctcattttgtagatgaagaatctaaagtcatgtgtctagtaattggtgcaagtaggacttaaacctaattagaaatttcatgttctaattccaaactctattttttttattgttttaaataaaaaaaattttatttttcatgttttttttttgagacagagtctcgctgtgttgcccaggctggagtgcagtggcacgatctcggctcactgcaacctctgcctcctgggttcaagtgattctcctgcctcagcctcctcagtaactgggactactacaggcacatgccaccatatccggctaatttttagtggagacagggtttcaacatgttggccaggctggtctcaaactcctgacttcaggcgatcttctcacctcagccacccaaagtgctaggattacaggtgtgagccactgtgcaggctcactattgtattttaattatttactttgatatcctcctaccagattttaaattgccagaaggcaggggctgttactcttcatttcattaaaaaaagaagtattgagttatggcttacatacaataaaatgaattaaatgcttgatgaatttttaccaatgtgtttatctatgtaaccaccacctagatcaagatacatttctgcatctttctagagtgtagcatagagatgagcaaacattttctgtggagggccagagagtgaatattttaggcttgatgggctataccgcaagttgtagcaggaaaacagccatagataatatttaaatggacatgtgtagctgtgtctaagaaaactttgtttacaaaaacaaggtgtttgggctagatttggcctgagggcctcagtttgctgatcccttgtctagcagagtgtctaaggacaaaatagaaatttggtaaatgtttgttgaattgtagacaaagaccttgatttcagaaatctcttcttgattttctagcagtggggcagcttgtatctccatggtagggctgtactttgtttttatttattttttatgttttatttatttatttttgttatttagtgtttatttcataatcataaacttaactctgcaatccagctagtcatggaagaaaacagagaaaacatggagcccaaagggaactgcagcaagagcacaaagattcaaggatactgcgagcaaatggggtggaggggtgctctcctgacctacagaaggaatggtctggtggctaagataaaacacaagtcaaacttattaagagttgtccacagtcagcagtggtgatcttcttgctggtcttgccattcctggacccaaagtgctctatggcctccacaatattcatgccttctttcgccttgccaaagaccacatgcttgccatccaaccactcagtcttggcagtgcagatgaaaaactgggaactgtttgtgttgggtccagcatttgccatggacaagatgccaggacctgtatgctttaggatgaagttctcatcatcaaatttctccccgtagatggacttgctgctagtgccattatggtgtgtgaagtcaccaccctgacacataaaccctggaataattctgtgaaagcaggaacccttataaccaaatcctttctctccagtgctcagagcacgaaagttttctgctgtctttggaaccttgtctgcaaatagcttgaaggagacatggcccaagggctcgctgttgacagcaatgtcgaagaacacggtggggttaaccacggctgatagtacggggctcccggcagcagcagcatctgcaaagacttttatgttttatttttaatagagatggggttttgccatgttgcccaggctggtcttgaactcctgagctcaagcaatccacccacttcgtcctcccaaaatgctagggctataatgttgagaggttctttgtggaacaggctgccttttgataagttgtttgtgttcataagggaataaaaatgtcatcccttccagtactctcccaattttgttggtgcaaggtcttcagaatatttgggatccatgaaaacaatatagagggatgtttgtatgaatcccctaaggctattatgtgttatttattttgtccttggtgcctagccagcatagatggacagggatgctcagtaaatatttgtttttgaatgaataaatgaatttaaattgctttcagtattttaacaagcctaatggaaattgtacatttacctacaataaaagtgtctttgattttggtttcaattatacaagttttgtgtgaacactagtttgctcatgccgattagttctttgactggcagttgatggcatcataggacataaacctacccagtgagtgaatgaccttggacacaagtacacagccaaaataaccaactggtagcagagcctggtgcatgaatatctacatgtttacttccactttcttgctcattagcaatattatttgtatatggttgataattgtatatggttggttaaaatctgggtcaacatttttttttttttttgagacagagtctcgctctgtagcccagtcacccaggctggagtgcagtggcgcaatcgcagctcactgcaacctctgcctcccgggttcaagtgattctcctgcctcagcctcccaagtagctgggattacaggcatgtgccaccatgcctggctaatatttttattttttgtagagatggggtcaatatcaatatccaaataaggtctacatcatgttgattgatctaaaccttcagtctcttctgggactacaggcacgtaccaccatgcctagctaacttttgtattttttgtagagatggggttttgccatgttgcctaggatggtcttgaactccggagctcaagcgatctgcccacctcccgaaatgttgggactagaggtgtgagccaccacgccaggccaatttgaactatatttgaaaaagagggttccattgtttaaaaataagtcttggaaactatagtattgtagctgttctctaacagcaccaattatgacaggaaccaggaactatgaagtggggacagtgactgtgactaacttgtaatatgttttaaacttttttttacttcctcatatttgttgtttttggcttacattctttctcaacccaacagttaaactcttacaacaaaaagggccccgtatgttttcacttttgaagggagagattggtggactgtcttaccctagagccaggcttcaggcttgggggcgggagtcccaaggggtggagtggggggttctgctttgatgagcaaaggaagtggttaagtccctggggcctgtgcagcctgaacaagagcccaaaagtgaccttgggagcatctaagactagacgctcttagcagagcatgggtcccttttccttaccccttattccatagcctacaggttctctttcagttgtccaaagggcctggctggtcaggctttagttgagtcacatccgacatgttccagacccagggtcctggtagctgtgtttagggctgattcctaggaatcatgagctgataacctcaggacaaagaatgaagggtatcttgtttttaaccgtgttcttttttcttttcttttttttgagacagggtctcgatttgttgcccaggctggagtacagtggcacagtctcagctcactgcaacctccgccttccgggttcaagcaattctcctgcctcagcctcccaagtatctggcattacaggcatgtgccaccacgcctggctaatttttttttttttttttttttttagtagagacagggttttgccatgttggccaggctggtctcaaactcctgacctcaggtgatccacccgcttcggcctcccaaagtgctgggattacaggcgtgagccaccgcgcccggccgaccctgttctaaggaaggccaagggcaggaacctcttagcaatagctttggctgatccttggccagcaatacatttgtcactctggccaagagaagagctgctgtggagcacttggtgttctctagcctttgtggaggtcacaggcaaacagggcaggggagcaaggccttaattacttagggactcctggagcaaagccacttggcagtgtctcagcttcttggtgggactggctccttctcctagtgacagtgcaaatactccttccctttatagcttttaaacctccaagagattggtcttcttccttgagcttcaagacatttctatgcagtgtggttcagggctgattttaaaagccggataggtggaatgacaaaaattccttccatctgtgtagcactttttggtcacttacccacattttatttagtttcaaaccaacggtcctgtgagttgtaaatgaagagattaaagcccagaaaggagatgcacttaaccaagtttatatagctaattcggctctgggttccgggaatagtgttctttctttctctctctttctttctttctttctttctttctttctttctttctttctttctttctttctttctttctttccttccttccttctttctttctttctttctttctttctttctttctttctttctttctttctttttctttcttccttccttccttccttccttccttccttccttccttccttccttccttccttccttcctttctttccttccttctttcttttctttctttctttctctttctttctttctctctctctctctttcttttcttttctttcttttctttctttctttctttcttctttctttttttttgagatggagtcttgctctgttgcccaggctggagtgtagtggcgcgatctcggctcactgcaagctccgcctcccgggttcacgccattctcctgcctcagcctcccgagtacctgggactacaggcgcccaccaccacacccggctaattttttgtatttttagtagagacggggtttcaccatgttagccaggacggtcttgatctcctgatctcgtgatccgcccacctcggccttccaaagtgctgggattacaggcgtgagccactgcacctggccggaatagtgctctctctctaccattatatgtgggacaaggggaaaggagaatggtaaatacagttattttatgtactaggcaatgggtaaggtgcttagtttagttttctcacattttgtggtaatttattttttaatctctattttaatgttagggaagctgagcttcagagtagttgacttactcacgatcatagagctaagtggctgagcctggattcagatctaagtctatttgacttcagaacccatgtcttttcatcattatactatattcctcgatagttgtttattctgaaacatcttgattgagctgccgatgcaacactaggtagtgtcacaagggatgcaaggaagcataagatttagtaatttcttccctcatggaatacgtaatttggtgatactgctatggcagagacaatggtgcatagggatagatagagacatggggcagtgggagtttagggagccccccaaataattggtggtgggggaaattgtcagagaaggctttccagaaaagttggtaccttagcttctctagcgataaagagcatgggtccttggggtcagcttgcctgggtctcatcactatagtactatatgctagctatagtgctttggggaagttacttaatgtctctgagcctgcttcctcatctataacatggaaattattataaaatcaatctcatagagctgtgcgaagattaagatgagataatctatgttgaataattagcagccagcttgacacataataagctctcattaagtgttaaccattataattatcactgtctaatctgtttttctcccatatcctgctcaagtggggacaaatgtaggctctcttagggcctgttattgtcaataaagtagaggttttgtctagagtgatttcaaaatatttctttcaggcccaagattctgtcaaagtaaaaactactaagttaattgtttccaggagggcagctgtcaagttactttgtatcttgtggcaaccaaatctggcttgagttccataaagccagctctggtgagttgctggaaatgctacctgataaaggctcttctttcctctgctgcctcttcattggattgactgaaagctggcctcttggaatactggtctatttctcttctcttcctccaagcttattgcgatggagaagatgatgtaattttagtagtccaggtattctctactacttttgggtcctgtctattctgggtaactgtggaatagcagtacctttatatatttgtacagtgctttttgtttgtttgtttgtttttatttttttattttattattattatactttaagttttagggtacatgtgtacaatgtgcaggttagttacatatgtatacctgtgccatgctggtgtgctgcacccattaactcgtcatttagcattaggtatatctcctaaagctatccctccccccgccacgcccaccccacaacagtccccagagtgtgatgttccccttcctgtgtccatgtgttctcattgttcaattcccacctatgagtgagaatatgtggtgtttggttttttgttcttgcgatagtttactgagaatgatgatttccaatttcatccatgtccctacaaaggacacgaactcatcattttttatggctgcatagtattccatggtgtatatgtgccacattttcttagtccagtctaccattgttggacatttgggttggttccaagtctttgctgttgtgaataatgccgcaataaacatacgtgtgcatgtgtctttatagcagcatgatttatagtcctttgggttatacccagtaatgggatggctgggtcaaatggtatttctagttctagatccttgaggaatcgccacactgacttccacaatggttgaactagtttatagtcccaccaacagtgtaagagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtcctttgcccactttttgatgggggttgtttgtttttttcttgtaaatttgtttgagttcattgtagattctggatattagccctttgtcagatgagtaggttgtgaaaattttctcccattttgtcagttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatgattttaggtctaacgtttaagtctttaatccatgttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagctttgtagtatagtttgaagtcaggtagcgtgatgcctccagctttgttcttttggcttaggactgacttggcgatgtgggctcttttttggttccacatgaactttaaagtagttttttccaattctgtgaagaaagtcattggtagtttgatggggatggcattgaatctataaattaccttgggcagcatggccattttcacgatattgattcttcctacccatgagcatggaatgttcttccatttgtttgtatcctcttttatttcactgagcagtggtttgtagttctccttgaagaggtccttcacatcccttgtaagttggattcctaggtattttactctctttgaagcaattgtgaatgggagttcactcatgatttggctctctgtttgtctgttattggtgtataagaatgcttgtgatttttgtacattgattttgtatcctgagagtttgctgaagttgcttatcagcttaaggagattttgggctgagacaatggggttttctagatatacaatcatgtcatctgcaaacagggacaatttgacttcctcttttcctaatcgaataccctttatttccttctcctgcctaattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacatcccatcaatacctaatttattgagagtttttagcatgaagcgttgttgaattttgtcaaaggccttttctgcatctattgagataatcatgtggtttttgtctttggctctgtttatatgctggattacatttattgatttgtgtatattgaaccagccttgcatcccagggatgaagcccacttgatcatggtggataagctttttgatgtgctactggattcggtttgccagtattttattgaggatttttgcatcaatgttcatcaaggatattggtctaaaattctcttttttggttgtgtctctgcccagctttggtatcaggatgatgctggcctcataaattgagttagggaggattccctctttttctattgattggaatagtttcagaaggaatggtaccagttcctccttgtacctctgcctaagcaagcctgggcaatggcagacgaccctcccccagcctcactgctgccttgcagtttgatctcagactgctgtgctagcaatcagcaagactccctgggcgtatgaccctccgagccaggtgcgggatacaatctcctggtgcgctgttttttaagcccgtgggaaaagcgcagtattggggtgggagtgacccgattttccaggtgccgtctgtcgtccctttctttgactaggaaagggaactccctgaccccttgcacttcccgagtgaggcaatgcctcgccctgcttcggctcgtgcacggtgcgccgcacccactgtcctgcacccactgtctggcactccccagtgagatgaacccggtacctcacatggaaatgcagaaatcaccatcttctgcagcgctcatgctgggagctgtaggccagagctgttcctattcggccatcttggctcccgacctgtttgtttgttttttgagacagagtctttccctctattgcccaggctagagtgcaggtttgcgatcacagctcactgcagccttctgggcacaaatgatcctcccacctcagcctcccaagtatctgggactacaggcacaccccgccatgcctggctaatatattttttgtagagatgggttctcactctgttgcctaagctggtcttgaactcctggactcaagcagtcttcccaccttggcttcccaaagtgttgggattacaggcatgagccactgtggctggcccaatgcattgttttaagatataatgagtgtagtggctaggcacggtggctcacacctgtaatcccagcactttgggaggctgaggcagtcggatcacttgaggtcaggagttcaagactagcctggccaacatggcgaaaccctgtctctattaaaaatacaaaaattagccgggcatggtggtgtgcgcttgtagtcccatctgctctggaggttgaggcaggagaattgcttgaacccaggaggcggaggctgcagtcacaccactgcactccagcctgggcgacagagagagactcagcctcaaaaaaataaataaaataagtgttcttcagaatgtcagtatcaggtgaaatggcattattattattactcagtaaaagacctttgagattaagttaggaaaagctaggaggctttaatatgataaggaaaggtatacagggttttctatgtttttctgaacatgtaatctttttttatcctcaaaaaccacctattgacattttgttagataccagtgttccacagaacaccattaggtaaatgaacacagtgtggtcccctgcttttctattagtatgacttggagaagtagtatggccagctgtcctttagttgacaaggtacctccatggctccttttcaaagagaaaatgagatacttaatgacagcttatgtgtcagaaaatctcctaagtgtttaacatagattacatctttgtgttcacaatagctctatgagattgctgatatagttttctccatgttgttgttgtagaaaggtatagatcttggttaatccaccagtccctggttatgtctcagactcagtggtaggagatttagctaactgagcttttattgtttgcctaagccttcttcatttttttcttttgagatagcatctcgctctgttgcccaggctggagtacactccagcagtgcagccacagctcactgcacccttgacttcctgggctcaggtgatcctcctgccccaggctccagtctcctgagtagctgaaactacaggcacgtgccacgatgcccagctaatttttgtattttttgtagagacggggttttgccatattgcccaggctggtctcgaactcgtgagctcaagcaatcttcctgccttggtcccccaaagtgctgggattacaggcatgagccaatgtggctggcccccaacatttcttaaacatttattgttcttgggtaatggagatgtagtgatggaaaaccagacactgcctcatggaacttaatctaatagagatgattagatatgagtgtggaagtataagttacacattgggactttagaggttaagggaaggcagatatttttatgagttactgtagcttcctgggatggtgtgacttaactaatccctaaaactctgtttaagtttatatactgcagaagcttgggaggcatttagattggaaaatgacctgagtgaaaataggagtgagcagagagcagcgatccccaatctttttggcaccagggatcggtttcatgcaagataatttttccacagaccagggtgcggggtggggatgattttgggatgaaactgtttcacttcagatcatcaggcattagattctcataaggagcacgcaacctagattcctcgcatgtgcagttcacaataggctttgcactcctgtgagaacctaatgctgccactgatatgacaggaggcggagctcaggcagtaatgctcgcttgcctgccgctcacctcctgctgtgtggcctggttcctaacaaggcacggactggtacagtctgcagcctgagggttggggacccttggcatagggaatagaatgctcaggagaaggtggtatcctgtactgctcttaggcatgacaccacctgtgagactgctgaaggcgttaatttctggccagctgaaggtagcattgccagaaggaggagctgggcagattgcaattggtgttgtggatagaggcaaaggatcataaatgatcgtcagaagggagctggtggattatggaatgtgaaatgggacagggcaacatttcatatctcaggctatgaatgacagagggacttggaacctgaacatgtttatatataatttattaagttcttaccatgtgccaggtactattctttgcatttttaatgctaagcttatttaatttttattagtagtttattcagattagcttatttaatctttgtaccaaccctatgaaagtaggtactattattttactgttttaaagatgggaaaactgaggcctagagaactgaaataatttgcccaaactcacatggctaataagtggtagaggtgggattcgggcccaggtaatatgttttcagtgtgcttgttcctaatcactctggtttacagttttaagcaatgagaagtcattatagatttctgcctagtgaagcaacttgtttgtaagtattgtgatgcagggcaatttcccaagccttgatggaaggcaagaagaccagccacagggtgttgtagcaaccatcccagttgctttggaagatgtataaaggtcttggagttatttcacaaattacttcctgagatggctctgtcagttggcagtcctacctgtcagctcagcccattttagaaatcattttccaaagaattttaaccttaaggaagctctcctctttctattgaacaggctgtaccaggcataggggccccaggaaccaggtaggaaatagctcttgtggggtcagtccatctggaagcatttgcaagaggggaagttgaaactattgagacttcctgttgtcattagaatttgctctcctgctatagggggagtatcccctgttaggactgatagtctggttgcttatcttgagaggctgggcaagtgggttggggtgcagagatgtgaaagacatagtctgtgtccatgaacaacctgcaggttactgagacacccataaacaagtgcactctgtacagtgtcacaagtgctacaatagaggtacatagaaaatgtcctgggaaaggctgggcttggtggctcacgcctgtaatcccagcactttgggaggctgaggcgggtagatcacgaggtcagcagttcgagaccagcctgaccaatatggtgaaaccccatctctactaaaaatacaaaaattagctgggtgtggtggtatgtgcctgtaatctcagctagacaggaggctgaggcaggagaattgcttgaacccgggaggcagaggttgcagtgagccgagatcgctccactgtactccagcctgggtgacagagtgagactctgtctcaaaaaaaaaaaaaaaaaaaaaaagaaaatatactgggagagaaaggaaggagggtctaaatacttagcaatatcaaagatgccaccctgtaaggatgaccagggttgtgccagacagagtgccctggagcatattctgggcagtgtgactgtggaagtgcatggcatattcagtgaatgacgagttgttccctgaactggagtgttggactacttggagggagtggcacgagatgaagctgggtgtgtgtgaagggccagatcccgaatgaccttgtattttatggtaaagagcttaaatcctattggagttaagctttaccgtcgatatttaagatgggtgtgacatgaccagagtgttttttttaggaagacctcttatatgcctgtgcttagaatgtatagattataactagaggcagggaaggcagccagaagatttgcagtagcagatgatgaggctggaacaagggtagtggtcatgggggttgatttaaattgtgtgacggaaggatgaaggaggcagtgttaggtgactgggcattactgtgatgctgttaacacatggaatacaagagagagagccggggaagttaatgctgctcttgagatggttatgggtgatatccatgagaaaatatctggtagttgggggagaagacatgagttttggagttcctgagagaggtaggaatagacatgagagaatcatgaactctaagaaatagtagagactgtagaagtagatgagatcacctgagtaaaatttataaaatggggaaagaaagggggttaaggatagagcagagaggaactctgatatgtgtggacagaaaagttagggagggagcctgaggaggggcaatcagagaggcaagagaaagtactgtctgggaagccaggaatgagaaaagtttctaaaagaaagcaatagtgtctgttgcagcagagaacaggtagggtgagcctgaaatgaggctactgagtcattggtgaccatggtgacagcagtttcagtggaggggtggggacagaagctagactgctgtggcttagggagtcagtatgaggcaaagatgtagaacaaaagacttttttgagaaatatagttgcgagggaaggaaggaaagagggtggtattttgaagaggcagcagaggaggcaggttcaaagatttttttttttttttaaaggtggaggggtggagtggagacctgagctggtataggttgtggggagaagagattgagaaatgtagccagtgaaggtgccacatctccctgaatacttcatactattgtgggagtcttaaactgtgctgctctgctgaagcctgcggtcactagagcatggggcagacaagggagaccttgtcattcataagtaatcattgcaccatttattgagtaaccgctgcatgccaggcatttttctagatacattagacacatctctgatgctcaccacagttcccagaagtgagtattgtccctattttccaaatgcagaaacagatgagttaagaaacattcagctagttagtggtggagccagtttcagccaggtttctggaactgcatgatgtattctttctgcttcccagtgctattttttttccattaaatggagcttaatgttgaaactctaaagagggcccttgcagggggcagggtgggtggcctagagggacaaaggtagagttctggggctagtgctagcctggagggaacatgacttaatatctgggatgagggaggagggtcttggtctggccttgctctaccttttctttacttaccagtggctctggtggtttcaggcttttactctatttttctgcatctttctgtaacttcttaccagggcccctgaggccctagctgctgtgtgctatggactgttacagaggaaaaaaagaatcagcttccaggcccagaggggcttatcctttttgacaaactactcgtgaggaattgctgagctgtaggatgcactctctttggcacagtggtaggcttcttcctaagtatttttatttgagttgaataattttgattcagtggaaagagcaaaacactgagaattagaagacatgatttccagtctaagagatgaactaggttacctcaggcgagtcattctccctttgcatatttacttgatgtaaggtagggactgtgttttactcatccttgtatcctgagcagctagcatatgccctgactgaataggtgtcctgaataagtttattatggagctagttaatctgctcttctattaaatgagaaaattggaccttttgatttccaaagatttgccaattctaaagcgtattgttctgtgagggcttatgatgttttaattataaaataatatatactgtcacttagcacctactatttgctaggcattgtgtgaggttctttacatatttattttatttaggtgatttaaaaaaatttaaattttgtctaggtgctttagaaatactatggtcccttaggctataagctccatgaggatagtaccagtgcctgttcactgctgtaaccctaatgctgagcacagtgctaggcatgtaatggatgctcagtaagtttttgttgaataaagcaataagtagatgtcttaccatcgataagataacaatcttttaagataggtactattagtaccatcgtatagataagaaaattgagggtaaaaggtcacagaactagtaaatggctgagagagagaagattcaaacctaaatccaactctaaaattggtacctttactacttaacaccagcgtgccttcacttatctgatgttttaattgcaaatttgaaaagaaggacaacagtaaagaaggatacaagatcagaaaatcaaatttttcttgaggggtggggacagggttagaggttgggcactgaagtttagaagttggcaattatctccaataccttaagaataaaaaggggtttataagcttgggaagctgggggaaaaaacgaacaaaacggggttataatggcagttactattcactgggagctttgtttattgaatatctcatggcattaaaagtccacttacataattttaactatcatctatttattgacaactcaaatttgtgtttccagcttagatttctccctgaattttagacttgcatatctaacctcttaattaacattttagatatctaataggcattttaaatttaacaagtttcacttacatggaatctgtcagcatatcctgtcggttctacctttaaaacaaatccaacattcagatacttttcattacctctgcacctaccaccctgatccacgttaccatcgtctcttgcctggtgagataatagcctaactgattgccctgcttttgcccttgcctgtctacagtttattctaaacaggaagccggagtgatcctttcaaaacgtaaatccaaattatataactcttctgttcaaaattgttcagtggctttacatatctctcagggaaaaagccaaagcccttagagtggcccacaagatcacatatgacttggctcccagttactgtcttagcctcatttcctctccacctgctcaccctgccccactggctttcttaccattctttgaacaatagagacagacatactcttgcctcagggcctttgcattggttcttccttcttactctaactttctgcatggctcatgccttatttccttcagatcttttggtcaaatttcaactcagtgaggccttatccaatcattctatttaaaaatagcaatccctcccccaccacacactgcaacccctttctctatttttcattacagcatttatcaccatctggcatatttattggtcaggcctttcaccttgcacccccactccctgttagttccataagagcaggggtttttgttaatggctaaatcctcagtgctagaatactgactggtgcatatagcatatacttagtaaatatttgttgactgaatgaacaaatgattgaataacctttttgggcctggtatatttcttgatgctttatatatatttgtttacttttctgcacaacagtcttgcaggatactactattattcccattttatgaatggggaaagttatttgctggccaggcacggcggctcacgcctgtaatcccagcactttgggaggccaaggcaggtgaatcacgaggtcaggagattgagaccatcctggctaacccggtgaaaccctgtctctactaaaaacacaaaaaattagctgggcgtggtggcgggcgcctgtagtcccagctacctgggaggctgagacaggagaatggcatgaacctgggaggtggagcttgcagtaagctgagatcgagccactgcactccaggctgggtgacagagcgagactccatctcaaaaaaaaaaaaagttatttgccaagattgcatggctagaaagtttaaagcctaggtttattctgcttaatacattgtcaagctcaaataaaatgttatagaaagatggcttatggcttataaatattgttgctttgctgctgaatggagtttataaaccacaagcctagaaaccagaagaaagccgaagtctgaatttcctgaactggacattgctcattcactcacttgggagcaagctgatatttgtgactgtgacatacctggaagcctaaaatacacctggaaaaaggcctttgtgtgagttcttcctgtgcaccatttgacccatatttggcttgcatacacagaaagtgaggggggttttatgatgatttggaagtttttctcccctaccaccccagagaaagaccttctttccctagttggggatagtactagtgttactttgggccagttgcttcatgtcacttttctttcctgagttgagtgccagccaaggccagagtgcaaatcattcccaaggtatactggggtatgactttctctttggtatggtgactggggaggccaaggccagagctgatctcaaagtaagatgaaactggggtcagtgatgtctccagggtaaaatgagggtgggttcaagtgccgtcctaatagagctttgtcatttcaaggattctgtcagaaagaaggtgagagagaataaggtctggatccaactccccagctgattgggggtatgggtataacatatctccctcctaagtcccaggtaccagtaactttggggtgagggtcctggtgaagtcctgggcttatgagagacccaggcagaggaagcagaagcagatatattcagtaaggctattctcagtaatatgacagaagtagaatagtaggaggtggaaaaaaagtcatcttatggggctgggcgcagtggctcacgcctgtaatcccagcactttgagaggctgaggcgggcggatcacgaggtcaggagattgagaccatcctggctaacacggtgaaactccgtctctactaaaaatacaaaaaattagcctggtgcggtggtgggcgcctgtgatcccagctacttgggaggctgaggcaggagaatggcatgatcctggcactgcactccagcctgggtgacagagcgagactccatctcaaagaaaaaaaaaaaagaaaaaaaaagtcatcttgtggtattatatggtcaataacatatgtaaagaagagtgaataatgaggtatggattagaatggcacccagagggaaatgagactggaatcagagccgttccgaggaaataatgaaaatatgagaactttccctagggtgagataagtctgtgggaaatgtgtatgaggtgacaaaatcattcccagggtgaaagaaaaaaatatgtttgagcagccatgagtaggaagggaagcataatgagagggaagaattttagggcaagatgtttaggagataaggctagggaaacaagcagatgccagattatagagagccttgtctatctgttaaggatttgcgactatattctttgggcaatgcagaaccactgaaaaatttaaaataagggatagacatggtcaaatttcctcctggtcataatgacctgtgttcctaggggagctgaggtcaggaaaggttagaaaagagtatggcagtttagggactctaggcagatgtttattgaaagccaaaagtatctggcgtatccatctgagcagagatgccagaggactggatgaaacctgacctgagtgaagtaagcagaggctttcctggacctcatcaaaaactaaggtccagctgggcatggtggcacctgcttgcagtcccagctactcaggagctgaggtgggaagattgcttgagtttaggagttcaagaccagcctaggcaacatacgacaccctgtctcttaaaacaaaaaaatttagaactaaaaacctctgtggatgcacaacactataaatgtactaaataccactgaattgttcacttaaaaatggtgaatgttatatgaatttcacctcaataaaagattaaaactaaaaacaggccgggcgaggtggctcatgcctgtaatgccagtactttgggaggccgaagtgggcggattacaagatcaggagttcgagaccagcctgaccaacatggtgaaacccctgtctctactaaaaaaaaaaaaaaaaaaatatccgggcgtggtggtgcctgcctataatcccagctactcaggaggctgaggcaggagaatcgcttgaatccaggaggcgaaggttgcaatgagctgaaatcgcaccaccgcactccagcctgggcaacagagcgagacaaacagacaaacaaacaaacaagaaaactgaaaacaaactaacaaatctacaagtctcatcctgctggagtctgtgggatttggcctggatttgccttccttctgtaagggcttggtttatcagtggtagcattggggagataaggataggactaggcatagcagcaaggatgagactccaaagcatgtgtccttgtccatccttccagttggctgccagaatcttctaacaagtcaatctaactgtggcccacctctgctcagaagtctattgctttcctatttctcagagattctaaaatccaagcttctcaatctggtgttcctggcattctatgatctgggttctgcatattgtcttttcagcaaacatttttctatgctattattcatgttttccattttgcttggaatgtctccttaccatctttttaaaattgtttttgtttttttgagacagggtctcactctgttgcccaggctgcagagctcaacctcctgagctcaagtgatcctcccacctaaccctcttgagtagctcggactacaggcatataccaccatgcccggctaactttaaaattttttttgtagagacggggtctccttctgttgctcaagctgctctcaaactcctgggttcaagtgatcctcctgtcttggcctcccacagtgttgggtgtgagccaccacccctggcttgcttactcttttctatctagtaaactcctcatcttttagtacatagctccagtgtcaccactttttaagctttctctgtcctccttgcctgtaggcaggcagtctattctactgttactctcctatcatactttatatgtctcagttatcttgctgcattgtggttgctttgtatgtgattgccacacaagattggaagttttttaaagacagaaacactgctttgctgttgttgttgttgttgttttctataccacttggcctagtattgcacagagatagcacttactgattttttagagcaacttttatttccaccataaatactggtcacagaagttaaataagtaggctttgttggtattgttcagtctagtgaggctaatagggggcatctatccataactgtccttccattcccttctcctttcccttctccctaaccttctcccctcccatcccctctcctcccctcccttctcccctcccctctcctcctttctcccctcccctcccttctcccctaccttctcccctcccttctcccctcccctcccttatcccctcccttctctccttccctcccctcccctctcttcccctctcttctctctttctttttttccaagctagccatcaggtttcactgaacaataactgcaaacttcagtatagctgggtttgggaataaatttttttttttgagacggagtttcactttggtgcccaggctgtagtgcaatggtgcgatctcagctcactgcaacctccgcctcccagattcaagtgattctcctacctcagcctcccaagtagctgggattacaggtacccaccatgatgtccaactaattttttgtatttttagtagagatggggtttcgccatgttggccaggctgttcttgaactcctgacctcaagtgatccacccgccttggcctcccaaagtgttgggattacaggtgtgagccaccgtgtgcagccaaatcatttgtttaataagacaaaatataaaaaaaactgaggtaatatgaaagagattcttagatgcctttgccaatgtgggctctctcattctttatttaatgatagaacacctgagttttagcaggatgcatagctgctcagcttcctttgcaactaagtgtggccacatgtgtcagttctatctggggggtgaggatccaagtggaaatcttatgtgtaccacttctatatcatgtacttaaaaacagtatgtggtgcttctctttccctttttcccttcctgctagctggaatatggtgagatctacagcaccttttttggtcccagagatggaagcctcattttgagtgagaatggcaaagtcccactctcatttgagactgctcactgcttaactattatgagagagaaataaactttttgtttaatccactgtatttgagggtctcttagttacagcagctttatctgtatcctgaccagtacagtgaggcatcaaattgctgcagtatcaagttgcttttttttttcttttcttaggacagggtcttgctgtcgcccaggctgcaatgcagtggtgtcatcaccactcactgcagccttgatccctgggactcaagtgatcctcctacctcagcctcctgagtagctgggaccacagatgggcactaccatgcctggctatttttttttttctttctagaaatgaggtctcacgatgttacccaggccagtcttgaacacttgggctcaagtgatcctcccgcttcagccttccaaagtgctggagttacagggatcaaccactgtgcccagtttaagttgcttcttgctgctgttcatgggtatctcttagtcacactatgcaccgggttcctgactgtttcttgccatgccttgcttctaagccttaattcctgatgcctggatgattccctgaactctctcatatacttaaagacattttattgaggtgaaattcatagaacattaaccatttcgaattaaacaattcagtagcatttagtacattcacaatgttgtacagccaccacttctatctagcaccaaaacatttctgtcattccaaaggaaaaccccttacctattaagcagtttctccctattttccgctcccgctggcagccaccaataggatttacctattttggatatttcatatcaatgaaatcatataatatgtgaccttttgtatctggcttcttagaataatattttggagcttaatctacgttgtaacgtgtcggtactttctttttttattattttttttggtggtaaaatatatataaccaaattttgtcattttattcattgataagtatacaatttaattacagtaattacactcacagtattgtgcaactttcaccactattttaaaacatttttcatcatcccaaacagaaactttgtacttattaagcaataactccccattcctccctcctgctagcctttgttaacttccagtctactttttgtcttcgtgaatttgcctattctagatatttaattaagtggaatcatataatgtttgtctttttacgtcttgcttatttcacttagcataatgttttcaaggtccatctatgttgcaacatgcatcagaaaacttcattttttttttttactggctgaattatgtgtatatatacataccacaatttgtttattcatctgttgatgaatatttagactgctatgctatggacatgctagttacatgtacttgttccagtacctgttttcaatttttttatattttttgagacggagtctcactctgtcgccaggctggagtacagtggcgcagtctcagctcactgcaatctctgcctcttgggttcaaacaattctcctgtctcagcctcccgagtagctggaattacaggtgtgcaccgccacgcccggctgatttttgtatttttagtggagatggggtttcaccatattggccaggatggtctcaatctcctgacctcgtgatccgcccgcctcggcctcccaaagtgctgggactacaggcgtgagctaccgcccctggcctgttttcaatttttgggagtgtatcataggagtggaattgtagaattgtatggtagctttatgtttaagtttttgaggaaccaccaaactgttttccatagcagctataccattttacattcccatcagcagtgtataaggggttccaatttttccacatctttgccagtacttcttttttttttcctttttggttttgtttttaattacaaccatcctagtgggtgtgacatgttatctcgttgtggtttgatttgtgtttccctagtgactaatgatgttgatcatcttctcatgtgcttattggccatttgtatgtcttctttggagaatgtgtatttaagtcctttgtccatttaaaattaggttgttttttgttgttgagttatgaaaattccttatatattctgaatactagacccttaatgagatgtatgatttgcaaatattttctcccattctataggttgatttttcactttcttgataatgtcttttgatacactgtagctttaaatttatttttattttttagagacgagattttgctatgttgcccaggtgcatctcgaattcccgggctcaagcaatacacctgcctcagccttgcagagtgttgggattaataggcctgagccactgtatccagtctagtttttaatttttttttttttttgagacggagccttgctctgtcgcccaggctggagtgcagtggtgccatctcggctcactgcaagctccgcctcccgggttcacgccattctcctgcctcagactcccgagtagctgggactacaggcgcccaccaacacgcctggctaattttttgtatttttagtagagacggggtttcacggtgttagccaggatggtctcgatctcctgaccttgtgatccacatgcctcagcctcccaaagtgctgggattataggcatgagccaccgtgcccggcctagtttttaatttttataggttttaatttatcttttgttgttgttgtttgtgcttttgtgttgtatctaaaaaagtttgaccagcatggtggctcacatgtgtaatcccagaactttgggaggctgaggtgggcagatcacttcaggtcaggagtttgggaccagcctggccaacatggcaaaactctgtctctactaaaaatacaaaaagaattagccaggtttcgtgctgcatgcctgtaatcccagctacttgggagctgaggcaggagagtcactttaacccaggaagcagaggttgcagtgagctgagattgtgccactgcactccagcctgggcccacagggtgatacatctcaaaataaataagtaaataaataagattaaaaaataaaaaatctgttttcaaagccaaggttatgaagatttactcctcagttttatgggtttgctcctatgttttacctcaaagagttttatggtttagcacttatatttaggtcattgatccactttgagttaacttttgggtgtagtgtgaatttcttgaactttaaacccttgaatgtgtgccaatccagtcagtaatgtttttttttttttaattgagacagagtctcgctttgttgcccaggctggagtgcagtggcgtgatcttggctcactgccaacctctgccacctgggttcaagcgattctcctgtctcagcctcctgagtagctaggactacaagcatgtgccaccacacccaatttttttttttttttttttgacgaagtctcactcttgtcccccagggtggagtgtaaatggggtgatctcggctcactgcaacctctgcctcctgggttcaagtgattctcctgcctcagcctcccgagtagctgggattacaggtgcctgccaccacacccagctaatttttgtatttttagtagagatggggtttcactgtgttgaccaggctggtctggaactcttgacctcaggtgatctgcctgcctcagcctcccaaagtgctgggattacaggtgtgagccactgcgcccggccatttttttgtatttttagtagagacggggtttcgccatgttggccaggctgttctcgaactcctgacctcaggtgatctgtccaccttggcctcccaaagtgctgggattacaggcgtgagccaccactcccagccagtaatgatttttaaatctttaaatcccaatagctatggaaaggtggtttggcaatgttttagtggctgttggctgaagcttctttcaataggggcattttagaagacatttcctcctcctcggatctgatccactgatgtgcatttgataggtttaggggcaactttgagagtaaggccagtgactttcagggatgccagtcagttgagtgacacacccttatgtacgcgtagtgagatgctctgctattggcttgtctgtatctcagcctgtgaggagcagggtgaggcctaattgaaacaaggcacagctggcaggggtgaggggaacaatgtagtcaggtagcaagtctgtactgagcccaggcaggttcccagccctgggtatggcttcctgagaactgtgcaaaaacagtaatgattagtgagaagatcatatggagacagaggccttgatttcaagttggatgacttaagactcgtcacttctctctgaaccttaatgtctttgattacaaaaggtgaatgctgacttcacagggtttctgtttttttttttttttttgagacagggtctggctctgtcggccaggctggagtgcagtgacacgatcttggttcactgcaacctttacctcctgggttcaaacgatcctcccacctcagcttctcaagtagctgggactacaggcgcatgccaccatgtctggataatttttgcattttttgtagagacaggattttgccatgttgcccaggctggtgttgaactcctggactcaaacgatcacctgccttggcctctcaaagtgttgggactgcaggtgtgagccaccgtacccagccttgttttgtttttgaagatgagctgaggttatcagtggaaaagtgatttggaaaccataaaatgagatttgggaatgtaatagagaatcaaggcgaagactaagttttctgggagtttttaaaaagattctttcgtgactgtgattctcagaaaaggtttgaggcttactgactagatagttgattttcaattttttattcaaataattttgcatttgttgtgactctttcttttgcaggtgacggaaatacaattcagacagacttaaccaagagagggactttattgactgagtaactagaaagcctagaagtagttctacttttagacacagctagacacagggaggtaaattatgtcattaggactcactctctccccctttggctctgcttttctttgtactggtgtcattcttaggcaggctttctcccatgtagtggcaaagaaagatatcagatttgggtatgcatcctaacagcttattgaaagatacaacaggcctggcatgttggttcaagcctataattctagcattttgggaggccaaggcaggtggatcacttgagcccaggagtttgagaccagcctgggtaacatgaggaaatcgcatctctacaaaaaatacaaaaattagctgggcgtggtggcttgtacctgtagtcctagctactcaggagacttgtacctgtagtcctagctactcaggagactgagcttgagcctgggaggtcaaggctgcagtgagccaagatcagaccactgcactccagcctgggagacagtcagacactgtctcaaaaaaaaaaagaaagaaagaaagaaagaaagaaagatacaacataatacctctctttcctgatggtgctggtggtcctgggtatgattttggcttgggtcctatgcccatcctaaagtaatcactgtggccaggagaatactggcctttaattggccaacagagttccattctactcatggaacccaggggtcagggtcagcttccctggaaccatgtggatcgagaacaggaaagaggtggttccttaagggaagaagatcaaggtacatttacagaaaggtaggtttgggaggtagggaaatagttttaagtcaacaaaattcgtagatgtttactacataattaagccatttttgttaaaaaaagtgtgtttccaatatttaaaactcaacaaaagtagaattctacttgaagtagatattgccaggagacttggacaggggagggaaggagaggaggagtctatagagcataatttgaaaactgctagacagtttatccattaaatatttgcttgaggtgggatagtgcttgaatcctttctttgcatctttctgacattttataatagagattgtattttccttctaatcagggagagggaggtaagtagcagagccagtcattgtctggggctgaagatgccaaggacttttcttagccccaacaccaaactgtgtttttttgagatggagtttcgctcttactgcccaggctggagtgcaatggtgcgatctcggcttactgcaacctctgcctcccgggttcaagtgattctcctgcctcagcctcccgagtagctgggattacaggcatgcgccaccatgtccagctaattttgtatttttagtagagacggggtttcaccatcttggccaggctggtctcgaactcctgacctcaggtgatccacctgcctctgcctcccaaagtgctgggattacaggtgtgagccaccatgcccagcctgaaactgagttttttttttagaagccatgagtctttcaaatttaaatagtgactcatagagaacaggaagaagttgctttataatgtgttggttaatgtaagtgatgaaatatattcgtatcctaagcatttggcaggggctctatatggtacggtgtataaagctgtgagctggatggattctgtattataaattgagtgaggatgaaagctgccctcacgtactatccagtttaccaggcagccaacaaccattcgattttttaaaaaattgaagtaaaaatcacataacagtttggtggtggtacaggcctgtaatccctgctacttgggatgctgaagtgggaggatccctttagtccaagggttcaagaccagcctggacaacatagcaagaatcagtctgcacaaaaaattaaaaaattagtctggcatggtggcatgcccctttagccctttctactcaggaggctaaggtgagaggattgcttgaacccaggagtttgaggctgcagtaagctatgattgcgccagtgtactctagcctgagtagcagagcaagacccctgtttcttaaaaaaaaaattcacattccataaaacttattattttgaagtgtacaattttttttttttggtagagatggggtcttgccatattacccagactggtttcaaagtcctgccttcaagcagtctttctgcctcagcctcctaaagtgctgtgattacaggcatgagtcattgtgccccgcccaatttggtggttttcaacaattttgtgtaaccgttaccactatctaatttcagaacattttcatcaccctaaaaagaaacactgcacccattaagcagtcacactccctattctctatcctctggcaatcattagtctactttctgtctccatgaatttgcctattctgaacatttcatataaatggaatcatgtctggtttctttcacttagtatgattttaatatatatatttatcttgttacttttctgtgatactttttttgaagtagaattatcccacagacctaccaactggtcattttctctgtccccaagtgtataattgggattgacaaactcagcagttaaagatagcacccatactggatacttgacctgttgaataagaggtgtcatagtgggaaggctaagtggaagccttggaaactaccttctgctctcctggccaagatagtgaaccaaacccaataacaccttctgggacagatggtggagagtagtgctaccctgaagtatctttttttttttattttttttaattttttttttgagatggagccttgttctgtttcccaggctggagtgaaatggtgcagtcttggctcactacagcctccaccttctgggttcaagtgattctcctgcctcagcctcccaagtagctggcattataggcacccgccactacgcatggctaatttttgtatttttagtagagacggggtttcaccatgttgaccaggctggttttgaactcctgacctcaggtaatctgcccaccttggcttcccaaagtgctgggattacagacgtgagccactgcacccgacctacccttaagtatcttaagatgcaaggtggtggtctctatcctatctatatttaattcattagtctgcccctgtaaaactggattgatcagagaatgactggacttcagtaattttgatttagcatccccaaatgtggctgccatgatggatttgatatctttgctagagcaggttatacttcgatatttggccattgatttggcaaacgcattattttctgtttcagtcagaaaaaaggattaaaaactatttgtattcatggggaacatatcagtattcctttatagttttgcctagggatatgtaaacacttctactcttatactgtttgtcataatatagtcaaaagatacctggaccatctggccatagaacatcaccatgatatattacgttgacaacatcatgctaaccagacagcattagcacactggaggccttggtaagatgtgtgtgctccacagtgggtactgtcacattctttgccaaactggatatacttggttttaaaatatgtccacaaattctttgatactctttccatcaaggggtggagtctaattcctctccccttgagctggacctcactttctattctaacaaatagaataaagtgaacatgatagtgtacaacttcagaaatcaggtcataaaaggcactacagtttcctttttgctttctctctgtctcttaaattattcactctgcggaagtcccatcaatatattgtgaggacactcaagaagcatatggaaaaggccatgtggagaactagtgtttcctgacaacaatcagcatggacttgctgggaatgtgagtgagccaccatgaaagcaaatcctccagccccagtcaaaccatcagatggctattggccttttaaaacctaagagaccagagccatagccactcagttaagccacttccttgattcgtaaccctcagaaactgtatgaaataatgtttattgttttaagcaactaaattttgggggtaatttgttatgcaattatagatattaatatacattcctacaagcagaatatgagaattctagttgtctgaccttcttttcaacatctagtatttcccttttttattttagccattctagtgagtgctaacaccactgttatcacattgtggtttaatttgtttttccccagtgactaatgtatagagcatcttttgacatatgtatgaatatctatatagacatatagatatgtatatgtgtatttaatatctggatttattattttggtgattatctggattttattatttgttcaagcctttttgcccagttttccattgggctatctttttcttactgatttgtaggcgttctttatgtatgctggatataagtcctttgtcttatatgtgtattatgaatatcttttctcagtttatcaaccttttcctccatgtgtccttatccctttttgtgccctgtaagaaatctggcctcctgggatcccatctggaaagtgcttagtattctgcctgcttcacaaagggagggaaagcaaacgtggtgaggcaccctttccattccagcttgctcggtagctggtgattggaagacactctgtgacagcgttcagtccctgggcaggaaaacctcctttaaggattcttcttccttaactgggtctgcttctttcctaaagaaaaaaaaaatgagtaataaaaaaaaaaataactctttgcaggccaggtgcggtggctcatgcctgtattcccagcactttgggaggctgaggcgggcggatcacctgaggtcaggagatcgagaccatcctggttaacatggtgaaaccccatctctactaaaaatacaaaaaattagccaggcatggtagcgggcgcctgtggtcccagctactcgggaggctgaggcaggagaatggtgtgaacccgggaggcggagcttgcagtgagcagagatcggcgccactgcactccagcctgggagacagagcgagactccgtctcaaaaaaaaaaaaaaaacaaacactctttgcctattccaagttcataatgatttccccataattttttttatctaaaagttttattgtttcacctttcccgttagatctgcaatccatctgaaattgatatttttgtgtatggtgtgaagtaatgattctaggtacatttttttccttctgtgtataaccaattgatccaacaccatttattgaaaagatcattcctgggccgagcgcagtggctcatggctgtaatcccagcactatgggaggttgaagcaggtggatcacttgaggccaggagtttgagaccagcctgggcaacatgatgaaactctgtctctactaaaaatacaaaaatcatctgtgcatggtggtgtacgcctgtaatcccagctacttgggaggctgaggcatgagaattgcttgaagctgggaggcggaggttgcagtgggctgagatcgtgccactgtactccagcccaggcgacagagtgagaccctatctcaaaaaaaaaaaaaaaaaggtcattctttcctactgtaccataagtgttacctttctcataaggcagatatttgtgggtctgtttccacactctctattctaattgtcatttttgtatcctgcagtagtaccacactgtgctaatttttattttaattattcttgatatttggaagtttaagtttatcaggttgttgttcttcagcagtgcttggctgtccttggtatttctatgtgaattttagaactggtttgtcaacttctgctaagaaaaacccctgttgggattttgattggctttgcattaaatctatagattgggagaactgacaaactatatgtagtctttcaactcatgaacatgatatgttcttccatttattcagtttatttatttatttatttattttttaaattagagtcagggtctcactatgttgcccaggctggtcttgaacttctgggctcaagtgattttcctgccacaggcttgagccaccatgcctggcctatttagaactttaaaattatttttttttttctgtaagtctgtaagttgtcttgtagtggtcttatatatctttttttttcttttctttttttttttttgagatggagtctccctctgtcacccagtctggagtgcagtggcgcaatctcggctcactgcaagctctgcctcccgggttcacaccattctcctgcctcagccttccaagtagctgggactacaggcgcccaccaccacgcccggctaattttttgtatttttagcagaggcggggtttcaccatgttagctaggatggtctcgatctcctgacctcgtgatccacctgccttggtctcccaaagtgctgagattacaggcgtgagccactgtgcctggctttatatatcttttattagtttttttcccccctaagtatttgatgtatttttgatgcaatagtcaatagtattactgtattttaaaggtcttatttttataaaataaacaatttcaatgaagccttgtagtactcaacacttccagctttaatttctttgctgtaatagcttgcttatgaacaattcaggaaagaatttcatgtgcagtgctatttctttaatcttacccataatccttttaaaattccagttgaagcagctactttttcgtggttacacttaagtatttttaaaataaaactttattttctatcattttaaaaaaatcttatttcaactaagaaagtcttatgctatggaggatatttcttctcttgtacatttttcctttactgtcccttgaaagacagttccttttttatttcagaatttaacagaacatagcaaatacccttaactggcacatgaaagaaaacttgtatcttactttctagaaaatacctcatgctccataatttataataatatttgtttttcaaatcttaaacaatatttaatatatattttctaacagtatttgctgacaaaggaatgcagttttaaaaatattgctttccagctggctgcggtggctcacgcctgtaatcccagcactttgggaggccgatgcaggtggatcacaaggtcaatagatcgaaaccatcctggccaacatggtgacaccctgtctctacaaaaactataaaaattagctgggcatggtggcgcacgcctgtagtcccagctactcaggaggctgatgcaggagaatcgcttaaacctgggaggcggaggtttcagtaagccaagattgtgccactgcactccagcctggcgacagagtgagactccatctcaaaacaaacaaacaaacaatacaaacaaaatattgctttctttgtactatttaatccactttattactgcaataagaaagaataaatgttttaccaataatatgttcctgtttttcattattaagcaggacatgtataaagagacttcttagcactggattgaatatctttggactttaaacactacagaaaaattataaaagtttatcttcagatataatttttagatggtttttaatcatgatagctttattttatcattatttaatataatggtcaacaaattatgcctgcttgtataaataaagttttattggaacaaagccacattcatttgattaatgtaatcaataacaatgtaatgtaattgtggctacttttaaactacagtggcagagttaattagttataatagaggctgtaaaatattaactgtctggccctttacatgaaatgttttgctgacatctgatttaatatatcaggcccggtaaagatttagtttattgttaataataaatttaaatccatacagtattctaagtatcttttgataattttgaatttttttgccaacttattgtttgaaccaattagattgttttcgtcctgtaatatagctctcagagagctcatattaggtatagaagggtcagctttgttacttgctatttatttttgtttgtaattttaatattatctttaacctatgggggttgtttttcatattcatttatttatttgcaaacatcccttaagatcatttgtgtggtaaagtttgatttagttgagaaaaaaatataaaccataatttataagtaccctgaaagcaaatgagtgactgcagatactgatgttcttccttgcacactggggagctcccatctctattctcaggaaaactcatatgtggtaagcgataccgaaatacatgacatacagacccagagagggcaccattgttagtcagtacagttaacattggtaaagcataattcttatattttaagattaaaaacaattataaaataagagttttaatttttctttttgtgcttcactggaaagtcttatgcattccactttggagaccactgtcttaatacatactgtttgtgtaaattctttcaaattctgaatgtaggcataatccctgaatataaataaaagtttgtagtatcataataattgagctttaagtccagcaaatactttgtgtggatagtactgccagcagctgcaattagagaatctgtgggctaagcaaagccttactcagatgctttatctgtttttatcctgtgtggacagtcatctctcttccaatagaattttgtatctgcagctaattaaatcaagaatttaaccttaggatggaggatagaggactatgtcttcctgccaataggtaacccaccagaaccactccagtgaggagagctaccaccttagaggcctcaataggtagggatttactttagggagttgacagatgcttaagtatggagtcatacagtctgggctcaaattctgggctcctcctattataagctgtgtattcctaggcaagttcatttaaccactttgtgtctcagtttcctcttatgttaaatagggagaatggcatctaacttttaaggttgctatgaaaaattagttaatccatattaagtgcttggcatactatctagcacatatgaagagctcaatgaatgttaatttttagttaactttctggcggttcagatttggtcagttcacagttcactgagaatatttatctttgagcagactcatattaacctttatttatctttgagcagacttatattaagttcttataaaactacaatgccaatttttaagtctacctcaggaagtagaactgtcacatatactggatgccctatgttgttaatgacctgtacattttctacctctggatggcaccatggaacacaaacatcctaatcacgaaggttatattgaacatagggtctgaattagggacattcattaggtgaatccagtgttttgtgtataatgccaaagtggctgaagtgaatatttattaccctttcctgtgtttaaggaatttctttacctaaaatgccagctacttacttgtaacctttttcgcagtttgccctaggctcttttggtcttagccactcatcatggactttgactctgaagagctgtgatgcaaagaagcagggtgcagtgatggtggtgcaggtagcaaattgagttcctggggcagcagggccggttatattacagtggctagagatagtggaggttggcagtggaagcagaggcatcctgatcagattagttctgctacttagttttaggcgttgttctcggcatcaatccctggtttttcacttctccttgtaagtctgagttactcttttgataagttctttttctcctcaaactagccaaaatcagctgggttgctaaatttgcaatctaagttgttcttgcaactaagaaccctgtggatatagcagctacaatagcctgatgcatttgtcttgcaatacagatagaaaggtcatgggaaagcaaatgaagtatttaaactttgttggcttcttctccccttgtgggtgttaagatcaccctattcccagggcctagatttgtgcctgaaataaagtaagtgcttagtaaaccttttgtggaatgaaagaatgatgggtactgccaatatgtgtctgttactctgctttttctcagctttcatggttgactgatctccctaaggaaggacatattttttctttcgatatgttaatacagatgtaatcctgcgtaacagtccattttttttttttttttgagacagagtctcactttgtcgcccaggctggagtgcagtggtgcaatctcggctcagtgcaacctctgccactcaggttcacgtgattctcctgcttcagcctcctgagtagctgggactgcaggtgtgtgccaccacacccagttaattttttgtatttttagtggagacgaagtttcaccgtgttggccaggctggtcttgaactcctgacctcaggtgatccacccacctcggcctcccaaagtgctgggattacagatgtgagccacaacgctcggctgctattctgttttttaaactcacttggcgtatctttattctgtggattttgtagtttagcccggggatgtgtgtgtgtgtgcgcgtgtgtgcatgtgtatgcatcttatagagccccagaatgctgacaggaatcccttcctggtgtcacaaggcagtctaacatctttcctgggattctggaaggcatctcttgagtcttcctcaaggggcttgttgatggagtaaagaaaagaccatacacccacagaaaatttcatacattcatacacaaatgtagaactgtatttaaaccttctatctgccacctaacaactttatgattcttgttaaattttcttttctttttctttttcctcgagacagactctcactcactctgtagcccaggctggagcacattggagcaatctcggctcactgcagcctccgcctactgggttcaagcaattctcctgcctcagcctcccaaaaagtagctgggattacaggtgcgtgccacaacgcccaggacagggtttcaccatgttggccaggttggtctcgaactcctgatctcaagtgatctgctcgcctcagcctcccaaagtgctgggattacaggcatacatctggccgatgattcttgttaaattttctacagatgtcctgctttgcttttcctatgatggtatgctaagattgggaaaggcaggagatacaggtccttttttacttcctttttatgttaaagcaggtgaacttctgctctagatttgtgtgttaaggagctgtgggaactggcagttagtaccccacattctggttccatgaagtcatttgcttgcatttacggagccccttgctgtatgctatgagataatggcattctgaggctggaggtgccaggattttgagagattggaatggcttgttgccagtttattattgcctctctcctggtggagtggctgaagctagtgccaagggtagtacacctgggatccctgtctttttgtttctagaacacagtgctttagacttgggcttataaatcagagctgggactttgagaagatttgtgagcaagttcatcaagatattggggtcatctggcctagtcttcttgagtttcacatgtagaaacaagcctagagaatactgtaacacaaagttagaagggttgaggagggcgagggaagggtcaacaccttaccgctgatcgctttgctttactcctgcattttttgttcagagtggaccccgttctgcaatcgttggtctgaaattcaacccagtcctaaattgcatgtctcgggccacaggttaccaagtttacagacaacagtcctgtgcctctctggacacgtgactggtctattaatagatctgaagttctgggagagcctcagctcttcccccacctttctacttccagcagcctgcttgctggtaatttcttcagtgcccggacaactggacagagaatggaaacagggcaatctgcccatccccttttaggaggtaatgcaggcccaggtgtatatatatgagtagcctctggcctcatgggtgtctgtgctgcatcaggtcaagtggaaatgcttagcatttaggaggaagtaattccagtttgccctggatgggattgaaaaaaaacccaaacatgtatttgaccttcactatatgtaaggcactgtactaggcactttgcatgtgtttaccacaatcttccctgaaccttgtgagatagatattctcattttacagaggagatgactaaaactcaggaagattgacttagtaacctaatgttacacagctggcaagactaaaatccaggccttctgactttgtctttcgaaaatgacagcttccctgtttataactttctatagtaaaattgggctaggataatttaaccatgctatctttggggacacttgtattattgaattatctcatatagctcaggaaaatgggggcaaacatgaagggaggggaataaggcctatcaggctgtgggcaacaaagggagctcagtgtagcaggatggtgcctactgtacaggtccatgtgaccttagtgaacccaagtcagatagtggctgtcctgcaggttaatcaaccatatttcttagcttggcgtacaaggcattcagaattagggttcctgcttcatcccattttatctcttcctacttcctatcatacaaattgtttttcattctattgtttgccagatctgctgtcatcttccatgcatgggcatttggaggctctattaaggttctagtaaaaaagtaactgtggctaccttagggccgagcagacagttttgaatctccatttactccagaatcattttgggctggagctctgtcattcattcatgtattcaatcattcttttaacatacaggacactgcctctctgccaggtactgtactaggccctgctaatcagaataatgaacaagatagatatggttcctgctctcctagagcttgcagtgtagtagggaaggcaaaaatgaacaaaataatcataatgaagtctgatgaatgtcatgaagtgcaaataagggatgtgatgggagggtgcatatatcagaggaacttaatattgtttagggtgttaggaaagacctgacattagctgaggaggtgacatttaagttggatctgaaaattgagagaaaataagtaagggttaagaaaggtaatgctaggcagctggaagagtatgcaaaggcttacaggccaggcaataaggataaagccatgtccatgtcagttcatttattcagcaatcatttacaactgctgggttatatcatgcagtgtgctaggttctgggaacataaaaaacaataagacgtggtccttacctgccctggataaactcagtaaggagtagtgatgtcactccttggtaaccagggtgctaagttcaccctagatcttggactcagttttttgggtcccatgtgataggacttaacacctttagaaaaactgcctgcccttgagtgtttggtccatctgtcaagccgacaggacatggacctcagatgaaaacctgcagtgttcttatccctggcttcacacttaccagatccatgataaatggggatctgctatagactgaatgtttgtgtccctctacatttcatacattaaaatcctaacccctaatgtgatggtattaggaggttgtagggtaaatggacctgagagcaataacaagcattcccttagaatgacactgtatggcagacacacctgaatgcatgttccaagctagggaatctgggagtggccaatccagagatttcgttccttttctataagtaatatctgagccctagcctaccctgtggaacacgggccatacaggggattgaggccctgggttttgagttgaatgaaggctgccagatgaggccattaagaggagggtgttaagtgaaaatgctatgtaaattgcacgctgtttacaagcggttgcgattttcctgcccggcctgttgctcctgggctgtgtggttttcctgtccagcctgctgcgactggactgtatgtaaggcagataccttgttcagcccgccactactggaccatatctgtacataaggcagttctcttgtccagcccaccaccactggactctcttccgtgtatgtaagcccctaataaaaccctgtgtcttgtttgctggctctaggtctcttctttggcctcttaaacctgctgccttccctatggaagttaacagggtttggtacaacagacacagggcctttggtgggtgattaggtcattaggacagagccctcttgaatggaattagtgcccttagaaaagagaccccagagggctgggtgtggtggctcacgcctgtaatcccagcactttgggaggctgaggcgggtggatcacgaggtcaggagatcgagaccatcagggttaacagagtgaagccccgtctctattaaaattacaaaaaatcagccgggcgtggtggcgggcacctgtagtcccagctacttgggagtctgaggcaggagaatggcatgaatccaggaggtggagcttgcagtaagccgagatcgctccactgcactccagcctgggcaagagtgcaagactctgtctcaaaggaaaaaaaaaaaaaaaaaaaagaaaagaaaagagaccctagagatctctcttgccccttctgcagtgggaggacacagaaaggagacagccatctatgaaccagtaagcgggccctcgccagacactgaatctgctggcaccttggtcttggacttcctagcctctagaattgtgaaaaatgagtttgttgtttaagctgccctgtctatggtatttttgtcatagcagcttgaatggactaagacaggctcctctacagagttgaggttattggggtccagagattggcttttgtccccagtagaaaacatagaaggagctttttggctgaggtgaagttgcctctgttttcagagctttgtgtccttggtgtctcatatttattacaattgatcatgtgttctcacacccatccattgtcttgagtacacctaaggtggtattttagctgtgtttttctggattctgatactgcttatagacaaaagtcttagcggctggctatcttggactgtaaattgcctaagtcctaggtgtgttgttcacatgggctgtgttgtgaatgggaccacgtttccccaattgtgcaacagtgcaacattgtggccctggttaaagggaagggaagttaggttattgaaacatggactgtgtgcctcaggctgtgtgatttgtattctttatttcatttaatactccctgtaatgctctaaagtaagtacttttattctaatttacagatgaggagactgaagtttagtgaactaagtaaacaagtaagtagtggtttggggttagagtttaggtccaactctaaagtccatgtttccctctctcatccagctgtttcccaatgtagttacagacttcagatcttgcatgtcatcttgtttccatggcctctttggccttgtctaccttgacttatttgccttgcctccctgtgtcagtaatctaaggattctcaacatggctgaggctcaggaatatatcctgtttggtagataacctagagtctctctctcttccccgccgcccgccgtctacaatgtatttttgtgtctaatgtgaggcaacattataactataattggagtcatttttaaagagtaagttagctctaaatttggtgggctgcttttcttaatccagttcccacagcattctcaggaagacggaagatggggatggctcattagaaatgagtttgaatgaaaaaggcattggggcttggcttgagtggtggaaagagcctccctcagcctttctaaattgcgtggctactgaagttggttggatctttgtaagttagtacttaatgtcccttttccagggacctaagattctcttttctctctttcccgtagaagccctgcctcatcatctggagattctggagctactgacattagagtggagagacttttttctttcacagagttgtcagggttgtgtacggggtgggagaggggtctgtgtataaggcagaatccagggaatggtggaagaggaagtgtaacatgtttttgtgtcttcaatagcttttcagcactctttttttttttcctcctcttttcttctggagactttgcagtctcatttgagaagtggggtcccaaataaaacaaggctgctacactcacccatcttgtgttccaactctgcttccttttcctgaaggctgacaggctttttcatatcttgagtctttgtaccttctgttccctcatccttgaaggcccagtttgatctcttctctctggaggttgtcatgcccactttgtgcctccatagcactttgtacagccttttatatagtcttattcacttagctgtctgcttcactctccacatcttgaacctcttaagagcaagaggctgagttagtttcacctctctttagcaagcacagggtatgagggagactagagtctcaaaaattgtagaattgaacaattcaattcattacatcagtaccttggtacactgatgcccaaatcaaaagtagatgattgtgtacaactatcttgtgtacttccataaactaaataagtttctcttccataattcactgttttgtgtatctcccaggcccatagcccttcaaacatgcagtgcagtagctgactttgagagagaacagagcacagatgttatctttgcctgctttgcccttcacctcacagtgctcttctaagtccctgggcttgacccaaggaatgagtagggaggaaatgccagaaatgagccacccttggcatcctaactccttggtttgcaggtttggccctgtggggcagtgcaaggtgagcaaatggaaaagaacctgttccctgtaatagcagctgaaagggatctctacagattattactgtcatcttttcgcagctgcagttgcagcaatgagacactcccctcattgcattctgcatctaagacaaaatcaattcatcttttaaattggctctcttggcttgtcctgagatttctcatagggctgagagcctgaaacaagtcatcttacccgtgtttttctaccattgtaaggccaaagactgtgagattgtgtacccttagcccttcattttatacatggggaaactgaggcccaccatgggcataggactagttcaaggttgggtgactagtgtcaggtgaggctagacactggtcttccaactccctgcaaggtgctctcttcattataccctgctgtctctgatatcagtttatgtttgtaatgcctgtagattgtgaagttggtgaggctgaagtaaccaggaaacctggtttcttttctttctgtcaccttcctagtttctggacatcagggcacagtagacattctgggaagacttagtgaaggagtaaataaaaaacaaagttggcccaggaaaactgcatggtctaagccagaagaagactaacgaaagcagattcctcccagtttcactggacatctttggctttgatgatgattcctgtggttcgattttcccagtgttaaatgcaaccttggctggagcgtggaagaagtatggattgtaactatggtattttatctggtgaaaaccaggtctgtaattaaatgtctgtgaaaataccacacctgggctaactgaggatgcctttgagtcttcagatgcctcccttattccctagcagcaatcacaagacagagattgtgtgcatcattgagaactaactacattatacataggtaacatttattgaatgcttactaagttttctggaactttttgaggtatttacaattcttttaatcttcacaatcatccatgagtagttactataattcttttaacttttcaaatggactttattgagatataatttacatataatatactcattttaagtgctcagttcgagttctgacaaatgtagtatatgcctgcgtaacctctcccctacaatcaagatatagaacattttcatcagtaggtacttttgttatccttattctacaaagaggaaaactgaaagacagagaagttaagtgacttgtgtggggccccatggtaatagaaccagcatttgaatccatgctgtgtgactgcagagtccacattcttctgagctgtgctacctttcatctctcaatttgtggtcaagccattgcctctcttgtcctagtggacaagtgcattaaggactaagatgacatagacttacaatctaagcactaggaggggtgttggggagcaagaggcccagagataggcagtggggaggaatgagatagccatctcagtacccctacagttccaggacccaaagaaggcagaacaacgtgccttttgctcagcctttgcttctccaggcctgcaaagaatagggtagactagagagtcttataataaggttaccagtatgatatagtatctgaaaaaaggacggctcctaggctcacataactggaatagaaacatagaaaatgagaagagatgatagtctcatatgttctgagagtgaccttagtagtggctgcagcccattctggacttggcactatagaggcaacatagatagtctggagatggagagtggccttgaaatccaatcctttgaggagaggttgaaggagccaagactggatgccctgaagtgaaaatgtaatcactggcttcatatccttgaaaggctgttctttggcagagaaaaccaacttgtttttctttgtggcttcagaaggggtaattagaacccaatgggtgggatggtgtagagtattttggaaaaattaaagtacagtgaatatgacatatctcatatctcattagcttggagtacaaataagatcagatcttttttcaatattaaaattaatctctgcagctgggtgcagtggaccacgtctgtaatcccatcactttgggaggccgaggagtccaggagttgaagaccagcctgggtgacatggcaaaaccccatctctacaaaaaatacaaaaattagctgggtgtgatggcatgcatctgtagtcctagctacttggaaggctgaggtgggaggaccacctgagcctaggaggcagaagttgcagtgagccgagatgacaccactgcactccattctgggcaacagagcgagacttcatctcaataataataataataataataataataaaatatctggaatgagtgtgaaattatctggaaatttaatatgtttcccttggggctgttcttcttccctctttctctttatgaagtattcaaaaactctaagggcttattcaatccaaaggggtcaggcttagttccaagtagagaactaaagaatcttattggcctgctagcgggccccatttttagcttctgttggtgttgcacagtatggcttttaaaaatggatctttcacagaatgtggtttctgtatttactgtagccacaagaacctgattctccataagtcacagtggttcattgagggaggatgatggcagtccttcaatgtcactcttagtcccagggttcactctgcttgagctctcaaggtgaatgctcaagtttatatgtatataagctcatccactggaggaggaaacctccacaattttccatttggctaagtctagaagtgtttctagcttccaccacattctagctccagaaccttctctcatgatcacttttgttatagagcttgggacatcccttcagcatgagctcttactgttggctgttggtgtccccccctacctttaacttcacctaggatcttgagtctgttagagaaattctttttttttttttttgagatggagtcttgctttgttgcccaggctgcaatgtagtggggcgatcttggctcactgcaacctccgcctcctgggttcaagcgattctcttgcttcagcctcccgagtagctgggtttacaggtgcccaccaccacacccagctaatttatttttgtatttttagtagagacagggttttgccatgttggtcaggctggtctcgaactactgacctcaagtgatccacctgccttggccccccaaagtgctgggattacaggcatgagccaccgcgcccggcctgttagagaaattctaatagcattgaacttcagaagtaaggggagtcaaagtttcagtctctccctaggagagctttagaccctatgcatatttgttttcattttcttcagctttgcataccaaggggtgttgagaacagtctttgccaagtcacaaaatatcctgttgtatccttttccccaagagcaatgtgtgctcatttgctttatgttttatcattaaaacagggctcctcaagagtgagggtctgtcccagaatgatttaatgtttctaaacattaaaagggactgacaggagggactgacagttttaaaatgacagtttaaggctgggcacatggttcacacctgtaatcccagcactttgggaggctgaggtgggcacatcacctgaggtcaggagtttgagaccagcctggccaacatggagaagccctgtctctactaaaaatataaaaatgagcctggtgtggtggcacatacttgtaatcccagctactcagaaggccgaggcaggagaattgcttgaacccgggaggcagaggttgcagtgagccgaggtagcaccactgcgctccagcctgggtgacagggcacgactgtcccaaaaaaagacagtttaagaccatcatccagaatgagcagggttatcattagaagatgtgagaaggggcaagtggccatgcagtctgaaccagtatcttgaaacccctttctcctaggagggactcttactaattttctccactactgccatactagcttcagcaaggtactgttctccctttatgtttggccccaagttgggcaaagaacttttctgtatgacatataactgagccctatataaaatatttagacaagaattttctaaaaactaagggatagcaatagaattgagactagatagactagcttataaaatgctgcttgatctctggggctatcagaggatatacacttagacagtaccatcatgattatctggttatgatggaagagagaggagagaggtgtgacttctaaagatccttctggctctgagattctgtgattcttctaggcttttccaaactgaaaattctagaactgactttgttctgtgattcttgcaaatcttacaggcccaacagtggggtcaggaaagtaggtgactatgacatagttgaggttaccactgatctcatttctgcatttctcccaaccactgcattccacttaggccagagaaatacagatgtaaaatacagccttttaaatgtatgttttaccacaattaaaaaaatacagcttttttatttgtccacaatgttagtctatcctttctcatttgaccctcccaataccttgtgatataggcaagaaagtacttattaagtcattttagagatgaagaaattgagattcagagaagttaaataatttacctgtccagattacacactagatcaactggtatcctcagtgctcttaataaatatttgttaaataaatgaatgaatcagaacatagaactaggaacaaggaagattctttgtttccttggccagtatttttctttccctattcttctgagctgcctgggggctttctctgagcaccttttgggttggctgtttttggttgaccttctctttgggattcccttgttctgtagctgaagctgtgtgcactcgttagagatcatcattccagttgtgttccctaaggagtgggaagggaaaaaacactccacccactgtaaatctttttttgttacttgttttctgggatcttcatatcattgctgacaagagtgactcatagacttcactatgtgattttcttggttaagagacctttttccttaactccagaagaaattaattcatggttttgtatggttaaagcacagctatttagtagctttacccagaacacaacagttccgtcttctagtgagcccagacttaccaatttggtttggccaaaactcttgaatgcctagctctgttaggtgctacagaggaagccgttggtgtgaggggaggagaggggctcactcagggtccagttggggagataagacacatacataaatgggaaaatagtttgaggcagtttaaataaaatgcaaaatcaaattgtatacatgtaaatatttaaatgtggggaatagatcataaggggctgagaaggtatagcagaaagagtgtatgctttagaactgtaggccattggcaagttaacataattctctgaactactttttccttttctgtaaaatggggataataacagcagactcacagggttgtgaggaataatgaggtgatgtgtgtaaagcaccaacatagtggctgatgcatcatggtaggcatcgaactattgggaagcagcatacccccatgcactgactgcctcccctacgaccctttcaaggagccatcctggaggacctaaactggaaaggttggttagcatttggagaaagagaaaaggggggatggcaagccatgaatgaaggaacaggtcccacagagaatgtcaatctagggggagtggaggatacatggaagaagcagtggagtaaaattaaagaaacagagaagtttggactttatttaaaagagatgtttttataggaagtgtttttatgccatatgcatatatttatatttatagaaaggcctttcttgtactcttcagtgtagtgtagtagctaagagcttggactctagagccagactgcctgtctctatatgccaccacttagtttacttctctgtgcctcagtttcttgagctgagaaatggagatgttgataatgatacctcatagggttgttgtgaggatgaatgaggtaacaaatataaagtgcttagaatagtacctgacacatgtgaggtgctataatttttattgttattatttaaatgaaacaaaacttttacaaaagagtacatgcctctactaatgaactctgataattaaacagaacaaaaatggtccactgactgagggattgatatctacagttcgaagacttctgctgtaggtaatgaagatccatgaaagtggtaagcaaggtgaggcctgcataaagtgatattaaacaaaacagatctgactgggaggtgcaggatgaattagaggaaagagagttggcaatgggctcttgagatagggtgtgtccatgttaaatcacctaacagtacaaaacatttgttatatttgaaagtaattcttggtagggttaagcagtagatgtgtaggacttgggcagccttgtcaaataacgtgagttctggtgaaaggaatgcagcagtgttgtagcaaatagtattgccatagaagaagcatatatatgtgtgtgtgtgtgtgtgtgtgtgtgtgtatacatatatatatatagagagatagtgtgtgtgtatacatatatatatatatatatatagagagagagagagagagagagagtgtgtgtgtgtctcagtgtcactgtgttgcccaggctagagtgcaatggtatgatcatggctcactgcagtcttgacctcctgggctaaagcaatcctcccacctcagcctcctgagtacctgggactacaggtatgaaccatcacacccagctaattttttatttttgtagagagagggtcttatgttgttgtacagactggtcttgaactcctggagtcaagcagccctcctgcctctgcctccgaaagttctgggattatagtcaggagccaccaagtcctgtctgtacatatttttgagtatataaaatgatcaaaaataggctttaattacatctcaattaaaaaatgttcaaataaaaatagagtgatcactgatgactgtaaaaggcaggaagatctcattagaggaggcagtacttggattgggtttgaaggtagggtagaatttgatcattggtgagcactgcatggaggtaagaatggatatggtgtgtgatcgagttagtagccaaaccaggacttcaacctggtctgtctactccaatgagctgtgcagagaagcactaatggccatataatacctagaccacttatagcaggcagtctcactatgcatagcctccatttcctgggcagagtggtctgaggtgcctggatgacacattttcagcttccttgtaaacttgtaagtcccataagggccaggctgatctggcatttggggtagtgttgagggtgggaaggaaccatagacagttgccctcttccatttggatgtgcctcaggagagttcctgagaacctaccctatccttctttgtagtgctgcctgtgctgtgggcctagagtgggcctagctggaacatgggtttggtgatggaccggtaggtggcagggactactggattttggatttcctctcaatgaactgtggtttcgtatgggttgtttgctttgctctctgtttatacagcattaaaggacttttatctttatctttggccagctgaaggttaaaacctccaaagtttgcatttgaactggatcatttctcattttggctggctttaagtctcatgtcttaaggccatttgtggtaccagcagacctctttatgaggtaatgtgttcctggttgctttgggggctagtgtgcaaggcaggaagtaagtgtttgagagcaaggtagagaaacctcttgtagagtctcaagctaatgcttagagctttttgagtgcagagtagttaggttctttacagagttagatggactttgcctggaacagacaccccagaaggatgttatcattgttaaagcaaccagggttatatcatttcttttaccccaaggcaactcttctgctaggagcctgggaccctctagtctgctcttagagagcttgccagctgtgtctgtgcatgctcagccttctgccatctagatgttttgtatttcctaaggccaagctctgagggcatcttctttgggaagcctttccttgactcctaggaaagaattagtcaacttgcttccacagaacctggtatatcctgtgattgtagatatttcctagtagaaaatggggactactcacatgataagattgccacatgctatctaaatattacatggccatttaaggagtgcttttctgcatcgttaactggaatagagaaactgggttgaagtcctggtttggctggtaacttgatgacacaccatacctattcttacctccatgcaatgcctcttaattacctgtcttcttcaccagacaataaagactgtaagctggtaaactttttttgttttttcttctggtaaagctattgtgctttaataaaaaaagattattgctcaatataggtttttccaagagagccacagtccagttcacagttaaaaaaaacatcttctaggtcgggtgcagtggctcacgcctgtaaccccagcatgttgggaggccgaggtgggaggatcacttgagcccaggagtttgaggctagcctgggcaacaggagagactctgtctctgcaaaacacaaaaaccaaccaaacaaaaaattatcctagaatagatggaaaatcatactaaggaacaaagacaactttcctttcatttttcctttgcatatcttacacagtcatatcactatgacttaaagaaaacaaattatcacgtatatacacagattcacataagtgacagaagcaaatgtattagtcaaaggatatcttcatctatattgaagtacaagctagaaagtaaacttcttgaaggcagagattttttttttaagttgtgtggctctaccacctaacataggttatgtacagaatagacatcaatagtgaatgaacagatgaattagttaatgagttaatgatggatttttagcacattttctctcttttttaggaacttaagaccccaactgagttgtttagaggaaggggccttaggctggggccaaattctatgtcttctatgcagacgtgagataatgtgaaatgttttccttttacagggtgtttcccctggcttttcagcattcttctcaattctttaattgccatttaaagatttgtatgctgtggatgagctgatggaggggaatgtttccctgaggacatggcttctcatggcagccaaggttttgtgcctgattaactcgctgattgaatcactggcctctggaggcaccaagggagggagcatgagtatatttaagcagccagaactctctgtgcctgtgtagtgggagtggagggggaagtgggatgggagtgatggtaagttgaaaagagaatggtcagagaaatctacagtttttaactcttcatcaatactatgttttggattttccttttgtgacagagtagtctagtagaaagagcacaatttaagtaagagactttcttctgtcaccaactcactgtgccacctaggacaaatcactgccgccatgtgggcctcatttgtcaagtgggatcaggaatctctgctctgcctgactccttgaattgtagtgagcatcggtgagctgttggatgacagagctctgcacagtagaggtgatggtaccctaatcagagcaggagtgtagtgactctggtcatcatcccatcatttcttgctagggttttcctatctctagaggaatcagctactaaagcctagtcctcaatgctcaatttcatctttctgttctttcctgtctttatctagtgactcctcattatataatacgggtgacccagttgtcccagcaaggcccctccatattctctgacttccctctatcacagtactcaccaggctgtcttaccattgtttgtttggaggtagctattaggagtataggctttggagtcaagctgcctgggtttgaatccttacttttacaacttactggctatgtgctcttgagcaagttacttatctctctgtgccttagtttcctatctataaaatgaagagaataatggcaactgcctcactggcagttattgtgagaatttaaataaggcagtatatatggagagtggagactagtgcctggcatatggtaagcattcaaaaatgttgtgtaggctgggcatggtggctcacgcctgtaatcccagcactttgggaggctgaggcgggtggatcacctgcggtcaagagtttgagatcagcctggccaacatggtgaaacacaatctttactaaaaataaaaaaataaaaaaaaaaagaaaagaaaattagctggacatggtggtgcacacctgtaattccagctactcgggaggctgaggtaggagaatcacttgaacccgggaggcggaggttgcagtgagccgagattgcaccactgcactccagcctgggcgacacagtaagactctgtctcaaaaaaaataatgttgtgtattattataataatcattattgcttaacttcttccctgattgaaactctgttaggccagggaccatgtctattttattattatatctatagttcttagcacaggtgtattagccattcttgcattgttataaagaaatacctgaggctgggtaatttataaagaaaagaggtttaattggctcacagttctgcaggctttacaggaagcatggtgctggcaactgcttagcttctagggaagcctcagaaagcttacagtcatggtgaaaggcaaagatggagcagacacttaacatggtaaaagcaagagcaagatagagagtgggtggggagagatgccatacactctaaaccagatcttgtgagaactatcatgaagacagcatcaagccaggagggatccgcccccatgacccacacacctcccaccaggctccacctccggcataggtgagtacaattcaacatgaaatttgggtagggatgaatatcccaactatatcaatggggttggaacagcaggcgctggataggaatttcttgaataatagtatacatttgaatgctgaattttccttatacaatactaattttatgatcatgagcaagagacttgccctctctacaccccagttttcatatctgttaaatgggaatcaaaatatttgtcctgtaggcctgatgtgagaattaaattaatatgaaatgccaggaagtgtgtaaatgtcattcgtctccatacctgttggctgtgtgcatgtggaacccaagaatctgctggttcctatagtacccctatagtgagctaaacccagagatgcttctgaggtgatgttttctggatatttggcctaggacaaagaaagtagcatactttgagattattcttagcatttctggccttttctatctgcctgccctgcttgttcttcgttggattctaggttcctaaaaataaccagaatatttttctgcctcttagttttccaagtgtcttaagcaatcagaagcattttaattttggctcctttaggctggccctgtttggttctgtcattgttagccattaccatatcctgcttatattatgtttcctgacctgctatactttttccagggccaaaacactacccacatcgctccaggtaaataactttatttggctcactctaaccagttgggaagcacagtggcccatgaggttagaagccttgagttccagtgctggctctgccactgtgtgactgtgtgacattgggcatagccctttccctctctgtgtctcaggctgtcatcattaaaatgaatgatttgaaccaactcagtgctttgtaagagtccttaagttctgtatttgagtttggacaaatcacttctcttttgggggggtcttagtttcctcatctgtaaaactaagtatgttggcttgaataatttacaaaggcatatataaacctgaatattttctcctcattcttagtgtttttttttttttttctttctgccttgtattactttctggaacatttctgtgacagttaacagctgtggacaggaaacccttgaacacttctaacttggcaaatgttgctgctcctctgaacctcatcccagcccatttcctgtgtttacagcttttgggttttgcacttagtgacaggcctgacaggtcatattgtagttttctcttcatagcctggtacagggtagaccaaagtgagcaccaatttgagtgtcagaagacagagtttcagtctctgctcagctgtatgaccttatggaagtgacctcccttctcagggttcaatttcctcctctctggagccagaaagttttaacgagggaggctttctggctctgatgttgaatatatgtctcttgtttattactgctgacgggggccctctgtttcacctgttttttccacatactccatcctacaagagacacagcaggctacctttgcatttcctatattggacaaaataagaggaagaaaggaagccaaacagctctcccaggctcagttggcagcagagaggagttgaggtgagaagctggtgtcaccgaattgcccagtaaatcagctgtgtggttggtaaccaggtaggcacctgtatgcatttattcttatcaaggctctggagacagactgtatcctacttccagacctactttcaccatatatgtgaccttggggaagtcacttattgtatctgggcttcagttttctcattttttattgaggataataaaagtactgactttacaaagtttcaaagagacaacgtatgtagaagtgatcaacatagttcctgacatgttcatcctccctttctcccttagacagttaacagtattcttaattctgttcttgtggagaaagcaaaaagacactcaagttccattctagaggagctaacaggccacatgagaacagaatacagttaggtttagaagagctcttatgaggtggtccgttggccagtgtaggctcaatactctgacctcaaaatgggagacttatagggcgcggagtagttaaagaaggcatcccagggccttccctgggccttgaaggttcagaaagtattagacatgaaaagctagagagagaataattctaggtacctatctaccctttctcaagctctggtgctttgttttgtataggtcagtttcccatatatctccctttctcttcttctaggtggttattatccaaggggcttatcttttctttttttaatatataagagaaaaaaattaagggatgaggagaacctaatatttattaagaacaagctagttttacttgaatctgtaggctatgtagtttgcttgcataatcttacttatttagaaaaatacattattatgccgtattttacagatgaaaaaatagtgcctccaaaaggttagacaacttttctagctctacaataacaaattatgatgacaaatcaaaggagccctacgtgagccagtttagaagacatgtataagcaggtgtcagttgtgcttattcattccaagttctcaatctataatagtctggttctttttacacttatcttctaaatacgtctatcttattcctagttccaacctgtactcacctcctgctcttagcagttattcccaatcctctaaatctccagttctaccattaatttagattgtaccttcctgccccaaccttagatcccttaattctcttctcaaatatttaccaagcatctactatatgccaggctagacacgaatgcaaataccaatttctgcttagatatttcagtgtactagttagacaattacaacaaaaataacatggtaataattgaacacttactatgtgccatgctctatttgaagtactttatatgtattaactcatttaattctcacaaccctatgaggtggatactgttttctccttattttacagatagaaatgtaggcatagagaatttaagtaattggtccaaattgtgatacagagaagcacagggactataagagcacagaagagggactcctaatcaaaccccgggggtcagtatagagaaggctcctagagaaattagaaaaagcctgagtagaatcttgaaacctgagtatgaattagtcaggtgcagaatggggcaaggatattgcgggcagagggaacatcatgtacaaagccacaaagtgagccttgcatatttatggaactgaaagtaatttagtatggtgggagtgtagggtatatgtgagctggtgagtggcaggagataaggctagaaaatgctatagagacagcctcttgaaaaagtcttgcatgcttttctaaattatattcattgcaaaggccaagtattcccagtcttggggatttgaatccctgaaaggggtccttgaggggtgtctcatgaatccatattatttcctcagtcatttttcaaccagtggttagtaaaagcacacctatcattacatggagctctttggaattcctcactgaaaaaagttaggcatcactgttaagggagtttgggaaccctgtgaaggattttttaaattaaaatttttattgagatgattatagatttacatggagtcctaagaaataatatggagagatcactggaaaactttgcagtttcctccatggtaacattttggacaagctgtagtatatcatggccaggatattgacattgacattgataaaatccaccaatcttgttcagatttcccagttttacttgtactcatctatgtgtataaagttctattccaacaccacaaagatccttcctattcttttataaccactcccgtctcctttcaaccccattcctcattcctaatctctctctgccttccatttctagaattttatcctttcaaaaatgttacataaatggaatcacagagtatataaccttttggaattggcttctttcttttttttcttttctcagttcagttccttggaaactcatccaagttgtgtgtatcaataggtcattcatttttttttttttttttgagacagagtcttgctctgttgcccaggctggagtggagtggtgcgatctgggctcactgcaacctccacctcctgggttcaagcgattctcctgcctcagcctcctgagtagctgggattacagacatgcaccaccacgcctggctaatttttgtatttttagcagagacggggtttcaccatgttggtcaggctggtcttgaactcctgacctcaagatctgcccgcctcggcctcccaaagtgctgggattataggcatgagccactgtgcctggctgggcattcctttttattgctgagtcatgtaccattgtacataagtactggagtttaaccattcacttgttgaagaatatatgggctgcttccagttttgggtattacaaataaagcttctgtgagcatttatgtacaggtttttgtgtgggcctgtgaaggattttattcagagggctatctagtcagatttgaattttattttatttttttgagagaaggtctcgctctgtcacctgggctggagtgcagtagtacgatcatagtttactgcaacttcaaactgctgggctcaagggatcttcctgcctcagcctcctgagcagctgggactacaagtgcatgacaccatacccagctaatttttaaatttttattttgtagagacaggatcttgctttgttgcccaggctgatcttgaactcctagctcaagtgatcctccgcctcagtctctcaaagtattgggattacaggcatgagccactgtgcctggcccagatttgaattttagaaaaattgtactcactgcttggtagaggatgagtttgaaagaaactagaacagagacagggcgaatagtgaggaaactgttgtaacccaggcaagagatgtagaagcctgaactgctttggcatagaggtatcgccctcagaaatcagatcaggcttgtgcagaggagggagcagggctatggagcctgggctgccaggaggctcaggtagacttcattctggatagtctcctttcagggaggacactctgctaccccagctgagaaaggcatcctgtaaggaagggctgctcttcagctgcaggaagagagtcagaacctggttcctagaatgatcatcttgactgcaacattgtttagtagatgctgttggttatcttctcccaagaaaagacaaagaggggccagttatctttcttttattgtctgagtggagggttatatggggcagaaagataatgagaagctctctcttagttcatgtctcttttggagcccaggaatgtgttctcttttaaccagccagcaagaggcctgggaggtttcagtctgtcctcttgttactatggaaactggaatccacattgtttttaccccatgcagtggtgtgcctggttcctcagtgtttatattttcaaggcgtttatcattgtgcacttagagccgctgtgattgggactgattgttgggaaccagccttactgattgaacccagaagggtataatcttagagggtccactgataggttggacatgccccctaggtgttgtcctttatctgggtaagtccttgggtgcccactccaacactttcagcaaacttttcccagcagaaagccatttgaggtgtctgtaattatttttttggctatctcagaccctgatgagtgctggctagggcacaagaacgtttgggtcaggcgccagtcagataatttggggtagcttttgaacaagtgtgtgttggtttaattcttctggggccgtctttcttcttggaagctttagtatataaagacctgtggtatgtgggactccaaacctgggatagcaaatcttcaaaatcagtatgcacctttcagttgtctctagaccagatattgtgctgcccagcactgggctagacacaggggaataccagaagaatcaaagactctctttgctattgttgggaaggtaagacttcagggccaggctcagtggctcatgcctgtaatcccagcactttgggaggccgaagtggtggattgcttgagcccaggggttcaagaccagactgggcaacatagtgaaacctcatctctacaaaaaatacaaaaattagccgagcacagtggtgcatgcctgtggtctcagctatttgggaggctgagcctgggaggtggaagctgcagtgagccatgatcttgccactgcagtccagcctgggtgacagagtgagaccctgtctcataaataaataaataaataaaataaagtcttccaggttaagcagagagtagaaaactgatggatgaacaactaacatttgtatagagctttactatttttcaaaagacttgactgattttttcaggtaagaacattaatccttaggagtagtcaatgtataggaaagttggaattcaaagacccatatttgctacctctgcaattcaatacatatttcaataattagggattggggaaaaaggggatcctggaggccagagaaatgtgtgttattgtttgatttcccagtgcctttgcctagttcagctagttcagtcatcagcaaaagctgcttgaaagtgttaaataagtgttgaaatgggtattccagcatgtgaacactgatctgggagtcagtcagacactttcaattcagtcaggaaggtcatagaaacaaaagggcaggcaaataggctgtctaccaggagtctgaagccctatgggaaaccaaggagtgggcaaagggtatcataacagttggacagctcctgcatcagaagcccatgttattgaggtcaaggcctgcttggtggtgactagctgtagggattagccattttcttctggaaggaggcttcttgtgagatcaaaatttgaagaaaagaatgcttagaggaggaggaaggtagaaatgggacacagaaggagtagctgagtgcaccctggaggagagatagccagagacttctcttctagaagatgattaggtttagcagaagcatattctttttccctttttgctcctcccagcatggtgtaccagagactcagttcttctctagtgattcttaaactttatatttaagttctaatgagaaagaggtttttggctagtttgtttcaggaggttgaacactaaagaatttaaggcaaagcaaggatgttctattttaccctgtttggggaatggttcaagcccagatggagtttcttgtatttgtcattaatagacaaaaaacccctgatggaagccctgcttcctcaccccacagcccttgctttgttgccttggaaagtaagagttagtaatgccagggagcccggttgcataggctgatccagatcacccaactatagccttgccataggacgtggtataggaagttagtgtggtttctaatctggttctgccacttctttgctggccaacctagggcaaaacaacccattttatggcctcaattttcttctccaggtgttaaaagagcaacggcctttgaggccctccaaatccccttcaattctgccatttagagtctgagtataatatgtgatctcaacatccattattcccattctatgccaggagtttttgcaagatcggtattgacttcttgatcttcttctttcttttttttttttttttgagacagggtcttgctctgttgctgaggctggagtacagtgacatgctcacagctcactgcagtcttgacctcccaggcccaagaaatcctctcatcccagcctccctaatagctggcaccataggtgtgtgccactactcccagctaatttttgtattttttacagagatggagtttccctatattgcccaggctggtcttgaactcccaggctcaggtgatccttagcctcccaaagtgctgggattacaggcataagccaccatgcctggcctgactttctgatcttttaataagtcaagttgtgtgagatgctgtgctccttgcctttgggctttctttgtttgggttgcccttccttcttctcccattctcttctacctgtttttcagtggtaactcctgcttgtgtggtctcttgccccttgccatattttactttgtaattcatatactgtgctcattctcctagtactttttgtgagcaaaggatggtgtttattcatctctttttgaatttgttcattcaacaagtttttctgtgcatttgtttgttcgttcaacaaatgttcattgaagtctaaccgttgtcctagggactaagctaggtgctagcagccaggattcagccatgagcaagacagccatggttcctgccactatggagctttcaatttagtggagaagatagacattgagcaaattatcacagaaataattactattgtgaaaagtgctgtaaatgaaaaatataggttgttttgagaatgtataatgtgggcctaaaccagtttgggagggagaatgagtcaggatctttgaagaaaagacatttaagtggagatcagcagcatgagtcagaatttgcaggttaagaaagaagtaagagccttccataccgaaagaattctgagtggttcttgacctgggctgcagtctagcgtcaccacgtaaaagggagtatatggagcacctggacatatcatgcatgactggtgggagtataaagtgatatgcctactttagaaaacagtttggcagttacttgaaatgttaaacatacttttattttgtaaatgcatcagttccaccctagatatttgctcaagaaaaatgaaaacatatgttcatacaaagacttgtacatgaatactcataatagctttatttgtaaaatagccaaaaactgatgagtggataaacaagtggtggtatagccattcaatggaatactactcagcagcaaaatggaacaaactactgattcatgtgacaacatggttgaatctcaaatcttgttgagtaacagaagctaggcacaaaagagtacatactgatgattccatttaatttgaaattctagaacaggcaaaactagtttatagtgatagaagttggaacagtggttgtgtggggagggagaatgagggttggcagtgaaggaccaagtaggaatattctggggtgatggaaaggttctgcatcttgattggggtggtggttacacagggatgtatgtttgtccaacacatttaacagtacattaaaaatgagggcattttattatatgtaactgtaccttaaaaatattcatgcctcatttttataagggtcaaaaacaggtaaaactcgtctatgatgatacaagtcagaatgtggttactgtggggtatggttactcatggtagtattgactggaaaggggcaagaagggtggagccttcctggaaatgttctatattttttatttcagtggtagttacatgaacatatagattacataaaaattgaatgtatataatgtaaaaatatatattttaaattgtctatatatttacttatgtactttactgtaagtgtctctattaaagaaaaaataaaaccccaaaaaacccagcttatgcctggccccacccagagagatactgatttaattggtctggtgtggggcctgggcatcagcaatttaagagctccttaagtgattctgctatgcagccagggttgagaactactgctctatgtggaaaggctgaggagggaagaaatggtgtgtaaagaaggatcataaaaagcaggagtttcacttctcttttatttttaaaaattttaattaaaaatttttttattattattttttactgctccctgtgcagcagggctaccccataagcagtatgcccagagtagtcaggagtttcacttctaatatgaagttatagaaaaaaaaaaaaaagcaggagttactggagatgaaatcagaaagatggcaggtgtcagatcattctgggccttgcaggccacattaagaaattttaactttatcttaagaataaggagaaatttttgaaaggttataagcagagagtgactaggttggatattcagctagtatgcactagcaccgcctatagctcgcatttctgctgattggtcattaagtatttagattatctcctctgggagaggcatgctgtgtgcaggataagagttggaatagttaaggaatattgaattaggattggtgattgattaaatgtggagagtgaaggagagtgaggtgtcaaggcttctgacataagcacctggaaaagtaggaaggttagggaaaaaatgaatttagaattggaacttaactagttcaagtgcctgagagacatccatgtgatgtctactaggtagataggttctgtgggtttctgtaggtcctaagtgaaacttgaaccagaaacataattttaggacttggtaatagtaatttctttaaatagtaactgaaggtatgagaagaggtaaaatcactttaggaaagagtgtagtaagaagacagcccagaatttagaaaaaaattctgacatttagaatttatgtagaagtctgggcacagtggctcatgcctgtaattccaacactatgagaggctaaggcaggaggattgcttgaactcaaaaggtagaggctgcagtgaaccatgatcatgcaattgcacttcaatctgggtgacagagcaagaccctgtctccaaaaaaaaaaaaaaaaaaaaaaaaaaaagtcagagaggagaaacctaccttgcaaattagggaaagcgaagatttattcattcattcagcaaattctctattgaatacctagtatgtgtcaggcactgtacgagtcccttgggatactgcagtgagcaaaaaagcgactgctctcgtggaccttacttttagtggagggagataggtgataagcaaaccaaggaataaatatatcatgtgtcaggtggaatcaaatgctatgaaaaatgagaatcacaagctgtgtcctcagatatcttcaaataactatagttataaactgactgaggtaaggccatatgaggtgcaaagtcagaattgctgttggaactcagaagtatatctcattgcattgctcaacatggacctgtatatatagttgatgctgtggattattattattattatttttgagacagattcttgctctgttgcgcaggctggagtgcagtggtgtggtcttggctcactgcagcctctgcctcctggtttcaagccgttctcctgcctcagcctcctgagtagttgggattacaggcgcccgccaccacgcccggctaatttttttgtatttttagtagatatgggctttcaccatgttggccaggctggtctcaaactcctgaccttgcgatccacctgcctcagcctcccaaagtgctgagattactagggtgagccactgcgcctggcctattattattattaatgttgagacaggttcttgctttgtcatcaaggctggagtgcagtgtcatgatcatggctgacacagcctgaaactcctggactcgagcagtcctccatttcagcctcccaagtggctgggactacaggtgcacactagcacactgggctaattaaaaatttttttttcttcctttgtagagatgagatctcactgtgtggaccaggctgattttgaactcttggcctcatgtgatcttcctaccttggcccccaaagtgctgaaattacaggcatgagccatcaagcctggccaatggattaatttttttttttagacgaagtctcactctgtcgccaggctggagtgcagtggcgcagtcttgactcactgcaacctccacctcccgggttcaagcgattctcctgcctcagccttccaagtagctgggactacaggcgcgtgccatcatgcccagctaatttttgtatttttaatagagacagggtgtcaccatgttggccaggatggtctcaatctcttgacctcatgatccgcccatctcggcctcccaagatgctggaattacaggcttgagccaccgctcccagctgattaatttttgatgagcgacctcagggagagaagtgagcttggtcaaaattcagagcttagaagctgagtgcagtggcaaaagcctataatcctagctatttgggaggctgaggcaggaggattgcttgagccaggagtttgaaaccagcctgggcaacataacaagacccccctctcaaaaataaaaaggaagttagagcttagaatctgtagtgatttgtgttagtgttgcttgggcagctgaaaccagtgccagttttgtccagaagaaaagatcttttgaattcctgccccctgctgagaagagctggtcctcttcttggatatgaggacgagtggttctaacagacgcaggaatatctctcagataggctgagttttgcctagcctaggggtatgactcctctttctgtggctaggcctgctgtgtgcctcagctgagatgttatatttcactggggacctttcttggataactccaggtctcaaacctgttccttttttaagacttcacatttccatagtcaggcgcagtggctcacacctgtaattccagcactttgggagactgaggcgggtggatcacctcaggtcaggagtttgagaccagcctggccaacatggtgaaaccccgtctgtactaaaaatacaaaaattagccaggcgtggcagtggaggctgaggcaggagaatcgcttgaacctgggaggcagaggttgcagtgagtcgagatcaagctattgcactccagcctgggcctgggcgacaagagcaaaactctgtctaaaaaaaaaaaaaaaagactttacatttctggccagagcgtccatcccttactcctccctcacctcatccccattctaggccccatgctattttatctcttgaacttcatggtccttgaccaaatttgaaaatcttcccagggctagtactctcaagtcttagtcttttgatccctttccaagaatgagggtggattctaatcccatcaagagtagctgcagaatttgctagtcctggctgagaaataagaggtgaagtgggagaaattcttcttactgatggggcccctgctggtaaaacttggcaatttccaattcgtcctatagggatgaattactgtttagtgacgagaaacagaaagtggttgggaaagtcgaagcattagatggacagtggatattggtggtgggaattggtgggttgtattcaagaattcccttgactttttgggagatatggttttttaattaattaattcacacattcttcattcattcattcatttagccagcacatactgatttcatacttgacagggtagatggtagtggtaatattataatgggccctgggggatagagtgagtcaagcttggttcttaccacttggatgtggtatgtgaacaactcataacatgagaattaatataacagagctatgcacaaagtgctttggagcatagaacagtgaacagtgaatgattagctctgcctggagaaaggtgaggagatttgggcaggagggaaaggactttgtgtttttttctgccaatagctatcaaagtgtagtctttagaccatggcgggtggcagcaaggccttttcaggacatccagaagatcaaagccgtttcataataatatattatttgccttaaaaaaaactatgtatacctttgtactgatgttgcaaaaacagtggtaggtaaaactgctggcaccttaacacaaatcaaaccagtggcactgaactactagtaatgactgtattcctcacctccacacactgtcagttaaaaaaaataaaagttttcaacaaagaagtagaaatcattaattttattgaattgcatcccatgagttcatgccttttagtattctgtgtgatgaaatataagtatgcataaagcatttctgctgcatgtagaagtttgatggttatctcaaggaaagcacttgtgcaattgagttgtaagttgacatacctcttttttttcaggcagcactatcattagttgaaagaatacttgatagataactatggttattcagtatttggcagaattttcttgtaaataaatgaaatgcatcttctgctttaaggaaaacaactggtagtatttgttgccaatgataaaattccagcttttaagtgaaaactggattttagaaaacttgtatctgtcactgtgaaattgacagttttcctggattaaaagcttttctgatgaaatcagtggtgatattaataattgtggctattttgatattgtataaatgaaagtgtcaacatttggaagctctgcactaactcctaaccaatagtttccaaatgacaagtgcatcatgttacaaagtcatgcatgtattaaagatccattcaaagtgtaagatagaccaatggattttaatgttagagggtacaaaaagtttattcatatagtttgggatttcacattgcaactaacctttaagaaacctaccgcttgttgagtttgggtatagtctcgtataaggtatccacaatagtctgactagtaaaatattcctgtcttttccaactgcatatctatgttttgatctttagccaaaacaacacatcacaataggttgaatgtagctataagattatgtctgtcttctattaagccagacatttaaaagatttgcaaaaatgtacaattctacccttctcgagattttttcagaaaacaattattttccataaaaatattatttacattaatatgtaagagatttgttattgttctaaaataaattaaagagagcctggagagcagtagcagcctggctgtcatcaccatgtccctgaaaggtgattttttttttttggagacagggtctcactgttgcccaggctgtagtgcagtggtgcaatcacagctcattgcagcttcaacatcctgcactcaagtgatcctcctacttcagccttctgagtagctgggactacaggcatgcaccaccatgcttggcttttatagagatggggtctcactatgttgcccagacagattttgaactcctgggctcaagcaatgcctcagcctcccaaagtgctgggattataggtagtgagccactgtacctggccctgcaggctgattttgacagtgttgcagaagatgtgaggaagctgaaaacaagaccagatgaggaaggactgaaacaactctatgggctttagaaacaagctataactggggacattaatattgagtgttcaggaatgctagatttaaaaggcaaggccaaatgagaagcattgaatttccaaaatgggatatcaaaggacaatgtgatgagtatatatatatatacatatattttttttttgagacagagtcttgctctgttgcccaggctggagtgcaatggcacgatctccgctcactgcaacctccacctcccgggttcaagcgattatcctgcctcagtctcctgagtagctgggattacaggtgtgccccaccacacctggctaatttttgtattttttagtagagatggggtttctccatgttggtcatgctggtcttgaactcctgaccttgtgatccgcctgcctcggcctcctaagatgctgggattacaggcgtgagccactgcgcccggccaaatacctgtatttctaagcaaaggagctgatagaaaaaggttgaatttaggataaagcataggagaaaattgtcctttggaagccttcatactggtatcatgacctaacatttagtgggggaaatgcacttttaactctatgtatcatctacatttttgctgttagcatgaattgtaataattaggagtaaattgaaactacctagttaactaaactgtggttacttaaactaggtgtctgtaaaagttcttttagaaaagtgtcttatattttatttttatagatttagggggtacaaatgcagttttgttacatgggtatattgtgtattggtgaagcctgggcttttagtgtacctagtgtatccatcacccaaatagggtacattgtacccaaaaggtagtttcttgtcccttaccgtcctcccccactcctggcaacttttcgaagtctccactgcctccagggactctccatgtccccctatacacattgtttggcttctacttgtaggtggcaatatgtgatgtttgattttctgtttctcagttgtttcacttcagatagcggcctccagttccatccacgttgctgcaaaagacatgatttcattcttcttttatggctgagtagtattgtgtgtgtgtgtgtgtgtgtgtgtgtgtgtataaaaataatattttctttatgcagtcatccattgatggacactaaagttgattctatgtcttgctattgtaaatagtgccgcaacagacatgagtggtggctatctctttatataatgatttcttatcctttcttatcctttggctagctgcctaattttggtcctttgggagatctccatactgtttttcatagaggttgtactggtgcattcccctaacagtgtatgagtatttccttttctctgcatcctcaccaacatctgttgtttattgactttttagaaaagtcttgctctgggagtatgtatacaaagactttagcaattgtttgttcttttggcttatctgttctacagtgagtttagtgttactcatttagtgttcatctgttttgattattaagaagaaataaaatgaattaataactaaatataaaaatttgtgttttactttccttttttaattcaaaattttgtggaaattttatttgaaatgctctgatctataccttatgaaacatattatcaatctagaaaaaatcttactgaggcagtttgcaaaagttttatgttgctaaatattcattaacgcaatgtaggtaattaaattttaacttttattttgagtttagggatacaagtataggtttgctacataactaagcttctgacatggggtttgttgcacagattatttcatcacccaggtattaatcctagtacccattagttatttttcctcatcctcttcctcctcccaccctccaccctccgaaaggccccagtgtgtgttgtttccctctgtgtatccatgtgttctcatcatttagctcctacttagaagtgagaacatgtggtatttggttttctgttcctgtgttcttttgctaaggataatgacctccatctccattcatgtccctgcaaaggacatgatctcgttctttttttatggctgcatctgttttactttctaatatggtaaatattaaacagttctttgtaattaaaagatgttatgcatataaaagggtcctgagaccaaaaagtttaaaaacatatgcctatgctattttctttgcctagaactcttctcttttttctctagagaaatcctacacatagttgtagagttaatatttaggtattcattttaaaaaaacatttactgagcatcttatcaagaacctggctttttgttgctgttggggacatggtaccaatcccttatggagatcacagtctggtggggaagacacattaaacccagtatgttgaatgttaccagtgatagcatataaatgttgtgggagtacaggctgctgtcagagtcttgcaaagagccactttcccactcacttggaacatatgactggtcaggttgattggattatacctcctatatttgattcttcatagtcagacagggaaagtggccgaagttaaaagaagatgggaactgtttacttgctgctctgggggtaaagaaggatacttcaaatgtattaaatgtcagcctacaccaggccctatgctggatgttttaacaaatgtgattttatttttaaaaagtctgtgcagcagattattatccttattttgcaaatgagaaattggaggctcaaataaattaacttgtccaatatcttatggtttgtaattggtgaagatgggattttgatagtgttctgactctaagtccaggctttttcactgtagttatgtgttgctaaatgcatggctctttgaaggtatttccagatggttgtgggaaaccttgccagattggaatgcgtaagagaaggtaggaaaggtctcaggaagaacagagagactgcttaggacatgcttggttgaaggaattatttgtgagttttggctgacatggtttttctgtacaggattcaacggccataggagaatcaagcttttgtactccctaaccctcaatccctttaatccttctctatgtcatctgatgctagcagcaaaggtcacctgtctgtctgattaggttacaaaccagagactgggtatttgaagcccaaacttcttggatcttgtaggtttttgggaaaggtgctggttaattgacctcaggccagtggtgcagcctggaggccccaaaccctagagcttggtaaactatttccattattttaaaaagcctattagaagttttgctttacctaggatatgtgtggatacaggctaatgaaaagattggatttctatctttctttaattctttttttttttttttgaggcagggtctcgctctgttgcccaggctggagttcagtggcacaaacatggatcactgcagcctcagcctcgtggcctcaagcgatcctcctacctcagcctcctgagtagctgggaccacaggtgtgtgccatcatgcctggctaattttttaaatttttgtaaagacagggtttcaccatgttgcccaggctagtcttttaactctggggctcaagggaactcccacttcagcctcccaaagtgctgggatcacaggtgtgagccaccacagccagccttggatttctttcttttaggtcaatccaatatgatttaggtatgctacctatgatattctagaacagggttcaacaaactatggcctgtgggccaaatccagtttactgcctgcttttataaataaagttttattagaacacattcaagttcattcacttatattttgtctacggatgcttttgtgctacaatggcagagttaagttgtgcaacagagactatatggctgacaaatcctaagttgtttactatctggccatttacagaaaaatttgctgatacttaattatgatcctttctatcatggcacttagcacatagtgttttaattgcttgtctctcccacttttgtaattagccttctgagagaaaaatgagatatgattcatgtttttatgccccatgctgatcacagggcctgatatatgaagaacattcaataaatgtttaaatgggcatatcatgggctgatcaaaaagctctaatatgcaattatatatgtttttgttggtgaggtagtagagaaacaatgccttaatctttgggtgtattctgctctctccctaagttcccactaccccttcatcccactccccaatttagcagaacaaatgtagagagaaataagtttatgcagagatatttctttttgtatgcatactgtttatcatacttttttcttttatcaaaccattgcaggctgggcgtggtggcccatgcctgtaatcccagcacttcgggaggccgaggtgggcggatcacttgaggtcaggacttcgagactggcctggccaacatgctgaaaccccgtctctactaaaaatacaaaaaattagccgggcgtggtggcgcatgcctgtaatcccagctactcggaaggctgaggcaggagaattgcttgagcccagggaacgaaggttgcagtgagcagagatcatgccactgcactcaaacctgggcaacagggtgagactctgtctcaaaaaacaaacaaacaaacaaacaaaaaaccaaaaaaaaccccatttcttcaatgttcttcttgcccatattatcacctgtggcttctaaaagatgaaagcaacacaaggccagctatctggtcaccctagcaaaaaggcagtggtgaaaatggaattttgaagtgctggcctgggagtcagcagacttgggctctcactgtggctctttagctgcctttgactttggcacatcacttaacattggtgagcttcaatgttcaacatacttctattgaatcacatctggaacactttaaaatttaatatttatactcctcccttattttgaaaaggatttgaataactagcaagaggtagagaggtgacctgtctagtcttatcactgtctttggctgtcagacaagtagatgattaaatggattagggtattttaggtctttgattagtgccttctaaaaggcgtcacaaccacagcctcttcaccctgtccttactttctgtcctgtgacagcttcttctattgcctaggaagttaagatctatcttctttgagggtcatctgaagagtattttgccaaggaagtagttgtcgagatccaggtcaaaaggaaagaggaattttagcatctaggaattggaagaaatactagaaacttcagtcaaaatacctttttcaaatagtgaccttgaggcctggagaagagaaatgacctccctagatcatatggtagagctaagcctagatttcaggctcttcctattgtgtgcatcattcagactaggtgttttccaggcttgtaagagaggactaggtgtcacagaaagagctaaggtggcctaggctcttgtgctggttttactgctacatggacatgtaatggtaggcagaagaaactgtatcccagaccacctaaggtgttgtatcagatgagctcgggaccttcagatatctaaaaaatatttgcctgatataactgtctatgagaaggcatgagatgtgagaggtttccccagtcaatggctgaccttatatgtatcagcactgacaaaatgaacaaaaaggaaaattacacatcatttgggcactgggactaattggctgttgttctgtttccagaaagattatgttgatttacatttgtgtatttggctgattaaaaataatagctcaattgaatatgtatttctttgattactaatgaggccaaattttttcctgtgttcattggctatttatgttttctctcatttgtgagttactgattcacattcttgtctagatcccagtatactcccagtcctatgcaagacttccctgccaagaaactattagggtgataaagcattgtccttgtgggggagctcagcattttcttggggagacagttacagtctagatgaaacacctctgtcactgtacaagtagccagttaagtgcctacatgaggagtcagatgctagaagctaaggatgctgacacaggtgggtgataggttctgggtggcagctctgagtaattttgtctcttgcttttcttacacagagttttgccgaattgacaagcccctgtgtcacagtgaggatgagaaactcagcttcgaggcagtccgtaacatccacaaactgatggacgatgatgccaatggtgatgtggatgtggaagaaagtgatgaggtgagctctcccatcctgctatgtctctcttttcttcctgtgtgaattagtctttgaaagctacttagacagcctcttccctggggagagatgttctctgctggcttgttctttaggaactcatccctatcagggaagatggctcccagaagagcagccctctaggagtcagcctgtcagagtgtaggctttatgcttgtgtctgtgcctgggctggctgccccctgcctactggctagttgtgtaacactgactaagctgtgttgtttgggagggagagagatccctgaggctggtctctatggtttccttgcatccttcttgcaatcctgctatagatggagggcatcagtctgttctcagccctgtgttggcatgagggatagaagataagacacccagatcctgccctctgggagtttatactctatatgggaagaagaaacaaattgttttagaaagatcattctgaattccaggctgaagtttttgggagccagttgagtggtctagatagtaagagttaaaggagtctctaaatggaaaaaagctctattgttgtttcatcttttggcattattgtacctgtggctcagcagatcccagagaataaggtcattatgtgtgaaaagatttaaaagtttgttcatttaaagctcaacatataccagtagtttggtgaagctaccaagttatgccaaatcttcaatagtgatgtagttatatcacgatgggggagatatccccattctctctttcctgccagcctacctttgagttttgagttcaattttggatcccacattgtcagatccaatgtgaggaacaatgagggcctatacagagaggagtgacatgagtgatgaagagtttggaaagtatgaaacaaagagcattcaacacaattatgtttattaagcgtctatgtaccatgcactgtgctaggcatggagatgggactgtaaataaaacagatacagtctgtctttatataacttaaagtctagtgaagagactttagcctggagaagaggagactcaggtaatataatttctatctttaaatacataagaagtaaatcaatcagacttaagtaatgatgatagtaaagtgaaaaccatgatactagctctcattgattgaactcttaccttatgccagtcacagtgttaagctttttgcatagttactcttttaacttcaacagatttatgaagttggtattattactagggtatggagccttagaaaggttaagcattttcttcagggacacagtgaatatcagtgcagatctgatttcaaagcccatgctcttaagtactgctgtattgtttctcctattctaagagcagaaccaggtccaaagtaaagtggggaaagtaaaaagtaggcattttcttttagaataaagaattgactaatagtgagagctatcttgtcatagaagaggcttccttggtagacagtgaactccctatcactgaagatgggcaagtagcatacagaactccactgaatctgggtgtggtggctcatgcctgtaatcccagcacttcgggaggccaaggcaggaggatagcttgaggccaagaatttgagactagcctggacaacacagcgagaccctgtctctacaaaaaaaaaaaattggctgggtgtggtggcatacacctgtagtctcagctactctgaggctgaggctggaggatcacttgaacctaggaggtcgaggctgtggtgcactatgatcatgccattgcactccagcctgggcaacagagcaagaccctgtctctaaaacaaaacaaaacacaaaacaaaacacaaaattcactgattggtcaacagaggggatttgtctgtaaggatgaaccagataatgtttaaggaatttaaaggaagagaaaaaatagacttcctgtataaaaagtaaaatttggatagaatggaaagggttgggcttactgagtagtggagaatcagtgtgagcaaagctgtagaggtagtaagaaatatagtgggttggtttggttagacagggactgtggtagaaaaccacagaacaaaaagttggaaaggaaagtggggcccaggctgagatatgtatacttgttgaaccaggcaactgtaggttcttgagcaaagacaacgaccatgatgtaagtatctgaaatttggttacatccagaagtgtcactgacctgtaaaggatcaaaattttatttgtctaacctgagaatacagccatgttcctgggggtgaatgaggcctagtggcatcctgatcactgtcccagggcctggccagaaaactggggaatggatgaagaaggtgatgtaacccaagatctataaattcttggatatctttgttatatgctcctcatccttttttttttttttttgttacatcctgctgagttgctttgtcaatgaggggaggaataaaatgttctttttagaggaatgttaccacaacaaaaagctcatcagcacaaactgttccgaaataacacaaaaactgttaccctgctcttctctgcgccagtggtgagctgttctttttcagtatagtttttgccttgccttggtttccactgctctccctgcaatctcaggcctcacatggttagagaggcctgctggtctaggtttgcatgatcaatcacaagctaccttcctgagagagaaagtaccaaaatgtgtgtgcctaagtcacttcaaacatgtataagatagccttagagttcaggatctaactagaaagttgggtagatatctcagggtttagaatgttgtgtaatggatggtggggtaccagaaaccctggttcttttggccattgaggacctgaagggttttttttttttcattcataaaacttttattccacttacatgaatttaatacacgtgttcttaacaattatgcttggattattaatgaaaatttcataagatattaaacaaagctagccatcatctcaagttatttccttgttaactatttttacagcacatgcatgttaggcaagtatcaaaaaaaatcacaacagcaaaaaaactaaaaaaaaagaagttaaatacatgggtttttctttttttgttttactgctgtgcttgatatacgtgaagtaatgaatatcaagcaattcatttttactgcatctttacttttacatttgtttttaggttgcctaaaacatttaaatacaaataaaatgagtgtagcaaaaataatgaaagccaacagcaggtaactttacaaataatggaatgtgaactgtttctgcccttatccagagtaaaatgggtcacaactttgtctaaaggaacacttctgcagccgtagtcaaaggtgtgcacagtgagattgaatattccatagatatacaagatgtaacatgtgggccaggtgtggtggctgacacctataatcccagcactttgggaggccaaggcaggaggactgcttgaggccaggagttcaagaccagcctagtcaacatagtgagaccttgtctctataaaaaaataaacaagtatgaaaaaaaaaaaaaaagggccgggcacggtggctcacgcctgtaatcccagcactttggaaggccgaggcgggtggatcacgaggtcaggagattgagaccatcctggctaacacggtgaaaccccgtctctactaaaaatacaaaaaattctccgggcgtggtggcgggcgcctgtagtcctagctactctggaggctgaggcaggagaatggcgtgagcctgggaggcggagcttgcagtgagccgagatcgcaacattgcactccagcctgggtgacagagcaagactctgtctcaaaaacaaaaaaaacaaaaaaacaaaacaaaacaaaaaagatgtaacgtgatatccatgggatatctgtttctaccacagccgtttaagtgctccaaaccttaaagtacccacagttactacacctgtgactggaaccaatgatcccttttactccctgccaggacaaaccaatgtgtaggcagttttctttgcttagacatgaagcagttttaacactggcccttgtgaagccacaatgtaccaaaagtactatgccaaacatttataacctttagaaaaattccacatttccatattggccacctcaaaatggaaacagataactccctaaatgttaaccggccctgctctcctaatattaaacataaaaaccacatgggaaatatagatattcaagtagaagtagcataaacctgtcataaatcataaacaaaaactctttgtgggacagcatggatgacaaatggtctactatgtaacttttagaatgaggcagacaaagttggaaggctggttaattttccccttgttctcctgcttcagcttcatttccttgggttctgatgaaggacctgagatttttataagtcatcttaaaagccttgctgattactcaagagccttagtagaagtctgaaggggtgctctattgaggcctcatgtattcagcctcctactggtaacttttctgcataactggactgtaaccccagttacagatcttttaaaatttttgccatttctgaagtaagtctttattcctacagattattgtgactagagtgttaacttttcgttgtatgaatcaaagcatgtcttcagggcctcttgcactattaccccagtacctagattcctatatacattcttatgattgcctcttatagttatcttcttatagttttatctcttctttgattcattttcatttcttttttttatagacacatttattcagcatcacgatcaaactattacatttagcaatcaacagcatgagtaaaaaaaattatctacactaaaactctttgttggcatgctttacattttccacagaaaagaaactaaaataacctgttatacaattagtcacaaacacagtcctacttttttttttgcctatacacattaatattgtctaaaacatgtcttctttgtagcagctaggccctgccaccactgtgcttggctgagttcacaaatctgttgtaacctgtagcttctttgtcacttctctggctctcttctgctaagtatttttctggcagtaattaaaatctgccactgccatagctactgactggaaccaccatagctgccttggttttgtgttttggccagtatagaatccagagcttctgcctccaaagtttcctcctttcgtgcatccaaaatttgaggactgattgttataattgccaaaattattgtagcttccaccacctccaaaattgctttcactgccaccaacaaagctgcttctgcctccatcgttgttatagctgtgagagctgacactcctgctgtagccactgccctgatttccataatcctgcctccacttccatagcctctgcttccttcagcgtaaccagggctgcccctctataaccactgttgttaccaaatccattatagccatccctgttgctaccagatcaccaccagcatggctgctaccaaagtcaccacaaccactgaagtttctcctccatgaccaaagttgtcattcccaccaaaaccacctccacgaccatcaccagagtttccagaaccatttcgacctctttggctagatgaaacactagccatctctttcttcgacagggcatccctaacttcatagttgtggccattcacagtatggtatttctttttttttctctcgagacaaggtcttgctctgttgcccaggctggagtgcagtggtgtgaacacagctcactgcagcttggacctccggggctcaagtgatcctcccatctcagcctcccgagtagctgggactacaggcgcgcaccactgcacctagctaatttttgtattttttgtagagatgaggtcttgccatgctgcccaggctggtcttgaactcctgggcaagtgatcccctgcctcggcctcccaaagtgctagaattacaggcatgagccactgcacccagccagtatttcttttaaaaatatttgtttatttattttgagacaaagtctcacactgtcggccaggctggagttcagtggtgtgcgcatggctcactgtagcctttacctcccaggctcaaacgatcttcctgtctcagcctcttgaatagctgggactataggcacatgccaccatacccagctaatttaaaacaaatttttttaaatttaaaatgtatcttttttaaagcccccaacaaatatccttttcatagttaagtgggcatgtggtctttgagaatcttctcttgatacagctcttctgtccaccttatgtagccttgcattcacggctgcatccacctcctccacagtggcatatgtgacaaacccaaagcccctggagcacttggtatttggatctctcattaccacagtctgtgagtgctccctgttgctcagaatggctcattggaccctcactggtcatttcaaagctcaactctctgatgaagaacttctacagctgttgggactacttaagagactctgtcttagacatgatagcagtgggaagagagactttaatgatgttttcagcggcatccatgggtagaaaaagccattctcgtttctaattgctgaatatactctgctgtgaaattagacttagggcaaactgagactcagtaggcatgttatagaaaaatatataatcaggccagttgtggtggctcacagctgtaatctgagcaccttgggaggctgaggcaggaggattgcttgagcccaggagttcaagaccagcctggacaacatagggagactctatctctaccaaaaaaaaaaaaaaaaagccagatattggcacagagaccctaaaagagactttttaagagtctcttaaaagaaaagaaaaatatataatcatttgtgtaggggcagctagtttggttaagtgccatctttgcttgcttctcttctggatagcagaggctatgtattgtgggcccttcagatgtgcaagatggctctattggtgatggtgcccttcttgcagagctggcagggagttctaccaggctggcagtatgagaattcatgacctgtgttctgttcaaacttctggtggggtttgctccatgggcaaaagatttgttgcagtgggatggtactgttaggttgtccttaacagtatgagttgggcagacaagggcctacctaagaccattgtccccttgactggaccagactttttgagagcagtgctattttcttttctggagcctacatggcaaatcagggcatttattcagtcattaaacaaattcttatttaatacatattaaagccaggcactattcgaaggctagggattccacagtgtacaaaacagataagatccctgcttttagggagcttgcgttctagtgatctgtatgtcacaggtgattaagtgataagaaaactttgaaattaggcagaactgtgatcagattatagtagtctagtgactttgcctttggttttctcagggtaaagtggtagttaatgattcctaccattgcagcgttgttgtcaggattaagtgagaaaagtgctgtttaaagttcccaacacaaagaattctcaaaactcgacaatagaaaataagccaggccaggtgtggtagtggctcacgcctgtaatcccaacactttgggaggctgaggcaggcagatcacttgaggtcaggagtttgagaccagcttggccaacatggcaaaaccctctctgtactaaaaatacaaaaaaattagctggtgtggtgacacgtgcctgtaatcccagttactgggaaggctgaggcaggagaatcgcttgaagccgggaggcggaggttgcagtgagtggagatcgcaccactgcattccagattgggcaacaaagtgagactctgcctcaaaaaaaagaagaagaagaaggaagaaggaagaaggaagaagaaaataagccacttaataaaaaatgggaaaagatttgaacagagacttcaaagtagatatatggatggctaataagctatgaaaagatactcaatattattaaccattagggaaatgcaaattaaaaccataatgaggtatcaccacatgcctgttagaatggctaaaaataaaaaatggacaatatcaagtcctggacgaggaggaagagccactggaactcttgctgatgggaatgcaagatgataccgccagtctggaaaagtttcacagtttcttacaaagttaaatatatgtcccagcaattcttcctctaggtatttaccctatgaataaatgaaactttatattcacagtagaacctgtatatgaatgtttatagtatctttatttgtgattgccaaaaactggacataacccaaatgtccttcaatgtatgaacggataaacagactatggaaaactactcagcaatataaaggcatgaattttttggatgaacacctgtggggaaaagcaaaaacaaaaggcaaaaacaaaaagcaaaacaaaggcatgaactactaatatacacaacatatgtgaatctcagaggcattatccgagggaaagaaaccagtctcaaaatattacatactatgtgattctatttatatgacattctgagaaaggcaaaactatagggatggagactaggtcagtggttatcaggggttattagtgtaggggaggttttgactacaaggggaaagcatggaggaagtttttgggagtaatggcctaactgttctgtgtccagattgcaagggcagttacatgaatctattaataaatatgtattaaaactcatggaactatgcgccaaaaagttaaatttcatcatatgttaatttttttaaagttcccagcatagtacctgacacgtaattcaagctcagtgaatactcgctactttcccttttctcttttcctctatatatccaggaaatcaactagcatctgacagttgtatttttcttagatagggtctcactatgttgcttaggctggtgttgaactcctgggctcaagaaatcctcctgcctcagcctcccaaagttctggaattacatgtgtgagccaccacgcctagcctgacagttgtttttttttggagatggagtctcactctgtcacccagaatggagtgcagtggtacagtcttggctcactgcaacctctacctcctgggttcaagcgattctcctgcatcagcctccctagtagctggaactacaggcgcgtagtgccacacccagctaatttttgtatttttagtagagatggggtttcgccatgttggtcatgctggtcttgaacttctgacctcaggtgatctgcccgcctccagctccgaaagtgctgggattacaggcatgagccaccacgcctggcccctgacagctgtattttaatgtttgtctgatgtattttgagcccctttagggaaagaactgctcttatctggtttgtctctcttttccccagtgcccaacaaagtctgttatagaatatgtgcttaatcactgtgttgaatgactgaccaatattgctatagcagaatgctatcattctgctatgggagtcttagcaagggtgtgatcacacattttaggggataaggatgagtaggtagcagtatgaatccaggaagctacaagatctacttatgacttctgttagtgtctgtggtgtctggtatagaagtataacacagggttatgagcttatgctctggaatcatacagactccattctgcctcttccagctgtggaaacttagagaagttacataatccctttccacctcagtttcttcattagaaattggagtaataatagtagtaggcttttcatgaagatgttgcaaatattaaatgaataatgcatgtaaagcacttaatacaatgcctggcacatagaagaggctcaattaaagtttttacgttatcatcagaaagaacatatattttgatgcaaacaagcctgtattcaaaacttggctttgccacttactggctatacaactttaggcaaataaccttacctttctgagccttgattttttttttaagctatttgaagagggatgttgtgagacattaatgtatgtaaagcccctagcacaatgcctggtacgtgataggtgctaaagccatgtttttttctccctcaacatgagggtacaatagtgagggctggcttgtatagcaaaattccatatcagctctatcaccatcccatggcaccacagcatttagccatgggagccactcccagcagtgtgcctaacttgactagggccaggacactgtaggaggcagaggtagttctgttttcgcttaagtggttgatattaagagggagggcatgataaagcaggatcacacatttatagggactacaacttttctggcagctcacccagcctcctacatatgcctgtgtactttttttttttttttttgagacggagtttcgctcttgttgcccaggctggagtgcaatggcactatctcggcttaccgcaacctccgcctcccaggttcaagcgattctcctgcctcagcctcctgagtagctgggattacaggcatgcaccaccacgcctggctaattttgtatttttagtagagacggggtttctccatgttggtcaggctggtttcaaacttctgacctcaggtgatctgcccgcctcggcctcccaaagtgctgggattacaggtgtgagccaccacgcccggcgcctgtgtacttttaaaaaggtctggcttttgggccaggcacggtggctcatgcctgtaatcccagcattttgggaggccgaggcgggtggatcacctgaggtcaggagtttgagaccagcctgtccaacatggtgaaaccccgtctctactaaaaatacacaaattagctggggttggtatcaggtgcctataatcccagctgcttgggaggctgaggcatgagaatcacctgaaccccagggaggcggaggttgcagtgagccgggattgtgccactgtactccagcctgagtgacagagtagaaatgtcatgagacctgtttagagtttagtgggggtagaaatagacttgttttctatgtttttcattgtcccatccagagtaatgctaggtcctgggaggctgtgagagttcgggaagctggcatcaggttcccgatgccaccatttggcttcagcgctcccaccatttggctttagctcatgctactagttcatgttatgctgtatttccttaatctatgctatagccaccccaaacagaatcagagctaagggagctaaactctgaggggagcagtcagcaggttcacttgcaatatctaaagtgccaggaggaacttggactttataggtagtagtatatagggagagagtaggaagcccagtgctgtggttaatatgggccaaattagatgaagattaagtagctgggttatttgcagatgttattaccataattaataataattatattcccttttgtgctctgggcctcactttcttatattcagatagctgtagacaacccttaagtgttctgcctctagtttctcccggaaagcccatgttgtacatgctgccagtgatcttcctaacctacatttgggttctgtgtctcctgcatgatttccttttcctgtttcctttaacttcctgtacctaccactccatctctttaaatccgattttagcctttcttttctttgtttttcattgaaatatatttttaaaagagtcagggtcttgctctgtcctctaggctggagtgcagtggcacaattatggctcactgtagccttgagctcctggactcaaatgatccttctacctcagcctcccaagtaggtaggactacaggtgtgcaccaccacactaggctaactatttttgtagagacagggtcttgctatgttgccaagtctggtattgaactcctggtctcaagcaacccctcacctcagcctcccaagttgccggggattacaggtgagagccactgcaccttggctacctttgttaattctctggacatacctcctaccgcttcggtctggctccaatcttctttgtcttataaacattttatgtttatttccagtcccctttctttgctcaggtagttctccttacctggaattaacctcttgtgcccctccctgcacccctagccctgtctgtatcaatcttagttgtcctctagaatgtgccagcttcattttatatgaaccttccctgactttcccattcctactgatcttcctcatctcaatactaactcccatagtacatagtctctatcgctcgatttagcacttaattagaaattgccttgctttgtgccctaatgattttgattgtattgttttgtctataactttgtgttcctgcactaatactggcattattaaagcacaactcatcagattacttctaccatgtgccaagccaagctgattacatataaagttttgtttaatccttaaccactctgtgaactaggtgttattaactccattttagagatgataaaactataaatgagtggcttacttttgcttgtttaattaatctaaactctgctctgtcattcaatgctcccaccatttggctttagctcatgctgctagttcatgttatactgtatttccttactctatgctatagccaccccagacatgctcttcatatcttatcactgtgcccctgttccagataaatccttatcctggcatttctctgcttcccactttgcctgtaaaaatcaagccaggtttggtggttcatgcctataatctcagctacttggttgagacaggaggatcgcttgaggccaggagttctagaccaggctgggcaacataacaagaccccatctctttaaaaaaaaaaaaaaaaaacccacacatttcagtgcaatgcctggaacaaaacaacaacaacaacaacaacaaaaaaaaacaaatagaaacaaaaggaaaaagaaatttcatttgtccaccaaggcctagatcagggtttcggaacctcagcattattgatattttgggccagatagttctttgttgtggggagctgtcttgtacattgtaggatgtttagtagcattcctagcctctacatactggatgccagtagcaaacctttccccttcccccttccagtttgacaaccaaaaatattgccagttactattgtcagttgtcaattttcaaactgccccttgttgagaactactggcctagattaaatgttgcttcatccaagaaatatatatatattttttggagacggagtcttgttctgtcgcccaggctggagtgcagtggtgtgatctcggctcactgcaacctctgcctcccaggttccgatgattcttctgcctcaggctctctttcatcatgttggccaagctggtcttgaactcctgaccttgtgatccatctgcctcgggctcccaaagcgctgggattataggcgtgagccaccacgcccagccaatccgagaaatcttgtttgttctcctacagtgggaagtaatcctttctcatgttcgagagtacttggcatgaaccttatgtttgtcatgttgctctgttctgtattgtaattgggtccatccttaactgtcctaccagattttgagttcctttaggggtcatgaactaggttttattcattgctgtttctcataacattgtgtttggttcaggacctttctcttaagggtgctgagttgacgttatttttgaattttgaattcgaaaacaaagatactatcttattgttttatgccctttaaatagtttctctagtgcaaaggaggagtacagagtgggctggtcaatggtactggggacagagtgctttggacttgtgagttccctgtcaggataaaagctgaagtcagtgttgggttgtttttctggagttgctatagtctgggctctagatatgttagtatatgacctatacgtctgacctcctctgtgaccttcttccctacccttctgccctatgttatgaatcatgtgcagaatctggatggaggtaagattactgtacttaaaatgataggaaagactttaagaataacacatactataggagcacaagtgaagaaaaaaaggaaaacactgagaatgcccaaaggctatgtagtagagcaaaagtatgtacttataaagcaagaaagatagtttcaggtatacttttgccaattattagttgtttgactttggaaagtttctctctctctctgtctctttcttttctttttgtttcttttttcttttcttttctttcttttttgttttgaaatagagtcttgctctgtcacccagcctggagtgcagtggcatgctcatagcttactgcagcctcaaactcctgggctcaagcaatcttccaactacagcctcctgagtagctgggactacaggtgcacgccactatgcccagttaatttttgtattttttgtagagacggggtttcgccatgttacccaggctggtctcaaaactcctgggctcaagcaatctctgcccacctcagcctcccaaaatcctgggatcgtaaacatgagccaacgcacccagcctggaaaattttcttaaactctgtgaactttcatttccttaccgtcaaattagtcagtaattcctaccttgaaagattatggcaaagatgaaatgaaatcatgtatatcaagtacccagcctatggtctagtttatagtagcagtatttctacttctttaactcgtactaccattgctatgatgtactaggcttgtgctgtgtactcttgcatatgctgtctcatataatccttacaagaaatctctgagacagacagtaatttttttctgtataacccataaggaaagagactgaattagctcattgttaaccatttttgaggttattgtaactcagatgtgcctcaggctgatgataatgttctaaaattagattgtggtgatagttgtatacttctgtgaatatactaaaaactatggggttttatactacaattagtatgtgaattaaatctcaataaatatgttttttaaaaaagtgtcaccgcattggttggagtggtggtcacctttcgcttgcctttctgtagcccagcccataacaatccttagggccctgtagaaaagcactttgaaagtcatgttgatttctatctccatttttaatttttattttttttgagacagggtcttgctctgtcacccaggctggagtgcagtggcgtgatctctgctcactgcagcctccatctcctagggtcaagtgattctcatgcctcagcctcctgagtagctggggctacaggcatgcaccaccacgcctggctaatgtttttgtgtttttagtagagaaggggtttctctgtgttggccaggctggtctccaactcctggtttccagtaatcggcctgccttggcctcccaaagtgttgggattacaagtgtaagccaccatgccctgcctctatctccatttcccctgcctccaactttgatagagatgcagtggtgctttgaagtctgaagtaccatggttgctggaagcagatccgtggttagctaactgacagcgaggttgcctcagttcctggggaggtatagatgacttttgagaatgtcagactgaagagtcctggagcattctcttttggagaatttctccctctttccctctttttattccttccttttccttttttgtagttagtactgcttctggggaagttaagatgtcaaagaatctgtgggacaaccctggtggcaattccctcttacccatataccaggggcctgaatcaatttcttgacccctactatgtgacattacatgtgaggagttgtcaaagacagccagccaagtggctctagttttatttttccttgattaaccttgtgctcagggcctctctctgattcccatggctgctatatcactcccagaggccataccggcacctgagaagcagagctctccttttggtccctggacccaattctgaacataacttttctttgcattccctgcacacagctttgacagcctggagctactgctgctgctgctttttctctttctgctcctcctcctcctctttctcctttcttttttttttttagatggagtttcctcttgttgctcaggctggagtacagtggcacagtctcggctcactgcaacctccgcctcctggattcaagcgattctcctgcctcagcctcgcgagtagctgggattacaggcatatgccagcatgcccggctaatttttgtattttgagtagagacggggtttcatatgttggtcaggctgatctcgaactcctgacctcaagtgatccgcccgccttggcctcctaaagtactgggactacaggtgtgagcaaccgtgtccagcctctttctcctttcttaaaaaaatttactatatgcaaatttacttcagcattggtttctggtatatatattttttgctacagtaattcttctttgacttcagtttggaggcactgctctgccttttttctttctagttctctgcctgtatcctggtgcagtcatcatcttgtctcctacttcatggaacattctgaccccctgctcttaattcaggcaaagcatggattgaagtctgctcaggccctttggacagaacagagatagctgacaccatgaatgacataatttttcaagtgaaacctgctccttaggctaaagaaatgtcctgttcccattcttccttgtaagtacttatagggtggctgtagaattcacctaccaggagtggctcatcagtttataggccgcaacttccattgagttcaagttatttggcccagctcatacattcagtcctaacttttgtgagtttattagaatagctttagaataaactatttggactttgactttttaaaagtctaagcatgagctttggagtccaacctgggttcaaatccaaaccttgcaatgtactaaatatatggccaagtgatttggagactcactttcctcatctataaagtaatgatgacaataagatactctttgccatgaacaagccctaggctagtgagagacacaattatgtaaacaggcagtgacaatagcacattttaagggctgtaatggtagtatgcataggtcctgtgggagtttccagaggaatcaggatgcagtgatcttatatgtactggtgtagcagaagccatattgtcagccagcacgcaggcaagggtaccagttcccagacaagctgagctacgtatcagtgagagtaggcatagtttgcaatctgtcccagtaccttagccagatacaagatgaggcagcagctcccccagatggtacccctcatgtttccaggaaaacccgacggtggcttgctttgacagatagggaaattctttctcactaagcaggctgttgttttccttcccccctctttgttattgagtctgctttgtcttttctggatggtaatcctgtcgatgacagggatgagatatatttgtaagacttgtttgtatagatgtctatatatgtgtatatgtctatatgtgcctttgtgtttgtgttttttttgtatgtgtgtatacatcattttgtgcttgtgtgggtatgtgtctttctgcatttagatgtgtctgtgtaagacaagaagtggagggagaagaggaacactgagccaaggaagtaggggctgaaagaaagcccataaatgaggttgaggatcaaggagcaggttagggacaaagggtttggcctgaggtataggacacaggacctggaagtaaaagcagagccagaaatgtaatcagcagcccaaagatgctgtcagtctaggcagaatctgggccccacagagtggtaggcagaatgcaggtatcacctagcagccaggaatggtcaagctagcagagagagaaaagccatgcttcagaaattaaaaacttctgactcttcctgtctaaggaggaattggcagctggctcccaaggccctgcttcccttcagacctaactggtgtttgtgtttgtttgactatatatgtattttttcaagtccttctgtgcatgtctgtgtctgcatatgcctcacattcagtgtacttgtacttcatagcattaagaagaattgtctgattcacttaagttcagtgagtttcctttcatttcctttcattcattcttgtgttcttctcctcacttataaatacctcctttgaaatctttcttactttttgatgtgctccttgccttctttctctcttttttcttcaaacatatttagtgtgtgctatgtgctggatgctggatatgctttgcatattcatttaaagactaataagatgaatttactacctagaaaggtctcacatattactgaggcaaaaaaaaatacatattcaatccccatagatattgtaacaagagatgagccctgcatgctctggaagtacagaaaagagttaatccatctgaggatgataggaaacactatccagaaaaggtattgcctgagatgaatttttggagatgaataggggtttacatggggagggggctgagcatgatacatcatgtggagtaacaagtatgatgtccttgggaatctgtggtcagtggttcttttaacttgagcaaatgtaatagtggggcagggagggagaggttgggaataagattagaaaggcaggctgtagccagatttgtgtgccatactgaggaacttggatttcatcctaaagttgaaaagctagaagtaaacagagctggccctaattctgactgaaggtatgtcaggagcaggttttgcagaggaggtgaagttggaacttggtttttaaagatgagcaggagtttactagatgaagaaaggaagaagagcattccaggaaaggggaacttaacgagtaaaggcaggaggcaaaaaatatggcaactctgggagacatcaagtagggaagtatctagagaatagttatttcatctatgagatagggacaccagtaacatataccttcaatggctgatgtgaggcttgaaaaatatcctttgtaaaccatagagctgtgtgcaaatttctatagttgttgtgttatccagtttcttctaattttttgtcagtacccaacatgcatcaggccttctcaggtatagatccacataggcatacacctcagcagtttggcactggcttgatgagaggcatgccctcttttatctagccacttggtgtcttgaggaggcagaggtaagattagaagtctctgggaagtcactggtaagattagaagttgctgggtcccttgacaagggggctcatattctttattcttgtttatcctcagacactaggtttctcctcagataaaccagtataaatagtatgagcccccttgtcaaggggacctaggttcagaatagtcaaacacatatgaagcatcttctacatacaggcactgtaagggactgtgccttaaattatctccttttctccacattgtaactgtgaggtagtttgcattttacaggctctaggtgacacagtggtaagtggcagaaatgtgattcaagacattatctgtgaaattctttttcctctgtgacacttcataagctttgtgatttctctggatgttgaccaagctgcgtgatcagttaagagtggaaaactttgtgcagtctcaggcagtatggggatggaggagttggagagaaagttgcttggctctgtctttgggattgagtggtaacactttcctctgcatagaacagtggttctttccttcgaggaccaactctcttctatatatctgtctcacctagatgctttcaatatgtctgattaatctgtgtgtccttggatctcagcacaagacctgtcacatagtaactactcagtaaatattggttaggcaaatgaaagaacaaatggtgcttaacaaagccttctggaactcccaatgcctgcactattcttctgccttctcttgtgtagtacaatactcttaataggatattttgtccttaaggacacacacacacacacacacacacacacacacacacacagtgtgtatatatattttgtattgctcattgatgcataagcctaaatcccccctcttagagttgattagatgccaggagcttcttgggagaggcatgagtttgttttactctcttatattctttgtccctaagcctcttcccataccactgcccaaaggtgagtgtcatttataaggaacacgtgatgagctctaattctttttgccaagtctattgaagtgggtgttctattttggaaatggagtcctagaggttttcctgctgttgagtgtttggctgggtttgtgatcctctcagggtgtttgaaagccatgtatagggatggtagcatgagggaaaactgagcagtgaatcgaagttgccgtttgttcatggggattgtcagggagagagatttcctcagcacctgaagccagagcagagggtggatttattatatctagtccagggatcagcaaactgtttttttcgtgtagcctgcaaactaaaaatgatttttacatttttttctttcataattgagattttattggttgaggatcagtacaaacatttcaatttgtacacaattcttaacatacgtaccgaaaatctaaaaagccatgtattgtaattctttttttttaaagttattccagtgactttccagcttaaaatttggaagcaaattgtccttaagaggctatcaagtaccggtatgttcacatgttgataagctgttacatatgtcccaccaattcacaactgaatagcatgtatactacatattcaaatttttaatctttcacagcacagtaaccaagtgattaggaaaacaggactaccacaaccaaagatgttacagagtacacacaattctgacagggagagccatgatcaaggactggttttctttaggaaacaattctactaaaaaataacatgggaatagaagtaatttaaaatgttcaagacattaaatgcagggctgctgactccatattgtcatttaatatgcattgtattataggatataaaaactaacccccatctatggagtgttaagctgacagcaaagacagtcaaaacctcccataattcaataacccacactgttttctggttgtaccaaaaaataaacaaccagcgaatgatttcacctcttaaataaagcatttacacttaaaagatgggatgaggtgggattccctccttcttaaaaatgtttctagagctactaaaaaacttgcatttacaaaatagttgataaaaatattcctctggattgtacaagaagggagacagggaccactgataatgtatgatgtgtggtattattcagacttggcttccttctctcctgcctcatcagaggctggactctcctcagttttcttttccctgtttactgcaggtaaatgttctttagtttcttggttagccacttcggcctgttttccctttgctccccttttcccttttgtttgcacttgtttgtctgaagatttatcctttgctgctgcctttttcggcttcgcttccacttttgcaggagcaggtttagcagacaaccgcgccgatctcctcttgggctcttccttggcggccccttccgcggagctgaccttgctcttaggcatcctggcggcgtggagggtgcgtgcgggatgtctgtgagccgcggcgcaccgagagccttcgcgaagctgggctgcctggtcgctgccgctcctcccgccgcccgagctgctgagatccccagaaggggcggtgggagaaccctgatttttacattttaaaatagtttagggggaaagctaaagaagaatttcaagatgtgaaatttatatgaaattgaaatttcagtgtctgtaaagttttattggcatacagccactctcgttcatttacatattgtctattgctgcttttacacaagaacagcagagttgtgtagttgcgacagagaccatatggaccaccaggcctaaaatatttactgtctgactctttacagaaaaagtttatctggcctctagtctaacctatcaattttaaaaaaacagctttttggagaaagaattcacataccgtgcaattcacccatttatatacaattcaatgggttttagtatattcacagatatgtgcaaccatcacctcagtcaattaaaaacatttttgtcacctcaaaaagaaaccacatacgcattagctattgttctctctccacatttcccccagccctaagcaaccacgaatctactttctctttctgtagttttgcctattacggacatttcatgtaaattcaatcatataatatgtggtctgttgtaactagcttttttcacttagcatgttttcaaggtgcattcatgttgtatcagtactgcctgtacatgttcatgtatatatatctgtactttatttcttttcatgggcaaataatattctattgcatggacataccagttttgtttagcattcatcaatttatagacatctggtttgtttcactttttggctataatgaaaactgctgctatagacatgtataagtttttgtgtggacgtgtgttttatgttttgtttggatgtatacttttatttctcttgggtacatacatatgaatagaattgctgggtcatatggtaactgtgtttacctgttttaggaactgccagagtattttccatataaaaatggttcaagtggctaaaccatttttacattcctgccagcagtgtataagggatctgttctctccacatgctcatcaacacttgttattgtctgactttttgattacagtcatcctagttggtataaagcaatatctcattatgattttgatttacatttctctgatgactaatggtattgaacatcttttcatgtgcttaatggttatttgtatatcttctttagagaaatattttctcagatcctttgctcatttattttattttttattatttaaaaaaatttccatcttcattttatattcacggggtacatgtgcaggtttgttacaagagtatattgcgtgatgctgaggtttgggattctattgattttcttatgcagatagtgaccgtagcatccaatgggaattttttcagtccttctccctatccccactccttttggagatcccagtatctattgttcacatctttgtgtttgtgtgtacccaagatttagctcccacttacaagtgagaacatgcaatatctggttttctgtgtctgcattaattcacttaggataatggcatccagctgcattcatgttgctgcaaaatattttcatggtcaatatgtaccacattttctttcctttctttttttttttttttttttgagtcagggtctttctctgtcacccaaactggagtgcagtggcatgattccagctcactgcagcctcaatctcctgggctcaagcattcctcccacctcagcttctgagtagctggaactacaggcatgcaccactgcctggctaatttctttgtattgttttgtagatacggggttttgccatgttgcctgggctggtcttgaactcctgggctcaagctctcctcccgccttggcctcccaaagtgctggtattacaggcgtgaatcaccgtgcctggcctgtatcacattaattaatggcatctaggttgatttcatgcctttgctattgtgaatagtgctgcagtgaacatatgagtgcacatgtctttttagtagaataatttattttcctttgggtatgtatacagtaatggaattgctggatcgaatggtagttctatttttagtactcttagaaatctccaaactgctgtggccgggcgcggtggctcacgcctgtaataccagcactttgggaggctgaggcgggtggatcacctgaggtcggggttcaagaccagcctgaccaacatggagaaaccccatctctactaaaaatacaaaaaaattagccggtcatggtggcgcatgcctgtaatcccagctacttggaaggctgaggcaggagaatcgtgtgaacctgggaggcggaggttgcggtgagccgagatcgtgccattgcactccagcctgggcaacaagagtgaaactccatctcaaaaaaaaaaaaaaaaaaaaaagaaaaaaaaaaaaaatctccaaactgctttccacagtggctggactaatttgcattcccatcaactgtgtataagtgttttcttttctctgcagccttgccaacatctgtttttttgttttttttttttttttttttttagtttttaataataactttgcgtcctggtatggtggctcatgcctgtaatcccagcgctttgggtggcgggtggattgcctgaagccaggagttcgagaccagccagggcaatgtggcagaacttggtctctacaaaaaaaaaaacacaaaaattagctaggcatggtgatgtgtgcctataattccagctactcagaaggctgagacatgagaatggcttgaacccagtaggcagaggttgtagtgagccgagattgggccactgcactttagcctgggtgacagagtgagactctgtctcaaaaaaaaatttaaataaaataaaaaacctttacttatttttaaattgggttgtctttttggtattgagttgttaaagttctttatatattttaggtacaaatcccttatgagatacgtgatttgaaaatattttctcccattctgtgggttgctttttcactttcttggttgtatcctttgaagcacagaagttttaaattttgatgaagtccagtttatttatttttttgctgttgtttctgctcatacttttgaggtcatgtctgagaaaccattgtcaaatccaaggtcgtgatgacttacccctgtgttttcttctaagagttttaaaggcatctgaagcttaatgtgcactagatggattctaaatatcatctcatccaaaacctgctatatatactaccttcctcatctcagttgaaggcaagtccattgtttcaattgcctgggcaaaaaatattctaaataattcataatttttcctcaactccacatctattggtaaatcctgtgggttctccttttaaaacatatccaaaatagaatcatttctcactatcattccactgcaggcaccaagtctcaatagtctcctagcagataatcatgtctacatttattctcaatgtagcagctagagagcttttttgaaaaaaaaaaaaaaatgtaaaccagatcatttcactctcctcaaaacttcatttttttgtttggtgtgaaagccacagtctccacaaaagttagcaaggccctctgtgatctggtccccacttattctgatctcctctctgacttatattccccttgtcactcactgtagccacactctttggtgttccttcatactcttttatattcctgctttagggccttggttctagcttttgccgctgcctggactattgtttccttaggtatttagtttatgccctcatatttccatataaaatatactttgtggctgggcgtgatggctcaagcctgtaatcccagaactttgggaggccaaggtgggcagatcacttgaggtcaggagtttgagaccagcctggccaacatagtaaaaccctgtctctactaaaaatacaaaattagccgggcgtggtggcatatgcctgtaatctcagctactcgagaggctcaggcaggagaaatgcttgaacccaggaggtggaggttgtggtgagcagagattgtgccactgcactccagcctgggcgacagagggagactctgtctcaaaaaaacaaaaaacgaaacaaaaaccccaaaaatattctttgtcatttgtcatacttcatgttatcaaagagacctttcccagaccaccctatttaataatgaaatctgcacctctactccattcctggcacccagatcttcattatgaatcactttttaaaataatttttaagaacttatcatcatctggattttattatttaatcacttattgttttattatttattgcctagaatataaagttcataagggaaagggatctgttttgttcactgctatgtctccagtacctagaacagtacctggctcactgttggtacttttttgtatggattcaaagtactatctgggggggtcacttaaagagcttcctttagtatttttttgtaaggtgtgtcagttagcaatgaattttctcagtgtttgtttatctggaaatgtctttattttcacaagagttttgccggatgtacaattcttggttgacatcctctcacttcagtgagccctttgatcatgttatcccattgtcttctggcatccattatttttggtgagaagttaactgttaatcttactgggttcacatgtgtgtgatgagtcatttttctcttgctgctttcaaactttctcattgcctttgacttttagcgttttacttaatgtgtctatttgtggatctctttgcatttatcctatttggagtttattagattttctttatgggtagattaatgtttttcaaaacttgggaggtttttcagccattatttctttgaatatttttccttctcctttttctttctttttttttttttttgagacatagtctcactctgtcacccaggctggagtacagtggcacaatctcagctcactccaatctgactcctgggttcaagcgattctcatgtctcagcctccccaagtagctgggatcgcaggcgtacaccaccacacccggctaatttttgtatttttagtagagatgtggtttcgccatgttgtccaggctggtctttaactcctggccccaagcaatccacccactttggcctctcacaggtgtgagtctttctgctcctttttctttatcttccccttctggtattcatatattggtgtgattaatggtgttctacatttctctgaggctctgttcatttttcttcattcctttttctctatgtttttaggattgtataatctctatcagtctctcttgaagtttgctaattcttcctgctgccagttcagatctactatttagcccctgtcctaattttccacttcagttattgtacttttcaactccagaacatccatttggttctttttttaaaacaataatttgtctctttattgacattctttatttgatgcatcattgacatcatgcattcctttacctctttaaaaatcatgatttttttttttttaatctttggacatatttataatggctaatttgtagtctttttctgttaaatctgacatctggtccctcttactgagagtttctgttgcctactttttttctggtatatgggtcacactttcgtgtttctttgttttttgtttgtttgtttgtttgaagctgaacatttttgataatatattgtagcaactttgggtacttgtctgattcctctggggcttattattatttgcttgtttatttatttaatgactggctagattgtttaagtggttgatccccctcctcccacagtgtgaatcctctgatgttgctcctcagaggactttggtatgcccacagtcatatttggatgataatggtttgggcagaactttgactgtctctttccctggccacacccagctttttaggttcactaattgccatctggttgctctgctcttttcagcaatgccctgaggcataaattgcttcccagactaatccaactatattagggttcctttgaagggatagttcctgaggtcagtgtttgagatttgttcttttttggtttgtttttggagatagagtcccactgtttcacccaggctagagtgcagtggcgtgatcatggcccactgcagcctcaacctcctggactccagtgatcctcctacctcagcctcctgagtaattgggaccacaggtgtgtgctactacacctggcttcttttttttttttttttttaagttctgggatatatgtgcaggatgtgcaggtggcctggctaatttttaaattttttgtgaagatggggtctccctatgttgcccaggctggtgaaatttgttcttaccctgagagactcctcccagctgtctctttccctagttatctccagcaaattctctagtctacagtttagcctatatctccaatgaatctgctaatcttttcctttcaccacaacttctactcttttgagagtaccctacccttagtcttgaaattctctacactctgtcacagatgaggtcatttcccctgggaagagattcagatctctttgttttatagcctgcttcctcggccaggcaaaatctttgagtcacggttctggagctagggtgggggacaatgacatgcttctgagtgacaccaccactttaggagctgaggacttggtggaggggtggcagtagcctcaggtctttttggttttcttctcccagagtgtaatcaccatcttatgagccagggcaatgccagttgtggctccagtattcttagtggcactgcatccaaggtaaagctctcgtcctatgagtggggtttaaacgggacaaaagaggcccaccttttagctgcactcacttagaacttagcctcagtaacaggtagctgggggaaggatcagaaatgctaatatcctgctcaggacattccaggcagctaaccctttaacagggagcttgagagagaaggtctgtgtttagctgcatcagtgtgcagtggagtttctgtgtcattgagttgggagaggcaaggtggagaacaggtcttggtttaaatattgtggactctcgctgttcttagattttcttgagcatatgtttcttcattggctgtgtgcctttaagaccatttccagaaactttaaatggttgcttttgaaaaataagtttcactagttttactggagagtgggtctgtggagcttctcatgctgtcaaactagaagtcccttctaacccatcaattttgtaactgttctttctcatagtgcattttctccagtgctatgcattcagcctatataaatgtggcagtatttaccccaattaagaagataatctctttcctctggggaaatattttctaattagtgatctatttctgtcctcctttcataaaacaaaggttccccagacagtattctttggctagcttggatactttggttctgacagtttgtaagactggagatgttagagtttctctgtctttgccattctggccaggtacctggcaagctgaaacttttaatgctgcctctaggatttgacctgtgtcatgtgcccagtgttttggtggggcatcaacaatgattccatgacaagcactgagcgttctcattgacctcagagggattctctgtatctatgtatgtgctaggtgctggaaaaaaaggagtaaaaggaaaggcaatgttgctgcctttgaagaagttcccctagtggtggagatagccataaaacagataaggacactataatttattaagtggatactgtgaggcacaatggcgtgcacctgtagtaccagctacttgggaggctgaggtgggagaattgcttgagcccagagttcaagaccagccttagcaatatatcgaaaccctgtctctaaaaaaaaaataaaattttaagagtgaacactgtgatagagttgcagaagaggacgccctaagtcagcctttcccatgttatagtcactgacacataatccggatctcaacagatgactaggagtgataaggagaatgttttaagtgagggaatagcatgtacaaagatattgtacaggtgaaaagcctggtactgtcagagagttttaagtaattcattatcattgggaattgggaattcattatcattgggaatgagaggaagtggcaactgatgcactgaggaaggccagcccatagaggagggagggtcttgcataaagttgtaaagttttgattttaaatggagttaaagctttaaaagctttcaaagaatcatagagtagaacaaaaaggaccttagaggttagtagactacaatgtcttgtcttaactatctccattcctaacctcttgacacatggactttatatagcaagcacttagaaaatatccgttttctacctcctctataggtcttccttacatatgagggatcagcatcactgtaatagtgggccctaggattgtacgttcttttagtatctttaatccttcttaaaacatattacacacacacacagacaggagagcttattttgtgccaggcactattctaaggtatttagttgaatttactcatttatgcttccctcaacatgagggttgttaggttttgtgctactatcttcattttacaaatgatgcaagttatacactgaaactaagtggtggaacgaggattcaaacccaggcagccaggtctagaatcaaactctaaagtatcatgttacattgaatccaagctagtgtaactctctggctcctggctaaatatctttcttttagataggctgacaatttggggacctttttctttcttctattcaatagacaattatgtcttgactagctattgtaagctaagctctctgctacatgttataggacaaactcgagagacactccttcagttatttaataaccacacactctgctctgtgccgggccctcggcttggagatggatttatggagctaaattaattattcatttatgtattccagaaaatttacaagatgctggtgaagaataaatgataaataaaatatagtctctatttttgagttgcttagggagagtaagagggggataatgtataccctgagaactaagggaacaaataggatagggcaatgaactcacctgggagagatctagaaaacttcacagaaggcagtgactttttatttaatagacaaagagtgggagaaagcattttaaatggagcaccttgtgcaaaatcttgggggtataaaagatcatggtttggtcaaggagcatgaaatggcttgatgtgtctagagcaggcaactttttctgtaaaggattagatagtaattattttagactttgatagccatagagtctctgttacaaatactcaactctgtctttgtagcatgaaagcagccacagaaaatatacatcaatgcatgagcctggctatgtttcagtaaaactttatgaaaactggctgggcatggtggcttatgcctgcaatcccatcactttgggaagccaaggcaggaggattgcttgagtctatgagtttgagactagcctggacaatatggtaagaccctgtctctacaaaaaatgaagaaaaaattagcccctgtgcctgtagtccaagctactcgggaggctgaggcaggaggactgcttaagcccaggaggctgcagtgagccatcttcacgccactgcatttcagcatgggcaatagagggagactcagtctcaaaaccaacaaacagcaaactggatttggcttatggccatagttttctgacccaatatctggtgtgtaaggtgtctggtagggagggagagtggccaggaaggtacttaggaagttaatgtgtcatattgtaaaagaccttgaatgccaggccaagaagctagggctttatcttgtaggtaatggggagccatgagatgttaagtaagggagttggaatagatatttactttaagatcattctagagtgattgtggtggggggaggagccaagatggccgaataggaagagctctggtctacagctcccagcgtgagcgacgcagtagacgggtgatttctgcatttccatttgaggtaccgggttcatctcactagggagtgccagacagtgggcacaggacagtgggtgcagcacaccgtgtgccagccaaagcagggcaaggcattgcctcactcgggaagtgcaagggatcagggagttagttccctttcctggtcaaggaaaggggtgacagacggcacctggaaaatcgggccactcccacccgaatactgcacttttccgacgggcttaggaaatggcgcaccaggagattatatcctgcacctggctcggagggtcctacgcccatggagtcttgctgattgctagcacagcagtctgagatcaaactgcaaggcggcagcgaggctgggggaggggcgcccgccattgcccaggctcgcttaggtaaacaaagcagccgggaagcttgaactgggtggagcccaccacggctcaaggaggcctgcctgcctctgtaggctccacctctgggggcagggcacagacaaacaaaaagacagcagtaacctctgcagacttaaatgtgcctgtctgacagctttgaagagagcagtggttctcccagcatgcagctgcagatctgagaatgggcagactgcctcctcaagtgggtccctgaccccgacccccgagcagcctaactgggaggcaccccccagtaggggcagactgacaactcacatggccaggtactcctctgagacaaaacttccagaggaacgatcagacagcagcattcgcggatcatgaaaatccgtggttctgcagacaccgctgctgatacccaggcaaacagggtctggagtggacctctagcaaactccaacagacctgcagctgagggtcctgtctgttaggaggaaaactaacaaacagaaaggacatccacaccaaaaacccatctgtacatcaccatcatcaaagaccaaaagtagataaaaccacaaagatagggaaaaaacagagcagaaaaactggaaactctaaaaagcagagcgcctctcctcctccaaaggaacgcagttcctcaccagcaacggaacaaagctggacggagaatgactttgatgagttgagagaagaaggcttcagacaatcaaactactccaagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagcctcaggacccaatgcgatcaactggaagaaagagtatcagtgacggaagatgaaatgaatgaaatgaagcgagaagggaagtttagagaaaaaagaataaaaagaaacgaacaaagcctccaagaaatgtgggactatatgaaaagaccaaatctgcgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttcagggcagccagagagaaaggtcgggttaccttcaaagggaagcccatcagactaacagctgatctctcggcagaaactctacaagccagaagagagtggggaccaatattcaacattcttaaagaaaagaattttcaacccagaatttcatatccagccaaactaagcttgacaagtgcaggagaaataaaatactttacagacaagcaaatgctgagagattttgtcaccaccaggtctgccctaaaagagctcctgaaggaagcactaaacatggaaaggcacaaccggtaccagccactgcaaaatcataccaaaatgtaaagaccattgagattaggaagaaactgcatcaactaatgagcaaaatcaccagctaacatcataatgacaggatcaaattcacacataacaatattaactttaaatgtaaatggactaaatgctccaattaaaagacacagactggcaaattggataaagagtcaagacccatccgtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacatgatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatatacatttttttcagcaccacaccatgcctattccaaaattgaccacatagttggaagtaaagcactcctcagcaaatgtaaaagatcagacattataacaaactgtctctcagaccacagtgcaatcaaactagaactcaggattaagaaactcactcagaactgctcaattacatggaaactgaacaacctgcccctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagagctagaaaagcaagagcaaacacattcaaaagctagcagaaggcaagaaataactaaaatcagagcagaactgaaggaaatagagacacaaaaaacccttcaaaaaattaatgaatccaggagccggttttttgaaaggatcaacaaaattgatagaccgctagcaagactaataaagaaaaaaagagagaagaatcaaatagacgcaataaaaaatgataaaggggatatcaccacctatcccacagaaatacaaactaccatcagagaatactacaaacacctctatgcaaatatactagaaaatctagaagaaatggataaattcctggacacatacactctcccaagactaaaccaggaagaagttgaatctctgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcagtaaaatactggcaaactgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaactcttcatgctaaaaactctcaataaattaggtattgatgggacgtatctcaaaataataagagctatctatgacagacccacagccaatatcatactgaatgggcaaaaactggaagcattccctttgaaaactggcacaagacgggatgccctctctcaccactcctattcaacatagtgttggaagttctggccagggcaactaggcagaagaaagaaataaagggtattcgattaggaaaagaggaagccaaattgtccctgtttgcagatgacatgattgtatatctagaaaaccccattgtctcagcccaaaatctccttaagctgataagcaacttcagcaaagtctcaggataaaaaaaatcaatgtacaaaaatcacaagcattcttatacaccaataacagacaaacagagagccaaatcatgagtgaactcccatttgcaatagcttcaaagagaataaaatacttaggaatccaacttagaagggacgtgaatgacctcttcaaggagaactacaaaccactgctcaatgaaataaaagaggatacaaacaaatggaagaacattccatgctcatgggtaggaagaatcaatatcatgaaaatggccatgctgcccaaggtaatttatagattcaatgccatccccatcaaactaccaatgactttcttcacagaattggaaaaaactaaagttcatatggaaccaaaaaagagcccacatcgccaagtcaatcctaagccaaaagaacaaagctggaggcatcacgctacctgacttcaaactatactacaaggctacagtaaccaaaacagcatggtactggtaccaaaacagagatgtagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttataccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaactgacaaaatgggagaaaattttcgcaacctactcatctgacaaagggctaatatccagaatctacaatgaacttaaacaaacttacaagaaaaaaacagccccatcaaaaagtgggcaaaggatatgaacagacacttctcaaaagaagacatttatgcagccaaaaaacacatgagaaaatgctcatcatcactggtcatcagagaaatgcaaatcaaagccacaatgagatagcatctcacaccagttagaatggcaatcattaaaaagtcaggaaacaacaggtgctggagaggatgtggaataataggaacacttttacactgttggtgggactgtaaactagttcaaccattgtggaagtcagtgtggcgactcctcagggatctagaactagaaataccatttgacccagccatcccattactaggtatacacccaaaggactataaatcatgctgctataaagacacatgcacgcgtatgtttattgtggcagtattcacaatagcaaagacttggaaccaacccaaatgtccaacaatgatagactggattaagaaaatgtggcacatatacaccatggcatactatgcagccataaaagatgagttcatctcctttgtagggacatggatgaaattggaaatcatcattctcagtaaactatcgcaaggacaaaaaaccaaacaccgcatgttctcactcataggtgggaattgaacaatgagaacacatgacacaggaaggggaacatcacactctggggactgttgtggggtggggggaggggggagcgatagctttaggagatatacctaatgctaaatgacgagttaatgggtgcagcacaccagcatggcacatgtatacatatataactaaccggcacattgtgcacatgtaccctaaaacttaaagtataataataataataaaaaagattattctagtgtctaatatggtagatagactgacagaaaagagactagacgtacaaagataagtgagaaatgactgctgtatccctgccttgagcaacagcttctgatctcagtggaaacagatatttcactcatgaaacgtacatgtcctagaactctgtaaatgacatttagagctattgtacctgaaatatggtatgcttccttgctagatgttcaagaggtaaataagagttggtaaacttttcagatctggaacatgtgacttatgggtttgatatggcttggttctgtgtccccaccaaatctcgtgttgaattgtaatccccagtgctggaggtggggctgttaggagtgattggattatcggggtgatgttctcatgaattgtttaacaccatcccctctcagtattgaatagtgagtgagttctcatgagatctggtcatttagaagtgtggtagcacctccccctttgctctttcttcctcctgctctggctgtgtatggtgtgtctgtttccctttcaccttctgccttgattgtaagtttcccaaggcctccccagaagcagaagctgctatgcttcctgtacagcctgcggaatggtgagccaattaaacctcttttcttataaattacccagtctcaggtatttctttttttctttctttttaaaattttctttggcggagtctcatgctgttgcccaggctggagtgcagtggcacaatctcggctccctgcaacttctgtttcctgggttcaagcgattctccttcctcaccctcccaggtagctgggattacaggcacaagccatgatggcagctattttttatatttttagtagagacgggatttgaccatgttggccaggctggtcttgaattcctgacctcaagtgatctgcccacctctggttcccaaagtgctgggattacaggtgtgagccactgtgcccagccacaggtatttctttatagcaatgtaataatggactaatgtagggttctaaatattgtgggctggatgggggttggagagcagcagagaaagtgggaatggaggtgggacaatttggtttgggaaatatggaaggtaagtagtagggaacaaggttggaaaggggagggaagtgttattgattctaaggaagaacccaggaaagccatccagattgctgtacccaaaggtgtgctgctcttcttctggctttatgtcagtgaattctcttctctggtggatcaagctggctgggcctattttgtagaaattatagagagatgtctcccctcttctctgctcccactctcactacttcactactgcttgacacttgggatgggtttatgccatgtgccacctcctgggagatcatttttctgggcgcatggaactaaatatacttactgacagctggtagcttggctctttgtagaactattgagctgtatagttctagccaatgttgcattccccatggtaaggcaggactcttggggagcctccttaggtattcctgagagaagagctgcttgttctaagtctgaaatagtaaatccctttggtgggatccaaaagctgcctgtttagctttgttatcacctttcgttacttttaaactttgtcttaaatcagactttagctattagctggatgtgggacagtgttcaaagtaagatgtggtaatgcctacttcaagtatattgaacatcaaagttacagctcaatataatattcttgggtgctagtacccagcttgtggctgggtaactgggaacttccgttgagggtatatggtttggcaggggagatagacatctaataagactgataaaggtattcataggcactatgggagcacagaagaagtcacctttgatcaagaatctttttctgttactttcctgtccttatctcactctccttccaataataatctcaattaatatctgaattgtgctttcaaactcagtactttagtgtacaacaggaattacaaactgtgcccctgaagggtcagagggcattgtaagtgagtaatgtgggctgtataaatgcatgtgcataagtctgtgagtggtgagagctgtgggaaaatggagagcccacacctcttcagaaggagcagctctggcagactgttgccatgtagtcatgtactccaagagcagttctaagagataggggattgagacctccatagctcctttagcaccaactccccaacctttaagataccccaaattgtataacatatatatattcatactcatatataatatgaattatacatattttatatatagtcataggccacataaggacattcagtcaacagtgggccacatatgcaatgtggttccataagattataatatattttactatatcttttttatgtttggatatgtttaggtacacaaatacttactactgtgttacaactccctacaatattgagtacagtaacatgttgtacaagtttgtagcctaggagcaataggctatttcatataacctaggtgtgtagtaggctatacacatctagcatactctatgatgttgacacatgatgcatttcttagaatgtatccccatcatatgtcataagtgaatgacatataatgaaaccaattttaacagaggctaatttgttataaacaagggttaagttcctatggcatatttctggtcacaaaaacatcaccaaacttacaaataaagaccaaaacacttacaatatgaaacactgaaataaatgtgagctgtatatacatttaagaaagattaataaaaacaagtaagataattatttataattatttacctacttatttcagtttagggttgagagtgtccagagtttatgctagcagctcagggtgcaaggtgggcaccaactctggataggacgccatttcattgcatggcacactcacacacccacactcactcaggctaggaccatggagacatgccagttcacctaaaatgtacatctttgggatgtgggaggaaatcagagaatgcacagaaaacccatgcacacatggggagagcatggaaacttcacacagacagtagccccagccaggaattgatttttttttcattgacgttataaagaaatgacattgaaagaaatggtgttatttgaggagctgctgtatatatttattctttgatatggagaattgattttttccttaagtttaagtaaaaggttaataaaaacatcttcataaaaagttgcattttggctgggtgcggtggctcacgcctgtaatcccagcactttgggaggccgaggcgggcagatcacgaggtcaggagatcgagaccattctggctaacacagtgaaaccgcgtctctactaaaaattaaaaaaaaaaattagccgggtgtggtggcaggcccctgtagtcccagctacttggaaggctgaggcaggagaatggcgtgaactcaggaggcggagcttgcagtgagctgcgatcgcgccactgcactccagcctgtgcaacagggaaagagtgtctcaaaaaaaaaaaaaaagttgcattttaaaattaatttgtggccgggtgtggtggctcacgcctgtaatcccagcactttgggaggccgaggcaggcagatcacttgagatcaggagttcgagactagcctggccaacatgctgaaaccctgcctccactaaaaacacaaaaattagcatgatggtgggcgcctgtaatcccagctactcaggaggctgaggcaggagaattgcttgaacccggcgggcagaggttgcagtgagctgagatcatgccactgcactccagcttgggcagacagagtgagactccatctcaaaataataataataataataataataaataaagtaaaataaaattaatttgtaatgaataatcttcataaaaatagtgtgcttgctatgcaaatgcaacctcatgacaagtcccttagctctcactctccttttccaattaaattgttagtccttaagccactcctgtataaaattctaaagtcattggagcttactgtggctagatatttttatttttttgagacaggatcttgctctattgcccaggctggagtacagtggtacgatcacggcttaccgcaaccttaacatcttgggttcaagtaatcctctcacctcagcctcccaagtagttgggaccacaagtgcacaccaccacatgtagctaattttaaaattttttgtggagatggggtttcactatgttgcccagactagtcttgaactcctgggctcaagcaatctccttccacctcggcctcccaaagtgctgggattgaaggcatgagccatggagcccaacctgttttgatttgtttaaaagatagcctgagaaggtggacttttagtgaaattttctgattttttttttttttttgagacagagtctggccttgtcatccaggctgtagtgcagtggcatgatctcgactcactacaacctccgccttccaggtttaagcaattgttgtgcctcagcctcccaagtagctgggattgcaggtgtgtgccatcctgcctagctgatttttgtatttttagtggaggcagggtttcacagtgttggcctggctggtctcaaactcctgacctcaggtgatccacctgcttcagcctcccgatgtgctgggattacaggcatgagccactgcgcccggccaaaattttatgatttttaaatttaggttcaacttttcaaaatgctgtgcaggccagtaaaagacacacacaaaggcaatttatgacttctgcaaacttgtctcatttaatccttaccatacctgaaatgagggacattattaaccctaattttgagaggaaaataggctcagagaggcaaagtagcttgcccaaaagtcacacagcaagtaagtagcctgtttctatgggttctgcctttctttctttcttttttttattattatatattttaagttctagggtacatgtgcacaatgtgcaggtttgttacataggtatacatatgccatgttggtttactgcacccatcaagttgtcatttacattaggtatttcttctaatgctatccctcccccagcccccagcccccaacaggccctggtgtatgatattcccctccctctgtctgtatgttctcattgttcaactcccacttataagtgagaacatgtggtgtttggttttctgtccttgtgatattttgctgagaatgatggtttccagcttcattcaagtccctgaaaagaacatgaactcatccttttttatggctgcatagtagtccatggtgtatatatgccacattttctttatccagtctgttattgatggacatttgggttggttccaagtctttgctattgtgaatagtgccgcaataaacatatgtgtgcatgtgtctttatagtatcatgatttataatcctttgggtatatacgcagtattgggattgctgggtcaaatggtatttctagttctagatccttgagaaatcaccacactgtcttccacaatggttgaactaatttacactcccaccaacagtgtaaaagcattcctatttctccacatcctttccagcatctgttgtttcctgactttttaatgatctccattctaactggcgtgagatagtatctcattgtgattttgattttgatttgcgtttctctgatggccagtgaagatgagcattttttcatgtgtctgttggctgcataaatgtcttcttttgagaagtgtctgttcatattcttcacctactttttgattgggttgtttgtttttttcttgtaaatttgtttaagttctttgtagattctggatattagccctttgtcagatggatagtgcaaaaattttctcccattctataggttgcccgttcgctctgctgatagtttcttttgctgtgcagaagctctgtagtttaattagatcccatttgtctgttttggcttttgttgccattgcttttggtgctttagtcatgaagtctttgcccatgcctatgtcctgaatggtattgcctaggttttcttctagggtttttatggttttaggtcttacatttaagtctttaatccatctctagttaatttttgtataaggtgtaaggaagggatccagtttcagctttttacatatggctagccagttttcccagcaccatttattaaatagggaatcccttctccattgcttgtttttgacaggtttgtcaaatattagatggttgtagatgtgtggtgttatttctgagggctctgttctgttccattggtcgagatacctgttttggtaccagtaccatgctgttttggttactgtagccttgtagcatagtttgaagtcaggtagtgtgatgcctccagctttgttctctttgcttaggattgtcttggctatgcggactcttttttggttccatatgaactttaaagtagttttttccaattctgtgaagaaagtcagtggtagcttgatggggatagcattgaatctataaattaccttgggcagtgtggccattttcatgatattgattcttcctatccatgagcatggaatgctcttccatttgtttgtgtcctcttttatttcgttgagcagttgtttgtagttctccttgaagaggtccttcacatcccttgtaagttggattcctaggtattttatttgctttgtagtaattgtgaatgggagttcactcatgatttggctctctgtttgtctgttcttggtgtataggaatgcttgtgatttttgcacattgcttttatatcctgagactttgctgaagttgcttatcagtttaaggagattttgggcggagacgatggggttttctaaatatacaatcatgtcatctgcaaacagggacaatttgacttcctcttttcctaattgaataccctttatttctttctcttgcctgattgccctggccagaacttccaacactatgttgaataggagtggtgagagagggcatccttgtcttgtgccagttttcaaagggtatgtttccagcttttgcccattcagtattatattggctgtgggtttgtcataaatagctcttattattttgagatatgttccatcaatacctagtttattgagagtgtttagcatgaaaggctgttgaattttgtcaaaggccttttctgcatctattgagataatcatgtgatttttgtggttggttctgtttatgtgatggattatgtttattgatctgcatatgttgaaccagccttgcatcccaggatgaagccaacttgatcatggtggataagctttttgatgtgctgctgtattcggtgtgccagtattttattgaggatttttgcatcgatgttcatcggggacactggcctaaaattcttttatttgttgtgtctctgccaggctttggtatcaggatgatgctggcctcataaaatgagttaaggaggattccctctttttctattgattggaatagtttcagaaggaatggtaccagctcctctttgtacctgtggtagaatttggctgtgaatccatctggtcctggacttttcttggttggtaggctattaattattgcctcaatttcagaacctgttattggtctgttcaaagattcaacttcttcctgatttagtcttgggagggtgtatgtgtcgaggaatttatccatttcttctagattttctagtttatttattttatattttatattattttattctctttgtgtagaggtgtttatagtattctctgatggtagtttgtattcctgtgggatcggtggcgatatcccctttatcattttttattgcatctgtatgattcttctctcttctttgttgatcttttcaaaaaccagctcctggattcattgatttcttttttttttttttttttttttttttttttttgagacagagtatccctttgtcacccaggctggagtgcagtggcatgatcttggctcactgcaagctcctcctcccggtttcacgccattctcctgcctccgcctcccgagtagctgggactacaggcacccgccaccatgcctggctaatttttttgtatttttttagtagagacagggtttcaccgtgttagccaggatggtctcgatctcctgacctcgtgatccgcccgtgttggtttcccaaagtgctgggattacaggcatcagccaccacgcctggctgattcattgattttttgaagggttttttgtgtctctatctccttcagttctgctgtgatcttagttatttcttgtcttctgctagctcttgaatttgtttgccatttcttctctagttcttttaattgtgatgttagggtgtcgattttagatcttttttgctttctcttgtgggcatttggtgctataaatttccctctacacactgttttaaatgtgtcccagagattctggtatgttgtgtctttgttctcattggtttcaaagaacatctttatttctgccttcatttcgttatttatccagtagtccttcaggagcaggttgttcagttcccacgtagttgtgtggttttgagtgaacttcttaatcctgagttctaatttgattgcactgtggtctgagagacagtttgttgtgatttctgttcttttacatttgctgacgagtattttacttccaagtatgtggtcaattttagaataagtgtgatgtggtgctgagaagaatgtatagtctgttgatttggcgtggagagttctgtagatgtctattaggtctgcttggtccagagctgagttcaagtcctggatatccttgttaattttctgtcttgtttatctgtctaatattgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccatcatgtaatggccttctttgtctcttttgatctttgttggtttaaagtctgttttatcagagactaggtttgcaacccctgctttttattgctttccattagcttggtggatcttcctctatccctttattttgagcctatgtgtgtctttacacgtgagatgggtctcctgaatacagctactgatgggtcttgactctttatccaatttaccactctgtgtcttttaattggggcatttagcccatttacatttaaggtttatattgttaggtgtgaatttgatcctgtcaatatgatgctagctggttattttgcccattaattgatgcagtttcttcatagcatcaatggtctttacaatttggcatatttttgcagtggctggtactggttgtcctttccatgtttagtgcttccttcaggagctcttgtaaggcaggcctggtggtgacaaaatttctcagcatttgcttgtctgtaaaggattttatttctccttcacttatgaagcttagtttggctggatatgaaattctgggttgaaaattctttaagaatgttgaatattggcccccactctcttctggcttgtagggtttctgccaagagatccactgttagtctgatgggcttccctttgtgggtaacccgacctctctctctggctgcccttaacattttttccttcatttccaccttggtgaatctgacaattatgtgtcttggggttgctcttctcgaggagtatctttatggtgttctgtgtatttcctgaatttgaatgttggcctgccttgctaggttggggaagttctcctggataatatcctgaagagtgttttctaacttggttgcattctccctgtcactttcaggtacaccaatcagacgtagatttggtcttttcacatagtcccatatttcttggaagctttgttcgtttctttttacttttttctctcatcttgtcttcttgctttatttcattaatttgatcttcaatcactgatatctttttttccgcttgatcaaatcggctattgaagcttgtgtatgcttcatgaagttctcgtactgtggttttcagctccatcaggtcatttaagctcttctctacactggttattttagttagccatttgtctaaccttttttcaaggattttagcttccttgcaatgggttagaacatgctcctttaggtcggagaagtttgttattaccgaccttctgaagcctacttctgtcaactcgttaaactcatcctccctccagttttgttcccttgctggcgaggagttgtgttcctttggaggagaagaggcgttccagtttttggaattttcagcctttctgttctggtttctccccatctttgtggttttatctacctttgttctttgatgttggtgacctacagatggggttttggtgtggatgtcctttttgttgatgttgatgctattcctttctgtttgttaattttccttctaacagacaggcccctcagctgcatgtctgttggagttggcgggaggtccactccagaccctgtttgcctgggtatcaccagtggaggctgcagaacagcaaatgttgctgcctgatccttcctctggaagctttgtcccagagggtcacccgcctgtatgaggtgtctgtcagtccctactgggaggtgtctcccagtcaggctacacgggtgtcagggacccacttgaggaggcagtctgtccattatcggagctcaaacgctgtgctgggacaaccactgctctcttcagagctgtcaggcagggacgtttaagtctgcagaagctgtctgctgccttttgttcagatatgccctgcccccagagatggaatctagagaggcagtaggccttgctgaggtgcaatgggctccgcccagtttgagctccttgccactttatttacactgtgagcatagaactgcctactcaagcctcagcaatggtggatgcccctccccccaccaagctccagtgtcccgggtcgatctcagactgctgtgctagcagcaaggaaggctctgtgtgtgtgggacccgccgagccaggcacaggagggaatctcctggatctgccagttgcgaagaccgtgggaaaagtgcggtatttgggcagcagtgcactgttccaccaggtagagtcactcacggcttccctttggctaggaaagggaaatcccctgaccccttgcacttgccaggtaaggcaatgccccaccctgctttggcttgtcctccatgggctgcacccactgtccaaccagtcccaatgagatgaaccaggtacctcagttgggaatgcagaaatcacccgtcttctgcattgatctcactgggagctgtagaccggagctgttcctatttggccatcttggaagtccactgggttctgcctttctgactcttaaggcctgattgttgcagcttcatttctttattttctaaagaggtcccattcagcataagtaccttccttcaggtagagcttctatttgccagttcctcttttggcatcatcttctctctgaccttgttttctgaccctacttgttttttgtgtgttttgtggcaccagtagggtctgtatgtgagtccctatgcagatcttccttatactttctttctgagtttctctgctctccacttacctcggtgatcagacttgactataaaaatgagtctatttcttgttgatttcctataagcagctggtatctcatgtcagatggtttcctggagttatctgataatgggagaaaatccccttccttggagattttggtgtttctgctcccaaggcttgcttgtggtaactgtctttctagtcttagattaagaggttctaggttggagcctatgaggaccaaagaagggtatatcttgaagaacctgattaatcaaacctaaaaaatcatgaggatagcagatttgatctctaaaatatatcccaattctgacaaattctcatcacttccacagctaccaccttgtttcaaaccaccattagctcatgttattgcaatacccacctgagtgatttctctgtatctgccctttcccttttatagtctactttttaacacagtatccagagaaatcgttttaaaaatataaatgtcttcatgttatacctctgttcaaatccctgtaacagctcccatctcagagtgaaaaatcaaagtcttgataatagcctaaaaagtcagctgggtgcatggctcacgcctataatcccagcactttgggaggccgagacaggtggatcacctgaggtctggagttcaagaccagcctgactaacatggagaaaccccatctctattaaaaaatacaaaattggctgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaattagccgggcgcggtggcgggcgcctgtagtcccagctactcgggaggctgaggcaggataatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacaaacaaaattagccaggagtggtggtgcatgcctgtaatcccagctactcgggaggctgaggcaggagaattgcttgaaactgggaggtggaggttgcggtgagccaggtttgtgcccctgcactccagcctgggcaataagaatgaaactctgtctcaaaaaaaaaaaaaaaaaaaggcataaaagggggatctgtgttctggaaccctgtggcttctttgagttcatctcctgctggttaccaccttactcatttctctccaacgatactggccttcttgttattccttgaacataccaagtatattctcttgcctcagggactttgcttctgcccttctccattcttgggatactcttctcccagttattctgcatgcctttctcccacacctcttttaaatatttgctttgaagtcaccttcttatcttttgccttgttgcactcctgaaggcaaaatggatcacaagcagctctgctggagccacccacaaaaatctggccagagttctcgctcttgttgcatctgctcaaaccagcatggtctgatctggaaatatagcctcaatatgtgcctccagtgttgccatcagtacgtgaaggatataggtttcattaaattggactaagtgatcttccttgaatggattatccaaggcatccacacaatgaaaaatcatattagctgtttgtacataaaataaaaatgaagaaaatgaagtcagcttcttaatgacaccttgattcctctcattaaaatgacaaattgtgaataccactactcttggcatctcctattcctcttccctgctgtttttttctttatttaaattatattttatttaaaaacatttttaaaattttattttatttgtaactgatacataacagttgtacatattggccaggcatggtggctgacgcctgtaatccgagcactttgggaggctgaggcaggaggattgcttgagctcaggagtttgagaccagcttgggaaacatagtgagacaccgtgtgtacaaaaaatttaaaaaaatagctcggtaccgtggtgcacacccatagtccaagttacttgggaagctgaggcaggaggatcacccagcctgggtgacagagcgagacactgtctcaaaaacaacaacaacaaaaaaccccaccaaccaaccaaccatccaaaaaaattgtacatatttataggatacagtgtgatgttttgatacatgtatacaatgtataatgatcaaattagggggtaaaattagtatatctgtcatctcaaacatatatcatttctttgtggtgaacattcaaaatcctttcttctagctattttgaaatatacactatattattgttaactaaaatcaccctactgtgcaatggaacactagaacttataaacttaccctcccaactgtaaatttgtacccactgaccaatctctccccatctccctgtctacccttcccagattctggtaaccactatcctacgttctacttctatgagatcagctttttaagattccatatatgagtgagaacatgtggtatttattttttgtgcctggcttatttcacttagcataatgtcctcgaggcacatccatgttgccacaaatgacagaatttcattctttttttctttatggctgaatggtatgctgttgtgtaaatatacgacattttctttaaacattcatttgctgatgggccctgaggttgattctatatcttggctattgtgaatagtgctgcaataaacatggaagtgaagatgtctcttcaacatgctgatttcatttcctttggatgtgtaccgaatagtgggatttctggatcatatggtagttctatttttcatgttttgaggaacctccatactgttttatatggtgactgtactaatttacactgccaccaacagtgtgtaagggtttccctttctctatatccttggcagcatttgttatttgttatttttttggtaatagccatactaactggggtgagatgatatctcattgtggttttgatttccatttccctgatgattagtgatattgagcatatttttcacatatcttttggacttttttttttcttttttctctgagacaaggtctcgctctgtcacccaggctggagtacagtggcatgatcacaactcactacaaccttgatctcccaggctcaagtgatcctctgacctcaggctctagcttcagcctatagctgggaccacaggcataaaccaccacacctggctaattttttttttttaattttttgcacaggcggagtctccctatgctgcccaggctggtctcaaaatcctgatctcaagtgatcctcccactttcgcttcccaaagtgccgtgattacaggcatgaaccactgtgctcagtcttgtttgtcttcttttgagaaatgtctagttagatctttcacccattttttaatctgattttttttctattgagttgttcgagttccttatatattctagatgttaaccgcttgtcagatgtataatttgcagatgttttctcccattctgtaggttgtctcttcacttttcattgtttccattttattttgatttaatcccatttatctatttttgtattttgttgcctatggtggtggtggtggtggtggttgttgttgttgttttttggcagtgcagtgacgtgatattagctcactgcagcctccacttcctgggttcaagtgattctcctgcttcagcctcccgagtaactgggattacaggcatgtgccaccatgcccagctaatttttgtatttttagtagagatggggtttcgccatgctggccaggctggtctccaactcccagcttcaggcgatccacctgccttggcctcccaaagtgctgggattacaggcatgagccaccgtgcccggcccccagtacagtttattgaagagattgtcctttcctcagtgtttgttcatgcatttgtccaaaatcaattggctatacatatgtggattttattcctgtgttctgtattcttttccatgtctgtttttatgccagcaccatgctgtttcagttactattgttttggagaatattttaaagtcagatggtgtgattgctctagctttgttctttttgctcaagatggctttggctattcaggtttctttttggttccatatgaattttaggatttttttttctatttctgtcaagaatgtcactgaaatttagatagggattacattgaatccgtagattgctttgggtagtatgaatattttaacaatattaattcttccaacccatgtacatagggtatctttccatttatttgtgtcttcttcaatttagttcatcagtattttacagttttcattgtagagatcttttacctccttggttaaatttattcttaggtattttattattttttgtagctattgtaaatgggattttttttaatttctttttcagatttgtttactagctctaacagttttttggtggtgtctgtaggtttttctagatttaatatcatgttattggctgggcatggtggctcacacttgtaattccagcactttgggaagcagaggtgggtggatcccttgagatcaggagtttgagaccagcctgggtaacgtggtaaaatcccgtctctaccaaaaatacaaaaaattagccaggtggggtggcgtgcacacctatagtcccagctacttgggaggcagagatggaaggatctcttgaggcccaggaggtggaggttgcagtcagctgagatcatgccactgcactgcagcctgggtgacagaataagaacctgtctcaaaaaaaaaaaaaaaaaaaaagagagaagatcatgttgtctgcatgcaggggcagtttgacttccttctttccaattttgatgcctttcttctttccttccttcccttccttcccttcctttcctttctttcctcttgcctaattgctctggctaggactttcattactgtgttgaataatagcggtgaacgaaggcatccttgtctcgttccagattttagaagaaaagctttcaacttttccctgttcaatatattagatgtgggtttgtcatatatggcctttattgtgttgaggtatattccttctatacctaatttgattgcagagctgggggctggaatcaactgaagtctcagtcactcacatacctgactcctgaacttgaagactcaaacagctggggctactcacacatttctatctctacatagactttccacatgatatctccagcagggtggcttcagcgtagccaggcttcttacattttgactcagggcccctcagggcccaaaagagagagagctaggtgaaatttatattgctttttctaacctagacttgggtgtcgtgcaacatcactgttgccacattctatttgttagaagatgagtcactaatgtcagcctatattaaaggggagggaaatccacctttaacgggaggattatcaaacaatttgtggacatgttttaaaaccattacagtcggccgggtatggtggctcacacctgtaatcctagcactttcggagaccgagatgggtggattgcctgagctcaagagtttgagaccagcctgggcaatggtgaaaccctatctttactgaaatacaaagagttagctgggtcgggtggcacacacctgtaatcccagctactcaggaggctgagacaagagaattgcttgaacttcggaggtggaggttgcagtgagctgaaattgcgccactgcactccagcctgggtgacgagcgagactctgtctcaagacaaacaaacaaacaaacaaacaaacaaacaaccatcacagtaaattaacctgtctaaacctaatgtaatttggggcaaatggcattatcttcaagagtatcactgttctcatttataaaataagtgtgataattcattggttgtgaagatttgatgagaaaatattgtggaaattcttagaatattgcctaatttataagcaagtactcaaacattttaaattcttccttttttctttcctcttttagcttattgattttcagttaactgtcatgtattgtcttttcatagttaaaaaatatgaggaaaggatttctaatttatatatatttttcaagtgagacatgtaacaaagaggaagtgatagtttagttggcaactaagacatgtgcataaggaaggatacatgagtgatgtgatacacttgtatgttgggtagatggaatgtgttatggctagctagaggcaggtgacctgtgtggagatcttgacgggctgactcctaggtatctcttgtgacttgtgtacttttcccttgcagttcctgagggaagacctcaattaccatgacccaacagtgaaacacagcaccttccatggtgaggataagctcatcagcgtggaggacctgtggaaggcatggaagtcatcagaaggtaataggcagcctggtcatcaatcctagttgtgggaaggtttagagaagagagaagcagcaacttggccttagaagaacatgtatataaaatgcttagtaaagggcaaattattgaagttattctacatatagtcactaaaaaagactgaatatagtcactctgctgggcatgggggaaggttctccagagttggcgtttttcttcattaggatactttttgaattctatcctattcctacccctttcgtcacccacctaaccctggcataggaatcttccaggttctgctgctttatctccagagatagggagcttgctggtctcttgaggcagcccctttcttctctagcttcccacttagtcccagctctgctgagtcctagacaattcaaagattgggtgagggtacagacagactctctcctcttctataccatcttgattgaaagcttttctataccattttggttgaaagctcctgagtcttcttttttccaggttaagtagccctacttcttgaagaaaacattttctcagcctccttcttgtcttgatttcctgcctataagcacttttgttaatgtgtttcttagatcctatagttggctgcagacctccaagtgtgattttatcatcacggagttgagcaggactgtcaccttcttgtttctgaatcctgtgcatctgttagtgcagtctgattagattctggtgcctcactagtcataccactctactgacccatgttgagcttaatgaaaacttcagatttctgtaaaactgctaaaccatgattaccattttttttttctggagcatttccttcagagttcttagtgaaagagcatgtctaattgtgcgagacttgacagggaaggggaaaacagggctttagcttcctctccatttatatctgtggctagggcacagataacaataagactagaagaaatctctcttcccagggtctcttagggcaggttctgatgtaacaggggttaaatgtaagtaaccatcaggatccctggtttttatttgaggaaccttaggcctagatgtataaagttacttgtcattatcatgcatttagtagagccagaacttcagctgtaggccaatgcttttcaataccctcttggttgaaagcattagtctaaggtagagaagactagttttggtaggaatgaggcagtttctatttttatttacattttaatttaggcttatagaatttgagatctgaaagggataatctatattgtagatggggagcattaaatgtgaagcaggaagacctggattctaatcctgattatgggatggacaggctgatgcttcctgttaactctatgttttatcaatgtagaagaaaaattaggcagctgtaggagagagcttcctggatatctttggaagctgagttccttctgggggcttttctttaatagctctcgagcaactcaggctatgtactgatgaagattaagcagtgacatgagctttggaactataccagcggtgccaggaaaaaatcttccattagcatcatttagttttggctttcttatttttctctaataacatgaggacagggtggctggtttttaagagtgggtttcaaaagtaggaacttagaattaaagatggcagggagagcattctggccttttctgaaagctcgcatagaagtatctaggaaaggaaagtgagagggcagaaacagagggactaaatcataatgctagaaaacagctccaggcagttttctggcaaggactttatttttggacttagcaactatttggaacacttccagtgtattctaaattacaggaaaatgaaagacaatggagtgaggttttttgggggagagtcctcattaaccatgagtggagaaaagcatttcaatgcagtgatgtagttcacagctgagaaatgatatatatgtaccctattagaatttgctcactgtgtgttatacctggtgatttgacagactaaaagtgagaatttttatatgtcctcttcctcccaataatttgcttcattattcagaaaaaggcccctaatctctccggagtgatgatttccagagctacaaaaagcatttaatattctggcaccggctcaaactagctgttctgagtttagctagatgatgtagatgtcagcagtggtcacttgtgttcagaacattagctggctagtgtcagtaccatctgtgtgattagcattgttaacatttttctgactaatgttgggagccagtcttttctctgtgttatatagatcttagcagaaaagttttctaatctctatcttagccaactctgggctttaggaataaaaacagcagcagcaacgacaaaaactgaaaaactactttaacatttatatagtatttaatatgtgctaggcactgtttctaagtgttttacatatattaacttatttctcacagaaaccatatgaagtatagatattatgattatacagagttagcacagacttcacaagttaagttcacagcccccgataagattactctcacttcagacatcagccataatttcaagctgttcccaggtcacctgcacttctgaccagctgactacaattcatgcattaccatggccttctcaggtttgataattaactaggactactcagagaattcaagaaagccctatacttatgattacaattttattataaaagttacaaatcaggaccagccaaaagaagaaatttatagggcaagatattggagggtcctgaatatggcacttttgtgtcctctccttgtggaatcaggacacatctccatttccagcacatcagagtgtttgccagccaggaaactcaactgaactttggtgttcagtgtttttcttagggtttcattacataggcaagtttgattgaattcttaggcacatgattgaacttaatatccagctccctttttctccataaaggttggattggtatcaccaggctcagagccccaatgttctagtcacgtggttgatttttatagtgaccaccccccatcctgagtcatcttatcagcctgaactcatgtgtgatccaagggacccaccaggaataataaagacattcctatcactgggaatattccaaaagttcagtgggtacctcccagtaacccaggacaaagatctgccaaattctttattatacaacattgaataattaagtatggaagaactggtaaagcagggttgaagaaggaccaagaatgagggccactccaggaaatccagcagcagagactaggggattcgccttttcttttttttcttttttcttttttttgagacagagtctcactctgtcacctgggctggagtgcagtggcgcaatctcagctcactgccacctccgcctcccaggttcaagcgattctcctgcctcagcctcccgagtagctgggactacaggtgtgtgccagtgcgcccagctaatttttgtatttttagtagagacggggtttcaccgtgttggttggccaggatggtctcaatctcttgacctcattatctgcccacctcggcctcccaaagtgctgggattataggtgtgaaccaccgtgcctggggaattggccttttctaattagctactttcatatgacccagctttattcattttttatttctaagtgtctttgctcaagagtcagatatgacaagagaagaatcagattggcgtagtgtggattacagatttaaatagggtgttgatggtgggagtgtgtgtgtagggtttggagagagctgcaatttccagcccctacaggatcatatgaggttagaggagtggcagttctttaaaggaagggtggctgggtagttttgtagaatccttgagaaatagaattactgcttgcatatttgagccattggaaacaataacagtgtcatttttggagaagaatgatgggaggcactgacctaagggaattctcctctaaccatggctttcattttttctaagcaaagtgcatcgttactgtttctcttctcctttcctggacactagattttaaatgatgctatctgccaaacaaagtatatttcttcttttgagacagagtctcactctgtagcccaggctggagttcagtggcatgatctttgctcactgcagcctctgcctcctggattcaaggcttcttttgcctcagcctcccgagtagctgggattacaagtgtgcaccatcacgtccagctaatttttgtatttttaacggagatggggttttaccatgttggctaggctggtcttgaactcctgatctcaagtgatctacccgcctcagcctcctaaaatgctgggattacaggcgtgagccactgtgcctggtgaatatttctttttttttctttctttttcttttctttttttttttcgaggtggagtcttgctctgctgcccaggctggagtgcagtggaatgttctcggctcactgcaacctctgccttccaagttcaagagattctcctgcgtcagcctcccgagtagctgggattacaggcgtgaacccccacgcccggctaatttttgtatttttagtagagacggggtttcaccatgttggaccaggctggtctcgaactcctgactataggtgatccgcctgcctcggccttccaaagttctaggattacaggcgtgagccaccacacttggccagtatttcttaagtggtaatttctttcctcgtttttatgaatcaagactttgtacctatcaatctttgattctatgaaatatgattgcagctgaaagcaaaagaacctggtagtctagtgtgcctgtggactttgccatagtagttgtttccaaaagtttttgtttccaaaagcctggtagaaaataaacattacagactgggcgtggtggctcacgcctgtaatcccagcactttgggaggctgaggcaggcagatcatgaggtcaggagttcaagaccagcctggccaacatggtgaaaccccatctctactaaaaatacaaaaaaattagccaggtgtggtggtgggcacctgtaatcccagctgctcgggagattgaggcaggagaattgcttgaaactggaaagcagaggttgcagtgagccgagatcacgccatggcactccagcctgggcaacaaagagcgaaactccgtctcaaaaaataaataaataaataaataaaataaagtaaacattacagtaagtaagttcacagatctccttttctgtctgtgctactctttggacgatagaatttctctgcaggaagcagtggagtagtacagcaggttcctgaataacgtcacttcattcaaccttgtttgattataatgctgttgaaaattaaaaaattgcttccttactgggaccattgtctctttgtggagtttgcacattttctccatgtctgcacgggctttctccaggtatatcagtttcctcccacatcccgaagatgtgcactttaggtgaattggtgtgtctaaatggtcccaatctgagtgagggagagggagagagaggagggacggaaggagggtgggcggggtgggggtgggagagagagacagagagagacagagtgtgcgtgtgtatgtggtgtgtgcgtatgtgtgccctgcaatggaatggcatctgattcagggttggttaccacctggcaccctgagctgccgaggataggctccagccactctcaaccttgaactgaagtaagcaggtaaataattatcttacttgctttaatcttccttaaatgtatgtacaggtcacgtttatttcattgtgtaatattaggagtgttttggtctttatttgtaagtttggtgatgtttttgtgaccagaaatatgccataataacttcacccttgtttatatcaattagcctctggtaaaattggttttgttatacatgcttttgcttaaagttgcagtttccaacaaaccattgatgacattaattgaggacttactgtactggagagctaggaagcctttagaaagaacatccaggccgggtgcggtggctcacgcctgtaatcctagcacttttgagaggctgaggcgggtggatcacttaaggtcaggagttcaagacctgcctggccaacatggtgaaaccctgtctctattaaaaatacaaaaattagccaggtgtggtggtgggcatctataatcccagctactcgggaggctgaggctggagaattgtttgaacccagggtatggaggttgcagtaagctgagatcgcaacttcactccagcctgggtgaaagagtgaaactccatctcaaaaaaaaaaaaaaaagaaagaaagaaagaaagcacccagcagagctgctgacctctctgttgacacaacacagggaggccaggtggcatcagacttctgtctaaaccatttcaaaagtcagatccgtatgaaagagctggcagcccatttttgcttttacataaacctaatgagagatatgtttagtattttcttttagtcattaaaaaaattatttttctaagttaaccatcaagtcatttagttaaaaacctcagacattagttgtttgctgctgtattttttggaagaatcatacagttggctttttctttcccttacattctttcagataatttttgtatactgataataaaaacaactagcatccatgtagtgatttaacttttatcacagtcattttatatttattttaaatagacacttgaggataaaaagttttacttgtattcccatttaataaataagaaaactgagtatctctcacccgagggttctacctgtttaatatatcttatgtgcatctccgatgatactaccttagctcaacttcattacctttttaaaaagatatttattgagttgcaattgacatacaaaaaggtgtaaatctctaaagtttactatttttaagattttggtacatgtatacaattgtgaaaccatcactgcattaaagatggtgaatatattaatcacccctgaaagttttctcatagtcctttgtagtctctgctcccctagcaaccactggtctgctttctgccatagattagtttgcatttgctacagttttatgtaaatggagttatataatatgtacttttaaaaaataatctggccactttcactcagtgtaactattttgaggttcacttatgttttgcatgtgtaaatagttaacttgtttttattgcttagtagtagtccattgtagagacataccacaatttatttacctatttagctactgggagacattgagctgcttttagtttttggctattacaaataaagctgctatgaacattcacatgtaagtctgtatggacatatattttcttttctcttaggtaaatacctaggagtggaatgactagatgatatggtaggtatatgtttttaagaaactgtcaaactgttttctaaaatagttgtattttttatattcccaccagcagtatatgacattttcagttcttccatatctttacaaacacttggtatggttggtctacttaattttagccattctgatagtataatgatcgtggttttattttgtatttgcctaatgactaacaatgttgagcatccttttatgtacatgtttccattcatatctcttttttggtagagtatctgttaaatcttttgtctgctttttattgggttgtttttctaaattgagttttgagaattctttatatattctccatttaagtcttttatcaaatatatactttgctaagattttctccagatctgtggcttgtcctatcagtcttttaacagtgtcttttgaagagcagaaagttgtaattttgacgaagtccagtttatcaatttgttttttaacagatcatgcttttggtattgtatctaataaatctttgcctaacccaggatcacacaaagatttctttctgtttctttctagaagttttgtagttttatgttttacatttaggtctataattcattttgtattaatttttatatgtggtgtgaaatatggaacttacttctttattgtgcttacacgtggtcccaattgttctagaaccatttttagaaatgctgttcttttcttcattgcgttgccacacctctcatcttttgtcaaaaatcagttgtttaagctgagtgcagtagcatacactgtagtcccagctattcaggtggctgaggtggggtgggtgggtgaaaactgcttgagcccaggagttggagtccagccagggcagcatagcaagaacctgtttctaaaaaacaagcaaacaaaaatgcctcaagttgtttgtataagtgtgagtttatttttggactctattatgatacgctgatctatctgtctgtctttatgccagtaccatgctattttgattaccatagaattataataattctttcaatcaggtagtgttagccctccaactttgttctttttcaagttattttggctgtttcaggtccttgaataaacctgtcaatttctacaaaaaagcctggtgggattttgaataggattgcattgaatctatagatgagtttgagagaactgacatcttcaaaatactgatgttctttcaacccataaacaaagtacatctctccatttatttaagagatacactttctctgggtactattttttggtctttcacatttagaactttcacatcttttgtcagatttatcactaagtagttcatagttttttatgctgttgtatatggtattttttaaaatcatggtaaaatacatataacaaaatttactatgtaaatggtattttaaaataatttctgattgttgcttatatacagaaatgtaattgatttttatatattgattttatattctagacatgaagtccttgcccatgcctatgtcctgaatggtaatgcctagattttcttctagggtttttatggttttaggtctaacgtttaagtctttaatccatcttgaattgatttttgtataaggtgtaaggaagggatccagtttcggctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctattttggttactgtagccttgtagtatagtttgaagtcaggtagcgtgatgcctccggctttgttcttttggcttaggattgacttggcgatgcgggctcttttttggttccatatgaactttaaagtagtttaaactaaaaatgtatattctatgaagtgctaaactcatttagtagatttcatcacatttttttccatagacagtcatgtttatctgccaataaagacagttttacttcatttccaatctgatgctttttttttctttttcttgcctgattgccttggatagtatttctagtacagtgttgaagagaaatgaggtgagcagatatccatgtttcatttctaatctttttttttttttgagtcggagtctcgccctgtcgcctaggctggagtgcagtggcatgatcttggctcactgcaagctccgcctcctgggttcacaccattctcccgcctcagcctcccgagtagctgggactacaggtgcccaccactgcacccagctaattttttatttttatttttagtagagacggggtttcaccgtgttagccaggatggtctcgatctcctgacctcgtgatctgcccgcctcggcctcccaaagtgccaggattacaggcgtgagccactgtgcctggctgtttctgatcttagaaaacattcagtctttcaccataaaatataatgttgggccagatgcggtggcttatgcctgtaatcccagcactttgggaggctgaggtgggtggatcacgaggtcaggagtttgagaccagcctggccaacattgtgaaacctcatctctactaaaaatacaaaaattagctggttgtggtggcgggcgcctgtaatcccagctacttgggaggctgaggcaggagaatcgcttgaacccaggaggcggaggttgcagtgagccaagattgtgccactgcactccagtctgggcaacagagtgagacactgtctcggaaaaataaataaataaaataaaataacaaaattatatatatatataatgttggctgtgggttttttgtagtgcctctctactcctagtttgctgagagcctttatcaggcatagatactggattttatcaaaggagttttctgtgtctattgagatgattgcatggtttttctgtttgtttgttaatttgataaattacagtgactgagttttgagtgtaaagctaaccctgcattcttgggataaatccccttggtcataatgtattatcctttcactgtattgttggattagatttgctaaaattttgttttaaatttttatgtctttgttcatgaaggatactggtttgtagctttcttaaaatgtctttgtttttggtatcaggataatgtttgtctcataggatgaattatgaagtattcctcaagtttttttgaagagttcatgtagaattggtattattttttcttaaatatttgatagaattcagcagtgaagctaactgagcttagagttttctttgtgggaaggtttttaattatagtgtcaatttctttaataggtataaggctgttcaggttatctatttcttgagtgagcttaggtactttgtgtctttcaagaaatttgtctatttcacctgtgttgtcaaatttactggtatatgttaataaaattgccttattttaatgtctgtaaaatcagtaataatgtctcattactgatcttaataatttgtgtcttcttttctttactgattggtcttattagatctttgttaattttacagaaccagtgtttggttttattgatttttctctggtttctatttcattgatttccactttgatctgtattattttctttcatctgctactttggatatcatttgctcttttattttttagtttggtaaggtgaaaactaaggtcaccagtatgagacctttcttcttttctaatacagaatttagtgctgtaaatctcccttaactactgctttagaggcatgtcccaaattctggtgtattgtgtttttttttttttttcctcttttccaactgatttattagtagcgcagacgaataaaaatacctagagtgaagacacaattaatggcaaatgttctcctattactttttttcctgatataatcttcaataacttagtatcccttaataatatgttctaatttgagagattctttttgccctggaaatgcatacctttaaaatctgttttagaccttagatccatccgttattggtttatcattatattggatgaaatgttgtgcttttttttttgacttagctcaaaatattttatatttcctttttgacatctttagttcacaagttatttagaagcaagttatttagtttccaaacatttggagattttttttagacttttttagttattgatctctaatttaattccattgtgatctgagatcatactttatgtgacttgaagcctttaaaaaattttaagatttttttctttcatgtcctaggacatggtctatcttgttaaatatcccatgtgcacttgtatgtgttctgttgggtggagagttctataaatgtcaatcaggtctgtttttgttgttttgcttttttttttttttttcaacttttaagttccagggtacatgtgcaggatgtgcaggtttgttatataggtaaatgtgtgccatggtggttttctgcacagataacccgtcacctaggtgtttagccctgcagccattagctgttcttcctgatgctttcgctcctcccactcccctgacaatgtatgttgttccccctgatgtgtctgtgtgttctcatcgttgagctctcacttgcaagtgagaacatgcactgtttggttttccattcttgcgtgaatttgctgaggataacagcttccaactctattcatgtccctgcaaaggacatgatctcgttccttttcatgggtgcatagtattccatggtatatatataccacattttctttatgcagtctttcattgatgggcatttgggttgattccatgtctttgctattgtgaatagtgctgcagtgaacatacatgtgcatttatctttataatagaatggtttatattcctttgggtgtatacccagtaatgagattgctgggtcaaatggtatttctgcttctagatctttgaggaatcaccacagtgtcttccacaatggtgaactaatttgcattcccaccaacagtgtaaaagtgttcctttttctctgcaaccttgccagcatctgttgtttcttgactttttagtaattgccattctgactggtatgagatggtatctcattgtggttttgatttgcatttctctaatgatcagtgacgttgagcttttttcatatgtttgttggtcgcatgaatatcttcttttgagaagtatctgttcatgtcttttgcccactttttaatggggttgtttattttttctttgtatatttgtttaagttccttgaggactctggatattagacctttgtcagatggatagattgcaaacattttctcccattctgtaccattcaggacataggcacaggcaaaagtttcatgatgaaaatgccaaaagcaaatgcaacacaagcaaaaactgacaaatgggatctaattaaagagcctctgtatagcaaaagtaactatcatcggagtgaacaggcaacctacagagtgggagaaaatcaggtcatgttggttgatggtattgttcaagtctacatatctttatcaattttccacctacttgttctatctttttcctttcttttctttctttctttcttttttttttttgagatggagtctcgctctgttgcccaggctagagtgcagtagcatgatctcggctcactgcaacctccgcctcctgggttcaggcaattctcctgcctcagcctcctgagtagctggaattacaggtgtgtcccaccatccctggctagtttttggatttttagtagagacagggtttcaccatgttgactggtctcgaactcctgacctcaagtgatctgccttcctcaacctcacaaagtactggaattacaggcgtgagccactgcatccagcctgcatacttgttctatcaattgttagagaggagtatttaagtttccagttataactgtggatttgcctatttttccttgtagtttctggttcacgtattttgaagctctgttactaggtgcataaagatttaggatgattatttcttagtgattaactgaccccttcaacattatgaaatgaactgctttatccttcgtggtaatctttgctctgaaatctactttgataaaaatatagctgtcttttgactgttgttagtttggaatgtctttttccatccctctacatttaatctatttgtatttttatatttaaagtacatttcctgtaggtgcatatagttgggtcctatatatatatatgtatattttgcaatgtgacaatatctgttaattgcattatttagaccatttacgtttggtgtgattattaatatgattaatcaaatatgattgatatgattattaatataagataatttaggttagtccattttcttgctatttgttttccgtttgtcccatctgttctttaattccttttcctaccttttctgctttcttttgggttaattcagtattttttataattcaattgtattttctttgttggcttattagatataactggtattttagtggttgctttaggagataaaagatatgtatctttaactcatcacagtcttttttttttttttgagacagagtcttgctttgtaacccaggctggagtgcagtggtgtgatcttggcttactgcaacctctgtctcttgggttcaagagattctcgtgccccagcctcctgagtagctggaataacaggtgcatgccactacgcccagctaatttttgtatttttaatagagatggggttttgccatgttggtcaggctggtctcgaactcctgacttcaggtgatccgcctacctcggcttcccaaagtactggtgttacagatctgagccactgcactgggcctactttcaagatatattataacatgtcacatgtagtataagaagcttccagtagcacatataccctaaaacttaaagtataataataaaaaaaaaaagaagcttccagtagtgtattttcatttccctctctcaagcttagattttaatccttgcactgtggcttggaaattcaaggccataagctggggcaattgtataacttccctcatttgtttcctatctctcaagagtcattgtcctttgtaggctgatgtccagtgtcctgaaaaccattatttcatatatgttgtcttttttgggaggggtaattttaattcaggagggagggtaaattccatctctggtacttcagcttaccctgaaacagaagtgtcagctgaatcttcttttgcttgggccgttgttcttcatataccattattcttggcccagcctagctctactgctatgtatctttcacttggttccagatctgacgaggtctttgcttacatttttcagagttttcccatttttctctcatacatgaaacaaacaagttagggcatcaaatttctgggtgtaagaaatattctcaaatggaagttggagaaataaagatactgttaaaaatgttacaagtaaatacctgtatagcaataaatagtaatcatgttattttgaaagaataaatactggctttcctattggtcggataacccttcagcttgtgtaggagtagcgataagcttagatcacaactgctgtctcatttgagactcaacagaataagatatccaaagcttagtaatttttgatgaaaaaaaattatagaaaatgttggctctgtgtggtgactcatgcctgcaattccagccctgtgagaggatcacttgagccccagaggttgaggctacagtgagctatggtcatgccactgtacttcagcctgggtgacagaatgaaaccctatctctgaaaaaaagaaagaagctgggcgtggtggctcatgtctgtaatcccatcactttgggaggctgaggcaggtggatcacaaggtcaggagttcaagatcagcttggccaacatggtgcaaccccgtctctactaaaaatacaaaaattagctgggcatggtggcgggcacctgtaatcacggctactcgggaggctgaggcagataattgcttgaacccaggaggcagaggttgcagtgagctgagatcatgccactgcactccagcctgggcaacagagtaagactccatctcaaaaaaaaaaaaaaaaaaaacgaaagaaagaaaatgtcagtgatttttttttcatgtttatctgtgagatgttagtcagatgtattgaaattaaatgtccatctgtaatctcaaaatgaattaccttatctgggagaaaagagtaatatgtacacataaataaaaatctgatgatattttattttattatattgtactttttgatggtgtctcactctgttgcccaggctggagtacagtggcgtgatcttggctcactgcaacctctgcctcccaggttcaagtgattctcctgcctcagcctcccaagtagctgggtttgcaggtgcccacgatgacgcccagctaattttttgtatttttagtagagatggggtttcatcatgttggccaggctggtcttgaactcctgacctcatgtgatctgcctgcctcggccttccaaagtgctgggattacaggtgtaagccaccgtgctcagccctgatggtattttatatcttgagagtttatttatattttaatgctgtagttctctgttattccttatctacctctgtggtattggccctagaaggtagtgtttttctcctataatttatgtaaacatttctgtgttaaaaatttactgagtaccttctatatactaggcattgtgctagatgagtttagcatacaaggtccatgcttatttctctgatctacttgttttccatcattccacaccacatctcctctggaagtgcactgctttattggcagttcctaggaaatgttgttctttttcatcccatggtgctttcatatatgctgtttcctctattcatctttctcatttgttgatctgtttaaaactcaattaatcatttctttaagtcttcttccctgaaaaccacaggctaagttaggtgtcttcttctgtgttcccacagcccctatctcttcacagcccttagcacactaaatgcaaagatctgttccactgccggttttcccatcagactactggagtgcagcattttatatgattttatctcttaatacttagcacagggcctggcccagagtaggaatgcagcacacaaaaatgtgtccttgactgtttgattgtgtgatcttagataagttgtttggcctacccaacatttcatagcacctaggttctcttactactctgcagccatgctgccagacttctctaatctgtctctactaaccttgtggtttctctcttggtggtctttaatagcatgtcctgttgggccctgggagacctggtttttgcctggtagcctagtgagcctatcacatgaggcctaggccagattatttttgcaatgatggttcagggtttgataatgacatcagattagaaaatgaagacctttacctcactgtagtcccagatgagaagctgctagtgggaaccagaaggaagctacttaaagagacaattcacagttccaggtcacacactatctttaggaagggccactttggaaggatttgatagctgccttggagtgctgttattcagagcagaccaataagaagctgggttttgtgatgccttttctgattctgtcagtcactcctttctctgtgctcccacatcaccttatatatccctgtgacctagcatttatcacactatattatattcatttgtttccttgtatattcccctctctagaagagagcccttgaggctggagttcatgcatattcacctctgtgctggttaactcaccctttacctgctagagtagaagccaataaaagcttagtgaatgaatgaataaatgaatggcgataataattatagatgattttttttacacttatagtatgctaggagcttccctttactacatttttatgatgtgaaaactctgattttcatcattttggtggtgaaaaaaatgaggcacaaaatattaagtaatttgcccatggtcttacatctagtaagtggcagattgcaaattcaaatcaagacacctggtttcaaagttcacattcttctttttttttttgagatgggatctttgctatcactcagggtggagtggtgcaatcttggctcactctagcctcaactccaggtgatcctcccacctcagcctcccaagtagctgggactacaggtgcgcgccatcacacacagctaattttattttttgtagagacgaggtctcactttgttgcccaggctggtcttgaactcctggcctcaagtgatcctcctgccttggcatcccaaagtattaggattataggtgtgagccaccgtgcttggccaaagctcacattcttaaccactgtgctatatctgactagctgactaaaggctaagtgaccaactaactaacagctgtgtgaaggaggggcaaagaaagtactggcaaccttcctgccagacctcattctcttgagatgtggatttgaaaccacaaaagtagatgagggcttcgtctggaggcaccacaggtccattatgggaaagagatactgattcgggaatccatttactattattccttccctgccaagagaaaagattggccaaggccaagtgtttgccctggcacatccctggatgtattgctatagctcaagtgctagggagtatactgttccttctgcctggtatgcccttcccccaaatgtccacatgcctcataccttttatttcattttctgctcaaatatcacttcatcagagaggccttccctaatctgacctaatacaatataggactattttttatccccttaaccccttatggcttaattgttctttattatacttatcaccatctgacatataattatttgtttatagtgttttattttgtctccctccaccaaaatataagcaccatgggatctgtgactgttttgtgtattgttgtatctttactcctagagtggtgcctggcaagtagtagctgctcaataaatgttttttccccctaatgaatatattattttggagtttgagaccacttgttttcaaggacctttgtcatttggtgtcagcaatacctcattctccttgaccctatatataactcttggactccagacaaactagagtcagtgttctctgagcatgcttcacatcttatagctctttgtctttgttcacgattctttcttctggcagatctgcatctctgtccatccagattctgaccagtccttaatatctacccctttttgaatgaaggtacatatgaagaaaaagttactactgagtttgtattaaatcctaggcatctcaaacacattaactcatttaattcaacaactctgggagacagatattgctaaattgtaagctacatgggagtagggatctctctcttgatcaccgctctattcctagtgcctggtctcagaatagaacgaaataaatgcttgttgaatagcaaaatgaatattttacagaaggggaaattgaggttcataatggttaagtgatttacgcaagctagttcatggcagataggataggcaaggtcttccagcttcaaattcagtgtttttttgtaatatatcctaaaataaaaaatcagtgttctaaaatgccaggggtttggcagtctttaataactttagtttttgtagctacctcagaataaaacaggaggttttattgatttttacatgaaaattgttcttaatcataaaaggtctgttcctttctataaaacatagtatggagaccagggtatatctttactacccaagatgctaactggacaccagtttctgggattctttgtggatatgtgtcattagtactttttaatttttttatacctcccccctttacctccgtaagtagtctgtgggggtaagtgatacttttttgtgagaaaacataatataaatactgatgggatggacaacaagtgatccaggacccacagattgccatcatttgttcattcgaagaagatactagaggtggtatttatgttgtacttatttttatctcattgtttaatttttatgtgtgttttacaatctatctaatgttagtaaatgaatctaatttataaacacatatacgtatattggcaatgtgtgtacaaagctttttttttacaggtagattatgtcattaaaaagattggagatggctgggcgtggtggctcatgcttgtaatcccagcactttgggaggccaaagtgggcggatcacgaggtcaggagattgagaccatcctggccaacatggtgaaaccctgtctctactaaaaatacaaaaattagctgggcgtggtggcacgtgcctgtaatcccagctactcgggaggctgaggcaggagaatcgcttgaacctgggaggcggaggttgcagtgagctgagattgtaccattgcactccagcctagcgacatagtagactccgcctcaaaaaaaaagaaaaaaaagataggagttaagtcaccctgtgtgtctctcttgtgaaggatggtttgttgtgtagaactccaggggttagccttctctgattcggtgtagcattgtttgtcattttgcccagaggtgtagtctttgatctggctaggggccacatggacaggctcaggggatgggagacttatgacattaggacattgactcttgcttgcatgtcctcctgggatttggacatatgagtcatttggagtctgtatctgtactaagctctccttgccaaattctgcagcctgtcactgatagccacagctctctgtacttgctgttgccttcttcctcactctggcccagggattcttcctatcttctctttggaatggaaaacagaacaagacttttaacttttaggtgcttgaaccttggggacagggagccctgatatatcagctggtctgttgaatgagatcttcatgctggaactcagggttgctatctgagatacagatgttatagaggatacagctcatcctggcttgttttgttcagactatagtgactccaggtggacaccatgctgccaaaccctacctagatagggcatctgcctaggtaacagaatgatatatgcagataaaaacaacaacaacaaacaaaccaaaacaatcttgaggtttggtctgacatgctgaagctattctccttttcccctacagcttagctatgtaggagcgattattctagagtccatcttcagtggagtgtattggcccccttggcaaccccgtgcctcacttaatgcagtgtttagagcagtggttctcagctgggggcagtttttcccttccatgggatgttgaacaatatctggagacattttttaattgtcatgattggcagcatgttactggcatctatgttgttaaacatcctgcaatgcacaggacagcctccacaacgaaggattatctcatctaaaatgtcattggggcagaggctcagaaactctggtctagagtgacttctgcctgtcaccactgtggtgtagggtgctgatagaggagtttctgcatgccaagattctatgcccagacttgtatcaaggcatcctcccagtagacaaaaggcccttgatgtactgctggcctcaggccttctagcaataaaaaagtagccttctttccactacactccaagcagaaaggcccctttgtgctggatgaggtcgacttcccttggcagcagtggcaggagtgtgttgttctctgtactttacaggctagcacttgtctgtctgccttatatctgtgtgtcactctcttatgccttcattacctgacactccagaccatagtaaatgataacatctgcaatgcgttaggatatatattcattttcaggaataatacgttctagtccatttaacttccatcagcattttttttttttttgagtcagggtcttgctctgtcacccaggctggagtacagtgttgcaatctcagctcactgcaacctctgccttccaggcttacgtgatcctcccacctcagcctcctgagtagctaggactataggcatgtactaccacacctggctaattttttaatatttttttgtagagatgggttttgtcatatttcccaggttggccttgaatttctgggctcaggcgatccacctgtctcagcctccctatgtgctgggattatagtcatgagccaccaagtccatccctcaacacttctttttttttttttttttttttgagacgaagttttgctctgttgcccaggctggagtgcagtggtgagatctcagctcactgcagccctccgcctcccaggttcaagtgatccttccacctcagcctcccgagtagctgggattacaggcacgtgacaccatgcccagctaatttttgtatttttagtagagacagggtttcaccatgttggccagggtggtctcgaactctcctgacctcaaagtgatccacccacctcggcctcccaaagtgctgggattacaggcgtgagctacctttttttttttttttttttttttttgagacagcctcagtctgtcgcccaggctggagtgcagtggtgcgatctcagctcactgcaacctctgcctcctgggttccagtgattctcatgccttagcctcccaagtagctgggatcacaggcacgcaccacccctcaacactaatttaaccccagctctgtcatccttcttttctcaacggtatctcttggaaattaatttatctttttcttccaacatattctagtctgggaattagaaatataaccaagcactgactaagcacccttcacttaagcttctagtatcttgtctcctaggatgcattcctggacacactgtgtctgcctcatttccttcccctgccacctttcccttctcacctcccatgcctctgcaaatagtctaatcttcccccaaaggcactcagcttcagagctttccttctgaactccagcatcttcttgaggacattaagagattggagcattcttgccttcaactttattttattcaggatgtctccctgattatctgctttgcatcacatcctgggctgagaggaatgcctgattttgtttgttttgttttctttgtttttgagacagggtctcgttctgctgcccaggctggagtgcaatggtgcagttatggctcactgcaaccttgaactcctgggctcaagttatcctcccacttcatcctcctaagtagctgggactacaggcatgtgccattaggcctggctaatttttttatttttcttttgtagagttggagtctgctgtgttgcttaggttcgtctcaaactcctggcctcaagtgatcctcctgcctcagcctcccaaagtgctgggattataggcatgagccaccatgtctggccaaatgcctgttttttgacaagcatttcagaagttacttatccacgtgagctgtatgtttttctaaggaggttttgttgttgttgttttgaggcccacatcaaatcatttctggaacccctcatttagagtagttcttattgatgccactgtatatgaagctcttagttcagaaacagtggatgagcaaaaatgaacaggacacattccgtgccttcaatgttttctgcctattaaagggaaattagaccaggtctgatggctcatgcctataatcttatcactttgggaggctgaggctggaggactgccagaggccaggagttctagaccagcctgggcagcattgggagaccccatctctacaacaagtaaaagaatttgaccaggcacagtagctcacgtctgtaatcccagcactttgtgaggccaaggtgggaggatcacttgaggccaggagtctgagaccaacctggacaacatggtgaaaccccatctgtactgaaaatacagaaattaactgggtgtggcggcatgtgtctgtaatcccagctactccagaggctgaggcaggagaattacatgaacctgggaggcggaggcttcagtgagctgagatcgtgccactgcaccccagcctgggtggcagagcaagaccctttttcaaacaaaacaaaacaaaacaaaacaaagacaaagacaaagacaaaaaaagagttagcctagcatggtagtagtacatgcctgtagtcttagctactcaggaagctgaggcaggaggatctcttgagcccaggagttcaaggctgcagtgagctgtgaccatgccactgcactcaagcctcggtggcagagcaagacctgtctctcttttttttttttttttgagatggagtctcactctgtcacccaggctggagtgccatggcgtgatctcagctcactgcaacctccgcctcccaggttcgagtgattcttctgcctcagcctcccaagtagctggaactgaaggtgcgtgccaccacgccccgctaatttttttgtatttttagtagagacagggtttcagcatgttggccaggatgatctcgatcccctgacctcatgatctgcccacctcagcctcccaaagtgttgggattacaggtgttgagccaccgtgcctggccaagacctgtgtcttcaaagaaaaaagatatggatcttatgagaggacagtgatgaatctcaccgtatcattcaacttcaaaacttttttggcttcttgctgcttacagcagtggttttcaaacttgaagaatgtacaaattccttttaaggtaaataatacatcttggacctgcagtgctgacttaaattatttttattataatgttatttaagtatatacaaacatagaacaaagtttaagtcactgtgtaaaatttgtatataagtgtaaacaaaaacagatttatactttaagtaaaaataaacttcagatccaataaaatgatgcttttttgctgaaaatcagttgcttccaggctctttttaagttcagcatatctgtattgctgggtaccatgtgatgactcattcctcccaccatttttctttatttaagctaccatgaaactttgattcatgatctcatttgaccttcactgggctggaactattccttgtgtattgtgtattaagtctacttctattccttcataattgacttttaacaaagtatagagataaatttgctttctgtgtgtttaaacacaatacagatataaaaattattattattattattaattttttttttgagacagagtctcgctctgtcgcccaggctggagtgcagtggcacgatctcagctcgctgcaacctccacctcccgagttcaagcaattctcctaccttagcctcctgagtagctgagattataggtgcccgccaccacgcccagttaatttttgttcttttagtagagatggggtttcaccatgttggccaggctggtcttgaactcctgacctcaggtgatctgcccgcctcggcctcccaaagtgctgggattacaggcgtaagccactgcacctggcctataaattattttaaaagggtactttttatgactattcattaaaaacatcacattataatattgaggaatcactagctctagtgctccacgtatggtgatgatgcaatttgccatgttgcaaatgaccattcagttgtttcagttagagttggttcctgttatgacagaaaatcctttcaatctgatataagcaaaagggagaatgtacttcttgcacaaaactgaaatatctatgaataggactttctacaggcattatctgactcagggcttaaattatatcagctggattttttttttttttttttgagacaggctctcactctgttgcccaagctggagtgcaatggcatgatcgcggcttattgcaacctcgacctccgaggctcaagccatcctcccacctcagcctcctgagtagctgggaccacaggttcacatcaccacacctggctaatttttttttttattttttgtagatatgtggtctccctatgttgccctgactgatctcaaacccctgagttcaagtgatcctcctgcctcagtctcccaaagtgctgggattataggcgtgagtcactgtgcctggcctgtcatctggatcttgactcagcttttcctctgtatgaaggcttccagcagcatcagggaggttgtatacacaacccccctgcccaaacacacacacacacacacacacacacacacacacacacacacacacacatgcttagaacgtgaatgatggagccagactgcctgagaccaaatcttggctttcccagttcctagctgggtaactttgggaaagttatataagcttgctgtgctttagtttcttcatccttaaaatggggataaaatgggatatctacttcatatgaaaatgatgaagattagtgagttaatatatgtgaggtacttagaacaatactctcatagactaagcgctatgtaagagatggcttctattactattattattattgttgttgttattaacattatagttcaggttcattttatcccagacaccagtatagtggaaaagcaagcatatcccctatgggccaaacaaaaattttagaattcagtttcttcagccttgatttgggttatgtactcatccctgaactaagcactatgggcagaaagatggaatgtattgattggtttagcttgggttacatactctacttttaaaggctgatttagctttacctgaagcatattagctgagagcaagggaggagtggttctgttcatacaaattcagaatactgttgccaccaaaaagggaagtggatgcttggtggcaaaagtgaaccatgttcattatagtgctatcagatagatcgtaataggtgatcctgttatactacattagtctctctggggatgcaccaattgggacagttcttgtctgaattaaactaaaagacagtttatatcttttagtgggtaatatttgtctttttgaattgcaattatgaatgtatattttgtgtaaaaacatcagtttgacctctgggttcttttgtattaaaatatttaaatttgagatatattattgttatgaagtacattatgtcctaaaattccaggaaaatacagttgagccttaacaacacaggggttaggggtgctgactgtcccttttcccccatgtagtcagaaatccacttgcaacttttgactccctcaaaattgaactattaatagcttgttgaccagaagacttaccaataacataaacagcctattaacacatattttatatgttatatgtattatatactgtattcttacaataaagtaagagaagaggaaatgttattaagataatcataaggaagagaaaatatatttactgtttattaagtggaagtggatcatcataaaggttttcatcctcatcttcacattgagtgggctgaggaggaggaggaagaagagagattagtcttgctgtctcaggggtggcagaggcagaaaagatagagaaggtaggaagggaggtgggagaagcaggcacactcagtataccttttattgaaaaaaaaatccatgtataaaattcatgtataaatggacccaggaagttaaaacctgcattgtttaaaggtgaacggtgtcactgtaactattttgcatcaacacacttataaacacaaatgcaacatgagcactgaagttgagagcctgtattcttatatatctagatgatacagaataaacttttgctttttacttttagcttatttccaaaatataaatatagaatcaaaacactttaatggtaaattgtcttttttttttttttgagatggagtattgctctgtcactcaggctggagtgcagtgacgcaatctcggctcactgcaacctctgcttcccgagttcaagcgattttcctgcctcagcctcccgagtagctgggactacaggcatgcaccaccacgcctggctaatttctgtgtttttaatagagacgaggtttcaccatgttggccaggatggtcttgaactcttgaggtcagatgatccacctgccttcgcctcccaaagtgctgggattacagtcatgaaccactgcctggccataaattatctttttttatctgttttgcaacagtctcactccgtcactcaggctagagtgcagtggcgtgatcatggctctctgcaggctcaatctcccaggctcaagtgatcctcccacctcagcctcctgaggagctgggactctaggtgtgcaccaccacacctggctaattgtccctgtttgcagatgacatgattgtatgtttagaaaaccccatcgtctcagcccaaaatctccttaagctgataagcaacttcagcaaagtctcaggatacaaaatcaatgtgcaaaaatcataagcattcctatacatcaagaacagacaaacagagagccaaatcatgagtgaactcccattcacaattgcttcaaagagaataaaatacctaggaatccaacttacaagggatgtgaagcacctcttcaaggagaactacaaaccactgctcaatgagataaaagaggacacaaacaaatggaagaacattccatgctcatggataggaaaaatcaatatcgtgaaaatggccatattgcccaaggtaatttatagattcagtgccatgcccatcaagctaccaatgaattttttcacagaattggaaaaaactactttaaagttcatatggaaccaaaaaagagcctaagccaaaagaacaaagctggaggcatcatgctacctgacttcaaactatactacaaggctacagtaaccaaaacagcatggtaccggtaccaaaacagagatctagaccaatggagcagaacagagccctcagaaataataccacacatctgtaaccatctgatctttgacaaacctgacaaaaacaagaaatggggaaaggattccctatttaataaatggtgttgggaaaactggctagccatatgtagaaagctgaaactggatcccttccttacaccttatacaaaaattaattcaagatggattaaaaacttacatgttagacctaaaaccatgaaaaccctagaagaaaacctaggcaataccattcaggacataggcatgggcaaggacttcatgtctaaaacaccaaaagcaatggcaacaaaagccaaaatggacaaatggagtctaattaaactaaagagcttctgctcagcagaagaaactaccatcagagtgaacaggcaacctacagaatgggagaaaagttttgcaatatactcatctgacaaagggctaatatccagaatctacaaagaactcaaacaaagttacaagaaaaaaccccatcaaaaagtaggcgaaggatatgaacagacacttctcaaaagaagacatttatgcagccaacagacacatggaaaaatgctcatcgtcactggccatcagagaaatgcaaatcaaaaccgcaatgagataccatctcacaccagttagaatggtgatcattaaaaagtcaggaaacaacaggtgctggagaggacgtggagaaataggaacccttttacactgttggtgggactgtaaactagtttaaccattgtggaagacagtgtggtgattcctcaaggatctagaactagaaataccatttgacccagccatcccattactgggtatatacccaaaggattataaatcatgctgctataaagacacatgcacacgtgtgtttattgcagcactattcaaaatagcaaagacttggaaccaacccaaatgtccatcaacgatagattggattaagaagatgtggcacatatacaccatggaatactatgcagccataaaaaaggatgaattcatgtcctttgtagggacatggatgaagctggaaaccatcattctcagcaaaatatcgcaagaacaaaaaaccaaacaccgcatgttctcactcataggtgggaattgaacagtgagaacacttggacacaggaaggggaacatcacacactgaggcctgttgtggggtggggggaagggggagagatagcattaggagatatacctaatgtaaatgacaagttaatgggtgcagcacaccaacatggcacatgtatagatatgtaaaaaacctgcacattgtgcacatgtaccctagaacttaaagtataataaaataaaaaaaagaaagaaagaaaaaccaggcgaccaaatagaaaaaaaaaaattttaatagagacagggtctcactgtattgcccaggctggtcttgaattctggagttcaagcaatctcccgccttagcctctcaaagtgctggaattacaggtgtgagctaccatgcccggcctatattagattatcttgaccagtgctgtctaacagaactttctacaatgatggaaatgttgtatagtttatgctgtccaatatggtaggcactagccacatctagctattgggcacttgaagtgtggctagtgccatcgagcaactgaattcttaatttatttaattttaataaatttaaattgccactgtggctactggctactactgcttggacagtgcagctctgaataacatcaaataagagaatggctataaagtgcccagtgtgctctatactaagcacacagtagatgtgagaggaggagaggtctatagattctgtcctgaaaagggttgggcctcacctaactggccagagcaacctgagttaggcttatcccaggacaatactagtagctatcttagcatggtagtcaagactctttgtgacatggcttcaaccttcttctgccactacctgccatatattctatattctagaccaggggtccccaacccctgggccacggacctgtgtcagtccatggcccgttagggactgggctgcacagcaggagatgagtggtgggtgagggagtattactgcctgaactccaccttttgtcagatcagcagtggcattagatcctcataggagtgcgaaccctattatgaactgcacatgtgagggatctaggttacgtgcttcttatgagaatctcactgatgcctgatgatctaggtggaacagtttcatgctgaaaccatctccctgcccaggtccatggaaaaatcatcttccatgaaaccagtccctcatgccaaaaaggttggggactgctgtttcacacacatcaaatttcacatcttttcttttgcacctgtcttcattctgtattgagtgccctcctctccccacacccatgaaatatttgagataagcttctactaatcctttatgttgcaatacatcatcttctctgaggctgtccctgaagccctaggcagttatttcctttcttctctgtgccgtatgtatttttctcatcagaatctgtgcttcactcatgctgtttagcttttgatctcttccactggattgggaactaacttcctccaggcttggcactaagtagtccccttatgaatgctcagttgaatagctggacgaatggatggatggataattgattctcaaccctggtcacaacagtttaaaaatattccaaaatcaaatttattgagttataatttacataaaagaagatacacctattttaaatgtacagtttgatgcattttgacagatgttatcatttgtgtaaccaccaccacattcaagatatagaatatatccatcaccttataatgttgcatttgtgattttttcccagtcagtccccagctcccttcctggctccagctaaccattgatctgctttctatcactatagatttgtcttttctaggatttcatataaatagactcacagtgtatactcctttcatacttagtattttatgggacagatagatattaaacacacaaatgtggtaaatattaaggtcagcatgacaacaaatgaaagcagtgcttggcattctagagtcatggctttgcttgtctcttttcacagtatacaattggaccgtggatgaggtggtacagtggctgatcacatatgtggagctgcctcagtatgaggagaccttccggaagctgcagctcagtggccatgccatgccaaggtcaggaggggactgggtttttctctgttgagggtacggggaatgggctggagtgggcctgccttcagattgctctggccagttaagtgaggttctgcctttttcagggcagcgtctatagatcttgcctcttctcacatctgttgtgcacttgctataaagtatgatgggcgctttgtatccactctcttctttaatattcctgtcagtcctgggaatagtactgatagctgccatttactgagtgcttagtacatgccaggcattctactcaacactgtatacagtatctcatttaattcttacatcagtcctgtaaggtgggtattattgtatatagatgatgaaactggttaagtaacttatccaaggtcacaaacatgactagttaggggcaaaactgagatttgaatcttggtgtacatcaaaccctgttggtgtttcttttttctttttttcctgtgccctgagcagctgcctcttttatcacccgggagcctcagggctcttttagcctcccctgggttatccatatacagcttatttataataaaaatggtacagaggagaggctgattgccattggccccagcctcatctctgggatggctccaacagctgttgtttcataactctttgcctactttacacgctgaatatgctagggcttgggctgggagtgggaaggggatggagtactgcttggacttcttgtcatgtcaaactagtgccatatgccattcagtcattaatccatttacttattcatccaacaaatatttactgggtacctgctctgtgccaagcacttgtgctgggtgctagggataaagatgacaacaagctgtccttgccctcaaagggcttactatctggtaagtgctgattatgtataatctgtcatcttattatgtaggtgcatctggttttgagcttcagcaaaggggaaaggggaaggtgaagctgttggaatgcccacactttgcagtctccagccacagagctactgagcactgctgtccaggcctagctgagctggctgttccctcctctgctgcctgcagcctcttcttcacagcttctctctgctctggagagagtaataatcttaatgtttgtacctccctttatagagtgctttcctacatattatttcagttgattctcacaactctgggaggaagagtatcccaacctttgggtgaacaaactgaatctcaaatattttataatttatccaagctggtaagtggcagagctgggatttgaacccaggtctgtcttgttctaaatgccctgctttttttcactgcatcttcctcttgtgccatgtggttaaagataggcttcctttcaatattcagtttagttctattttacaaaacttcactaagcacctaccatgtgccatactctctggtgggcccagaggacaaagagatgtattagacctgacccctgacttgaggaactccatgtttaatggaaaagtagatgactgaccactaagatccaggatttaggtttctttcttgctacccatagaaatagcaatattgccttgtggatccctggaccattttcctcatgggaaggatatctttggcttggattaaaactgcaaagcataggataagaagtcagttctcaggtcactggttcacttagcttttttgtggctagaattacagccaagaccaggtccagccaggctgggcacaggtgtaggggatgtcaagctgtggcaccttagtgacagcaggaagcatggggccttcagtgcttggggtgaagtgagggtggttctaggcccatcactagctcacatggtataatgagaataatctagcagatttgagttcattctctggctttgccacttacttgtgtgtgactttgggcaagttactcaactctaagtctccattttcttatctagaaagtcgcactaggccgggtgcagtggctcacacctgtaatcccagcactttgggaggccaaggtgggtggatcacgaggtcaggtgatcgagactatcctggctaacatggtgaaaccccgtctctactaaaaatacaaaaaattagccaggcgtggtggcaggtgcctgtagtcccagctactcgggaggctgaggcaggagaatggcgtgaacccgggaggtggagcttgcagtgagctgagatcgcgccactgcactccagcctaagcgacagagcgagactccgtctcaaaaaaaaaaaaaaaaagaaagtgacactaataatggaactgagttcttaaggttgttgtgaggactgaatgaggtattgtatgtaaagtatcagaacagtagcagacacacagtagttgcttagtcagtgttagctcctttctcatttctttcattgcttacaagtagatagcattccagttcataggtttctttgagaaatagactgtagaaaagacgacaatgtttattctcattagtcagacgaactgcagcacaagtgtttcaaagaggaaccccaagaactcccaggcttgtaggaagcatctgattttacataagtttgcacagtaggaaactgaggtcctcggggaggaacaaagcaacttatgatcagacaaatgagtcactagtagagctgaaatgagaagccagatctcctaaccactcccacaccccatcacagtgcctcactgcgtctcttactggtgggcttgattgctttccaaggccagagaaggaagtagctgttcctgtatgctcagacaggagtataaatcacactgtgatgtcagaagcttcttttctagctggagaaataaagctatgcatcagaaaagagcaccaatcttatagagtagtatagaattaagtgcttacttgtgggacctagaccagtggttttcaacctttcatatcttttacccccctcctcttatatccactgtgttccagcagaagagaaacaaagttccatttttcctaggtcattttcttgttcacaggctttctcttattaaagttatcactgacagtatgggtggaggtcataaaaaattacagtaattttattggaggtaacttgtattgcagtgactcaaatacaagctaacaggactaattccatttttgtcatcagtggttaattaaaattttttttccttttctatatttcatttcaatagcacattagcaggtttatatataatgacagtgagtttagattaggataattcataaatcccagaatcactgggtcatatgacatgacagtttgacctgggctgcacaggaaatgcatttataaatggtaggaggtggggaaaatatgtagaggataaaccctggaaggagaagcacaacagaaaatttagttgggtgtgggaatggtcacagacaggtaatccttagaggatagggtgcttagaagttggtggatatggggagagggctgaacaaattcttggtaaatgttatgtgtctctccatataccctgttgagacccaactggtatagactctgtgttctagagtgcagaggggagcaatcaccaagagctagaagtgttcctgggggaggcgggtaatcctaccaggatccttcctggctttactgggagggaactgatctgctactctttgcctcaacaggctggctgtcaccaacaccaccatgacagggactgtgctgaagatgacagaccggagtcatcggcagaagctgcagctgaaggctctggatacagtgctctttgggcctcctctctgtgagtcttgtgttgagaagggctactgctgtgccatggaaaccaaagctgttgtagtggataggctaaggctaaggctctgggtctcctaggcacacctgcaagatagcacctatactatttccactggtattaaggtatgaaagagtcttacattttagtccagacacgtagcaacatgcattcattaaatactttaaggaaatatctgcattgtgccaatgctgtgctggaccctgtaggaagacctggaatgaatcatgttctgccctgaagggacaacatgagtgttctgtagaggtacacagtacttctgaggcccagatgagggctagtgaaggtatcctatagacaaggtgacatgttacctctgcctttaagggtggatagagctttattctatggaggtggcagaataggacattctaggcagagtaaacaacctgagcaagagtacaaaagctaaaatatgaaaagtatgctcagggatagaagtaaccccctatgggctgaaagctttttacctgttacctacttctatatttcatttcaatagcatatcagcaggtttatatatatataatgacagtgggttattgtagacatgtagagtgcatgaactgattaatgaacatctttgtattattgaatgaccaaggaggactaagtgggttttcactgaagcagtagacacactcaggcctaagaaagggtggtctcttcagccagggtctagttgagagaattaggttgttcagtctctacagatctatgtggtaggaacggccagcctgtaatcctttttctaattctaagttaaccaagggggagcaaaaagtagtgagatttcttggaaaactattttcaaccaaacaggatcttagggcccacttcctgccctttgggaatggctggcctcgatttagggtgccagcagaagaatgctattgaaccaggaaacagtccagagaagcagctggcaggcaaggtcagaggccatataacatttccctgtctgtgaatatggcttggctaatgtgcaagttgatgtctcaatacaagtggatccatactttttgaaagtatgaaacagagcaacctgggagaagactaatgtttccacttcctttgccaccttttttttgggggagtggagggttctaggacacattttactcaccttcattggtaggttttgaataacgacacagtgaatggttctactctttatgtaaggcgtagtctctgtattgagcaatggccttccagtcattcactaacctttactgagcacattctatgtaccagcataatcggcagggtccctgctctccagtacttctatctaaatggagatagctatgtcaacaaatatagtaaagtgtcaacaaatatagtaagtgttatagctattatgtaagtctttccagagttcaactgggggcacaaactagggaggagtttcctattggagtccagggaaactttatggagaaagtaattcttgagctgagtcttaaaagatgagaagtggccttattaaactctccctatgttaacagcttacacatctctttgtatacaccaacaaggacacttatacccaactataaaagctaggctacttttgcagaggttctcctctgtcaccaccatgcaaggggaagctttcagcagcctgaaagtcttccttagccttgtaatatatattatcaagctttatctgtatcaaaatcagatttatcatgtctgaaaggatacagtagaaactgcaggttaaagcagtcaaggattttatctgaaaaaatcagctagcatgggaaccagaatgctggggacatggtactgggtccaggatatcagaaccaacaagaggggccctggtggagcaggttggactgataccaggacaggggtattcttctcttaggcttattgcatgtagcccatgtgctgcatgtgatctaacttaaggaaggccagagatcagcaggaaaactatcttcctgagataggcagaacacaggtactgaagctaagaatatacttcacactgactgggatacttataataataatagtttttaaaaatggaaaacttgtgttggcgagggtatagagaaattgaaaccctgtatattgctggtgagaaggtaaaacggttcagctactgtgtaaaatagtctggtggtttctcagaaattagacacagagttaccctagaacctagcaattccacacttaggtatatatgcaaagaattgaagacaagtactcaaacaagtacatgtacatgcattttcatagcagcacatgtcacaagagccaaaaaataaaacaacccaactgtctattaatagatgaatagataaatacattgtggtgcaatggaatattattcacctataaatggaatgaagttctgatacatgctacaatgtggatgaacctggaaaacattatgctaaatgaaagaagccagacacaaaagatcacatattatatgattctgttaatatgaaatgattagaatagataaatccacagagacagaatgtagactaatggttggcaggggttggtgggaggagggaatggggagaaaccgcttactggtaaaaaattttactgtagagtgatggaaatattttggaactagatagaggtagtggttgcataacatcatgaatgtgctatatgccactgaattgcttactttaaaatggttacttttatattatgtgaattttacctcaaattattttttaaaaagcatatacaacaaaagaaagaatagataaattggacttcaccaaaataaaaaagttttatacttcaaagaatgtaccaagaaagtgaaaagacaacccacaaagtggagaaagtattggcaaacatttttctgacaaggctctactatccagaatacataaaaaattcttgctaggtacggtggctcatgccagtaatcccagcactttgggaggctgaggtgggcagatcacctgaggacaggagtttgagaacagcctggccaacatggcaaaaccctgtctctactaaaaaaatacaaaaattagccgggtgtggtggcacatgactgtaatcctagctactcaggaggttgaggcataagaattgctgaaacctgggaggcagaggttgcagtgagccaagatcgtgccactgcactccagcctgggtgacagggtgagaccctctctcaaaacaaacaaacaaacaaaaaatggacaaaggatttgaacatattatttgtatagtccacagttcaatggccaatatacacctgaaacaatgctcaacatcattatcagggcaatgcaaatcaaaactacaatgaggtaacactttttacccactaggatataataaaaaagacagtaacaagtgttggtgaggatgtgttgaaattagaataatagccaaaaagtggaaacaactcaagtgtctgtcagttgatgaatggaaaaaaaatggtatatacatacaatagaatattaatcagtcactaaaaggaatgaagtactgatatatgctacaatgcggatgaaccttgaaaacatgccaagtaaaagaagccagtcacaacaggccacatattatataattttgtgagttcacttatataaaatgcccagaacacacaaatccatagagacagaaaatagattagtggtttctggggctgggggtgggggcagtgggaaataggaagtgactgctaatagatatggcatttctttttggggtaatgataatattctaacattaattttgccagtggttgcacaaccttgtgaatatagtacaatcattgaattgcccattttaagagagagacttagaattttagggtctgtgaattatatcttaataataaatatatacatgcataccttgttttattgtgctttgccttactgcacttggcagataattgcattttttacaagttgaaggtttgtggcaatcctgtgttgatcaagctgttggtaccatatttccaaaagcatgtgctcacttttgagtctctgtgtcggaatttttaagcaataagttatttttaaattaaggcacgcacactgtatttttagacataatgctattatacacttaatagactacagtatagtgtaaacataacttttatcactgggaaactaaaaaatttttgtgactcactttattgctatattagctttattgcagtggcctcaaactgaacttgcagtgtatccgaggtatgcctgaacagctttttttgtagctcctggatttttattcagacaacttgtttgaagtttggggaagaaccctgtattggcaggtgaccttggtcccttttcaaaattgccactcactgtgtgaccttgggtagtcacttttctcaggtgtgttttatgatttgtatcaggagattcctccctacagttcctttcagctgtgacattttatgatttttgggaggaacttcttcctcaataagggttctgtgtaaaagacaggaggtctgttccttcctggtgtctgcatcctgtatttttaggacttctgtgcttggtccttgccttattaagtgagctttggcaattcagttctgcctagatttgggtttccttatctgtaaaatgggtttgttcattaaaggttcttactggttctctcattcaaggattctgatagagctgggtatactcttggaagctaaggttttagaaatcagcagctgtcctgatggcaaatattgtttttatatttttctactgatgcttgtcaaaggaaatatttgaaaatcgccggctggaatctgaggaaaatactaaggagctctttgccaggagacttctgaaaggggtagggacatgcctgctgggtgtttacaaaaagtcccttgatctgtgcccctctagactttatttcccctctgagcatggactaaaaatccctatttcagttctattctttaatacccatttaggaggcctgtactggctctgacctgtattctgaacttaggatgagttcttaaggctgagtgagcagacacttagacctcatcatcagtcatttagcacacaaacaccccagagaacctagacttgttacagctgtgagctatggccaccttactgagctataataaaaattctgttattggtctgaggcttgacatatcttcaattaaaggtttgtcatgcagtagccaagagggtctgctgagggaacaggtgccatctgtccacagcagcctcagaacttgggaagagggaagagggaagagggatcagactggctcagcagagggccacctcaaggtccattttctgacagtagatggcatgcttaatcctccccatgtgaccacagagtagcacactgccctttaggatctttttcactctacagagttggctctgggtttacaggcccatctagggctcgccaaacagtaccagtttgcagatgttaggtgtgtttggagatgttaggagatgttatccatcttctacttccattagaggaaacaagatataataaagagttccagctttgaaatcaagctgaccagctctatcactcagtagctttgtgaccttggacacatttctaaggttctctgtgccccaatttgctctaaataaatggtagctactatttttaatttttaatgtgtgcctacagtgtgcttagtcctgggctaggggctagcatgccctttgtgctttcagcaggaatattgagaaaagtgcagggaggcctacagaataattgttgcgggtcaggggcagttggagataggaaaagaaaagactatgcctcatcttccttcttcattggctcagaaaataggggaaagtccccagtgagcaggagtggttgcttttctggcaaagctcactctgatctctgtacctgcatccttaccctctctctcttttctgttatggtccaatttgcccttcaagctttctccaggatgtttttccatccttttacaggcatgctcaactctttcctcttattctcctgtaggaacccacagccctttgtactttttttttttttttgataacaatatgtctctctgccttttatcctttaaactgggaactccttgatgaaagaattttgttcatctgtcatcagcacccagcttaagatctagccagaattaagtgctgggagatgtgtgctagaagttatatggaaggaggctgggcctctccagactacagaagtgaggggatttgggagaagaatctggcccagcttggttttggggagaaatgctatctatggagtacctgaatagctgaggcatttaaagcatttgttgggctataactagaagggaggggggcccatgagtagctcttacacgttaaacagacatcccagcacagaaggctgtgtaaatgacaaaagaaattcctactacatattttggcagtgagggatgaatatctatatctgccagggtattgtgtgaagtggacagggtggagagaatagattgggagaagggattccagaaggtgataatgattggatgctcactttctcagtgctaacttgtaccctgaaaattcttattattacccctgactttgttaacatctcagtatctcatttttttacaaccacttcccttgtctcaggcctgatggtgttaatagttgacctcattttgctaaaatctaattgcagcacacagactgggaattctgccatcctctggttcccccagtcccagccagcttccctgggttagctctgttcacctagccagccacatctgttctcctgaaacctccatggttactctgccctggctatggttactgagtgcaaggtagattctgagagctgagtttgtgtaggggttgtgcgatgcagctggccatgctctttttgtctccaggagctggcatttgccctctatatgcactttgtattgtagctccctttccacctaaaacctccctgcattctccccttttctcccttttctgcctttgctaaatacctgttctggtcagaccctgtgctaagagtatggggctacagagatataaataaaccttgtgccctggccctgaggaactcacagactaccagatggtgactgacatggaagttgaaaaataggctgggcgcagtgactctctcctgtaattccactttgggaggctgaggtaggaggatctcttgaggctaggaactcaagactagcctgggcaacatagcaagacctccatctctaaaaaagaaaaaaaaagttgaaaaacacacaagacagtccctgagaaataaagagataacctatgtttacctgtccaaagaatgggttgatcgtagctcacaggagatggaatggaaggctttgtgggcaatggtagggagaagacagtaggaattgaagaatgggaatgggattataatgggaagaagcagattattagtaaggcatagattagactcttgatttgcctattctctcctctttttctacacaatgattcatagactcacttagtggtgtggggtacagcctagggctctgcgggagggacccgacaattcttacatctactgcttcagctacttcttctttctcaaactccacatctatattcttaattatctcctggcatgtccatctgagtatctccaagacacctcaaagtgctgtcatttacacctacacgttcgatctcgttagtaaccacacattctatctctgtagtaactctaatgcattttacagctgaggaagctgaggtctagataggggaagtgaattatataacaaattggggcagaggcaaacatagaaccaggcttcccaacacatagtgtgggatgcctcccttggtagcacaagaatttctctacacggacccttgtgtttaatcttaaggcctggttatttggccttggggtattcactgccctgatggcaatgccactatcagcttccaggatattgtgtgggggaaaactcaggccttggaactcttagagtcaagagttccaagagtctagcttgagctagatcagggccatattagacatctccattgtaagagatgtttgcctgtaacaaaacagaaacaatatttgctgcgtgaatatgaaagctgtagtgagaaagtgtggtgtagcagaaagacaatgtagttgggcaaatctggatttaaacccagctctagcaagttagtgtcccttacagagcctcagtttcttggtctacagaatgggaataccaataacctatcttatgtagtagttgtgaggataagagacgatgaatataaatgcctgatatgttttatattttctctatttcccttcctttcttatacggattaagggaagggagatattatcatacttgaagcttatcagtaaagaatcaatccttccaagatttattgagtgacttctgtatgctggttgatgttatgctgtgcactggcatatataggcaagtgatgatcactaggaaccttaaagagtaaatcaaccgtgttagaatcatcttcttttatcaagcttggtagctcatggatgtggcaggtagtatttccggactttatctatacatttgacaaggcagagggttggataggatggatatttgtatatttaagtggagtcaaaactagttgaaggaatccagtggtactgataggtggaacagtattaccttagagggagggagtgactgttagatcttatccttggccttggttattcagtattcttattcatgacttggatgagaatatgaagctgggcaaaataatagatctggttccaaattgaactggataaggtagaataagaaaccaaatgaaataactaggctcaatctgcatacccaccttaagtatttgaggtactggaagtgctcgttgcatggagtcttgtttgaataaggatacctttgacttttggtaagaatataaaggggatattgaagttgagaaaccctaggaaaccaagattaaaagtcattaacaaacaggggagacaaagaataccccaggctctggtagtggctctggaggaggcaggtgtgttccaggaagtaaggcaactcactgtgctgcagaaatagctccccttggaacctgaaagacaggagagtgatggcttacgtatggctagacttgtagcctgcctggaggctaggggatggccgctagaggaccctcaattttctttcagagagcctggaataaacatatgaaggacatggccaccaccctgacctagtgacccccctcccttgggtggaaataggatgtgttaatctgtctttgatcccatctcatccccatgttctgctgctcagcctttctgtgaggagctatgatggtaactcttcttgtcaaactataggcatcagtatcatatggtttctttttctggtgtcttgaccttcccttaacttggtggctctacctgggtccttttggatttccaccagccccatgtccttactatgtccaaggatcatgccagtcctacctccttctctgctgtttaagggcaacttgctgtgcacagagggtcattagccctggcataactcccttttttccctctttctctgactcccacatccagggctcctctgagcccacagcaaaacctagacagaggatgcaggagtagctgtctccttcttatagtgcccctttcaagtcttttgtgctgtggcacagagcccagatctggtataccaggaacaatgttagttccagaaatgcctctctcctgattggctaagtttttaggatgtggcttttgctttttatcttgtggtgtcatttcttgtttaacatttaaattttgctctggacaatgggcattctttgaaccccagctggtggctggggccctcgtggttcactgaattgctaccaggtgttctctgaaaatagctctgcccctcaatttctggtaggtataatgtctcatccatatgaatgtattcatgctatcctgttctagagtctctggatttcacagtagcctagaaatgttctccatagattgagacttctggacctttccctgatctgtgccaagaatggcctggtagtccaggatacctagttcctacagtgacttcagtcctacagccagaactgaggcttctggtgacattgctttatatcctttataccagtcatctccatttacctactgtggaactttagaattgcttaccctgtatgacagaagccactacatcttggcatatgggctcatccagcccagagatggctggggcatattgagaaggcactagttctctcctcttcactgcatcttaagaaagtgtgatttaataagcatcctgtattgctgtaaggcctctcatttcaaaacaaagccttggctagcagagagatagacatagagcttactgtaatagtgtatggcaagtgtgtatctaagaagagaaactaattccttctcagtgggagagtgtgtctgttatggaaggcttcatagaggagggatgcagtggagtctgcaaggctaagtgtgcagtgggcaccctaactcatcatgccctcccctctctggcagtgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggtaaggcctgccccttcaggaaaggtgaggccctgccagttcttgggaacctcctatttccacctgggtgtgagccacttggcccctgagaccttgtcagcatggcagcccaggctgcatcatccttccaaaactgcattgcaagtttaggttgctgatattccaattgctattgggcagttattcctcctggggagaaacttgtttctatcttttttgcctcttagcttcagagggagaaatgtgtagctgccagaggtcttgagcttcccattgcttgttatggggtcattcttccttctgcctgtctctggactgcttctcctagcatataaatagatgtaatgaactgttctttactgttccccaaagaaacctcaaaaccttccttcttactgtccttagttctttcttataaggagtctaaatctcataaacactaacttgctatataactttggataaatttctttccctcccaggatttatttcctcattggtaatatgaagggattgaccttggagaatgctaaactctcctaggagaacacttccaactcagatggtctgggattctgttaaaataaaatgtgacttcaaaactatggcagaagatttaactgtgaaaagagagtgcccgtcagtcagtcagtcagtcctgacgtctaggaaccagttctgtgatggcagttatgagaaattcactggtcctgagaaaaaaaacttacacacccacaagaagcagcagtgagagcacacttaatgcagacttagttccagactcagcttataggataagaatgctaatgtctagaaagacaaagaggtggatgagtggatgtgggactctgaggaggtagcctttaaagatgggtagcgaggtcctaggtgttaaggttgagtgtatagggtggggtcagatccctggaaccttaagatgcatgtggggaagttagtaggatgcagaaggcaatagagagtcaaatcaggtttttttggttgttttgttttcgagaagaggagaggtctattcaagactgtcttttagaaaatgattctggaagcctagggactctagttgggaagtctttgcaggaattcatgtaaaaggaaatgaagtcttgtcttttcatttatttctatttattattattattattattttgactctgggtcttgctctgttgcccaggctgaagttcaatagcatgaacatggctcactgcagcctccaccccctgggctcaagagatcctcctgcttcagcctcctgtgtagctgggtgcatgccaccatgcctggctaatttttttattttttgtagagacaggggtcttgctgtgttgcccaggcttttcctgaactcctggactcaagaggtctacctcagcctcccaaagtgctgggattacaggcctgagccactgtgcccagccattgtgttatttttaaatggtaaacactatttaatttggaggggtagggacaagacttcttgtgagccaggtattgttaaatacttaaatgcattattacttttaatcactatggccctttgaagtaggtactattagagttggggaaatgaaggctcagagagggtaagtgctttgttcagggtcatatatcagtaagtagtgaactaggaattttgacactccagggtgctgcctctactgaggtagcagacttattggatttatttccatgggctgggcttctagggagcaagaggggtctgatctctaagctgattcctggctactttgctgggccccttgttcttgggccctttgccagttaggagctaactgctgctgtctgagcagtccccatacctcatttgtttgaaaaacatgtactgtttccattccaaaggcaaaagaatctaggcaggagacattccaagtttggggataaaactaagctcccagcactccctgctccctaaagcttccagagctaaatgaccactgtggcacttagaaagagacaaagacacccctccccttttccccctagagataggcttgcacacatgcacacatatatcctcctctgagtgtccagagcccacatgccacctggttcctccttgtattaacagacctgcaatgccagctttcacagagctttattacagagttcctgataatttatgtgaataaatataattctacatatacagtccagttaggatttcattgagtttcaagataattatttgaggcaggcaggaattttgattcccaaaacaggcaaaacttgctcatagtcacacaactgcttagagccaggactaattgcaatgctaattgttgttgccttggagtggggcagtgcttaattgtatacttatttgctcatttctacacccaacaatgattattgttctccatctctaacagaccttattggaactatgaaagggtgtcagtcttgattctactttaaaggagctcgctattattataaaggacagacatatcatagtattggcttttctcaagaggctgctttcataaaaggacagtatttcagtgaagaagtgaatccttaatggtgtaactttatatagttgggtcatggaagagtacagtaaaggaggatattcagcaagggaaggagatggcaggaaatggcgcctctgatttgtctttgcctatgcatatatcgccatctggtgttcattttcagggggttcaactccctttctcttcagggacaaattaggcagatcacaatttgcgggaagcttgcagcctaacatttcctcttcttacctccttgcttgttccatgatgtcttttgaagtctccgccactgatagctctggacttagaggttttttttttttttttttttttacagattgagttctgtttgtttcatctacttaattatctcagtggtcagtgttctctaggggtccttcttgttctgtagtctatcctttcttttctatacctcaagtctaagctatatatcttatctcttcttcaccatcctttctccttcctaatctggtcccctggtaacctggtggtttttacttagaaaggaagaccagacagtaaagtccgttttctcttccaaagggattagcaaactctcagtctttgttctgggtgtagcccaagtctctctttctttccctgactcctttcaggcagagctgatgactccatcttttgggaagacccaagaccttatatatctatatctatctctttctattatagaatttgtcacactgaatacagttatctgtctacttgtctttgttggagtaaatcatgagctcctcagtggcagggagagctttctgatttatcgccacgtatttagggcttagcacagggcttggcacttagtaggcacttgaaagaactcggtgaatgaatagatgaatgaatgagtgtattaacatagatagccgtgtggaggaaagaagtgaagaagcgggaaggcttgtttagctggatggaaggttttgtcggtgaactgagggaatgtgtgtgacggtgcaagggtagacttacattataactcatgcccttgagatcttatccactaaggaagatacttaggaaaggaactcagggcctgggggcagcaggggactctcctgagtcctttggcataaatttaatttgttttgtgcttctgggaacagaagctcaggagtccaagaggactcctagctcaatagttcctcctcatcttccctaatccacccctctgctaccaccccagtcatttctcagccattaggttttccctggatctttttgtcaagcttgcagggtattctacattcattgaactttctagataccactacataagaggaataattgtggcatttgaagtcacacagattggaattctagcctcagttcttcctacaagttgcaagactctgtatctgcctgtcccaggctgataatgataccaatatatcattatctgctgggaggacaaatgggaaataccttgtaaactggtacttgttatgattttagtatgagatagtttcgaggagggattcagatgcctgagagcctggcttcatagccttgattactggcagcaaaatgatggtcagtgtgtgaattaggtaatgactgtggtttctatgggccttgagctagctcagagccagacacacagcagagcagggagaatatatgctgagagttggagctgtcattttcctctttgatgccatgactcatggcatgttggctggcacccccttgcctggcctcctccagctccctgcattgcccccccaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggtaggagagtccacaaattcctggacaccttgacgggtgggtaaagggcaggggcccagggtctggctagaaagttacatgtgtgaggaatttgaaatatgatccaaagactatgttctagagtcactggactcttaccaacaataagagttcaagttgtaaaaaatagtcactatgggccaggcacagtggttcatgcctgtaattctagcactttgggaggccaaggcaggtggatcacctgaggttaggagatcaagatcagcctggccaacatggtgaaagcccatctctattaaaaatacaaaaaaattagccgggtgtggcggcgggcacctgtaatcccagctacttgggaggctgaggcaggagaattgcctgaaccccggaggtggaggttgcagtgagtggagattgtgccattgcactccagcctgggtgacaagagtgaatctctgtctcaaaaaaaacaaaaaaagaaagaaagaaaaaaagaaaattataaaaatagtcactatgattttcaaagaacagtggataataggtgataacagttattttgttccttttttgaggtatttacataaagtgtacaagtcataagtatacagctggcaagcttttgcatatgcatgtacctgtgttactaccacccagatcaagatacagaaccttctcagcaccccaggaaactcacttttgctaccccaattaatatttcatccaaaagttaactactgtcacaacttgtaaaccagattagttttgtctaattttgaacttcatataaatggcattatacagtatatactcttttgtgttttgtttctttcactcaacattatgtctatgagagtcatcaaagttgcatgtagtgatagttggtttatttccattgctgagtaataatctattgtatgagtatactttaatttatccactcttctgttgataaacatttgggttgtctgcagttttgttgacttttatgaataatattgctatgaaccttcttgcatatgtctcttggtgggcataagccctcatttctgttggacatataatattcatgtatttagctttattagaaactgtcaaacaattttccaaaatgattgtaccaatctatactgccacaacaatgtaagagaattctagttgatccatgacctcagtatttttaggcattttaattttaaacattctggtaaatatatagtagtatcttgtgattttaattttcatttccctaatattattaaacacctttttataaatttattggccatttgatttgggaatctcttctcattttaaaaattggattgtctgtctttttcttattgatttgtaagcattatttatatattttggatattagtcttttgtcaatataaatacacatatatatagaaaatattttctctcagtcttgacttttttttgctttattgtcttttgataaacagaagcccttgattttaatgaagtgtaatttaatcagttttttaaaatgattgatgcagtcaggcgccgtggctcatgactgtaatcgcagcagtttgggtggctgaggtgggcagattacttgaggtcagaagttcgagaccagcctggtcaacatggcaaaagcccgtctgtactaaaaatacaaaaattaactgggtgtggtggcacatatctgtagtcccagctccttgggaggctgaggcaggaggattgcttgagcttgggaggtggaggttgcagtgagccaagatagtgccactgcactccagcctgggtgacagagtgagactccatctcaaaaaaaaaaaaaaaaaaaaaaaaaaaaaaaattgatgctttttgctttttgtttcttgttcaagaaatccttccctatccccaagatatttccctaaattttcttctgaacctttattgtttgtcttttcacatttagggatattatttcaaattaacttttgtatgtgatatgaggtaggctgtcaaggatctttgttttttttcccccaagtaaggtgatcattcaggaatctcttttttttttttttatttttcaggtcaaaaagttttctaatttttattgtggttccttttttgggacatggttatctagtatattgcttgattttcaaacatgtgaggactttttaagttatttttcttttgctgatttctagtttaatttcactaagatcagagaacatatgctgtgtgggtgtagtcctttgaaacttgttgagacttggtttgtataaaaaaacaactaagcaattcagttaaaaggcaaagattgtcagattggattaatgccaaaactcaattatatgctgttcgtaagagacacattttaaatataagaacacaaaaaaaggttaaaggaaaaggatatgagaaaagatatatgttacaaaataaagcagcaaaattaagcaggagtagctatatattgatataatatttatattaatataaaataggatttaggtcatgaagtattgacctaaagcagttgctaagtgaaataaagcaagggtagctatatattaatataaatgtaatatttacattaatataaagtaaactttaggtcaagaagtattactggactccaaaaatagatatttcataattataagtggatgaattcaatttaatatataacagcccttaatttggatacatctaatgatgtagtctaaaatatgtaaagcaaatattgactgaactaaaatgatactagacaaattttataatcaaagttagagattttaatatgcttctctcaataagccaccaacagcatccataaggatataaaaaatttaaaaacatggttaataaatttgaattccttgacacatatagaacactttgcctaactctagaatatacattctttttagcacttatatatctcttaaaatatacttctgctccattctctcctctccttctgagaatctaatatttatgttagatcttttaactgtattccacatgtctcttatgctcagttctgttcttttttctctctgtgctttggtttggttattttctattgatctatcttttaagttctttaattctgcattctactgtaagcattctggtgtttaacccatccagtgggttcctactctcagacaatgtatttttcaattctagaatatccactttactcttttataggttctagttccctgtccagaatttctatcttttatctattgtatccatcttttcctgtatttctcttaacatagcaatcataattattttgaagtccttgtcttataattcttacatctggatcatttatgggactgcttatttttcctcttgattattagtcatattttttgccatttatgtctaataatttatttttattacatgctggacagtgtgtataaaaaaacaatagaggctccagatgattttctcttccatcaggtagttttccccctttcttttgtgaagtatattaaggaactgatcacctcaagccaatcagagatcaagctgcatttgaactaggttgtagttttagtaaaacttggtgtagctttcatttgtcccagtttctcaggtatgtccctccctgacttttaaatggaaagctgttaaatttctttctcttcagccctgaaagactgtgagagatgcagttctgccacttcgtaggctgttttctttgtgccccagtggagatcttctacatgggtccagcccaattttcggctgtcacctaaaatcatcaatgtctcccaggaagaaaatgactggcaattgacaaatcatcttagaaaggctttttttctctctgacttttggtttatctagtctagtggttttcacactttttgttcttaggactctactttttttttttttttaagatggagtctcgctcttgtcgcccaggctggagtgcaatggcacaatctcggctcactgcaacctccgcctcccaggttcaagcaattctcctcctgcctcagcctcccgaaaagctgggattacaggtgcctgccaccacacctggctaatttttgtatttttagtagagaaggggtttcaccatgttggtcaggctggtctcgaactcctgacctcaggtgagccacccacctcagcctcccaaagtgctgggattacaggcgtgagccaccacacttagcgaggaccctttactcttaaaaactatttaggacctcaaagaacattttgatagggggtaatactgttgatatttaacctattagaaattaaaactgagaacattaaaaaatatttattaattcatttaaaataactatatagccaggtgcagtggctcacgcctgtaatcccagcactttgggaggccaaagcgggcggatcatgaagtcaggagatcgagatcatcctggctaacacggtgacaccctgtctctactaaaaatacaaaaaattagccgggcgtggtggcgggtgtctgtaatcccagctacttgggaggctgaggcaggagaatggcctgaacctgggaggcggagcttgcagtgagctgagagatcgcgccactgcactccagcctgggtgacagagcaagactccggctgggcacggtggctcatgtctgtaagtaatcccagcactttgggaggccgaggtgtgcagatcacctgaggtcaggagttcgagaccaggctggccaacgtagtgaaaccccgtctctactaaaaatacaagaattagccaggtgtggtggcaggcacctgtaatcacagctattcgggaggctcaggcaggagaatcgcttgaacctgggaggcagaagttgcagtgagccgagatcacatcactgcactccagcctgggtgacagagcaagactccatctcaaaaaaaaaataaaataaaaataactatatcaaaccccttagatgttaacacaacatattttctaaatttttcaaaataaaaacaattttgaaaacacaattttcataaaatgcatacagctttctccagatgttgtgttggatcagaattgtttttctcccatgacctaccatatcctactgggaagtggaagtcaggtgataacactttatttaaaacatatagataagtgtttattaactttggctgcatattagaatgacttggagagcctattttaatgcccaggcaaacccccccagataaatgaaatcactgtctctaggttgggacccaggtatctgtgtttttttaagttcctggccaggcatggtagctcacgcctataatccttacactttgggaggcaaagggcaggcagatcgcttgagcccaggagtttgaaaccagcctgggcaacatggcaaaaccctgtctctaccaagaaataaataaataaataaataaataaatacaaaaattagctgggcatggtggtgcacacctgtggtcccaaagctactcgggaggctgaggagggaggatcacttgagcccgggaggcagaggttgcagtgagctgagactgcaccactgcactccagcctgggcgacacaatgagaccctgtctcaaaataaaacaaagtaaaaaagttccccatgtgtttacagtatgtgacaaggttgagaaccacagccataaaataaaaggacaagaactctgacttgcccatctcttgtcttcccatcagacatttattactgtgcatggcatgatatgtctctttctgtctgtctgtcttccatcttccctattccttattttgtagttatttctctctttaaccaaacagtttttttttttttttttgagacagtgtctcactctattgcccaggctggagtgtggtagcacgatcttggctcactgcagtcttgacctcctggactcaagcgatcctcccacctcagcctcctgagtagctgggaccacaggtgcacaccatcccaccaggctagttttacaattttttgtaagatgaggtctcgctgtgttgctcaggctgctctcgaactcctgggctcaagtgatcctcctgctttggccttccaaactactgggattacaggcgtgagccactgtgcctagctcccaacagtttttgagccttgtaggcctgcccctttgtatgcctccctgactatcatgcttctatttgctctctttttttctcttcttcatccattcttcccttcttagcttatcccattccttaaactgcttttaatatagaacttgatcataaattttcagacttggtatattagtctctaaggtatctagtcttcatttagagctataaaaccaggaatgggctatttttaggttttttttttcagggaacagaaaccaagtgaagattggcactctcattgcctcttaaaggaataaaggtgttctgtccctagctgaggccctcctggcctatcttagctgtggagaggacctcaggcttgctatgggatgtttacctcattggctgaagctggggataataagactgctttcaatgcatcttctctgggattctgttcaggtaggagaattggagatcacttatgctggtagcttggatgagacagcaagaaactcagtgtacataatgtctgtatgtactttcaagtcttttacactttagtgctttgtgactgcctcattgtgtgctccctgcagagaagtcggttatttctacttatacattggtcctctcatgtcttggcttctgttggcaatgcctgtgttaggtgtgggcatgctcattatcttcccaccttttacagagttcttttcaaagcccacttgctctactccctgagagaatcatagacgcagtctctgggctagagaagactttggagagcattcaggacaatgcccttctgaagtaccaatcatttttcagttctctctgacatgagctcttcacataactcccatgacagggaactcattctctcctgagatcaccccttcactgatagtttggatttgcatgggagaaagtccttcctcacactgaattaagagccggtttaggaagcacagggtcacacaaccagttaagcgacagaccagggaccagaactagattttcagattcctgaccagtgctttttctgtcacactgtgatgtcttgaagtctaagcacagaccctgactcttggtaagatgattcactagctgacctgttcctgaagagatcagggaagactgctggaacttgctgcatgaccaggaaagtaagctgatgtgatagaaaagaatgcctttgtctgggaacagaaacatctcaatttgggttctggttgacactgttgaccttgagtaggttaattttcttcgctgagcttgctttcttctatataaaatacggaaaataatccttaccttttctccttcctgggagagttgtaaagcagataagaagtctgagttctgaagcatcatacagagatgttggagagtcttagtagcagtaaatgaactcacatccttttggctgcctaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggtgagaacagcccttctattgtcctcttttctcctttttgcccttctcctttttacctgcatatcttcctcttctctccctctccctgttcctcccattgggtgaagagatatcctggtggtgggttctgtttctttcctaatgttcagctcctgacagtgtcctcaggcttctggaggagggaatgagggtgtaggggcattcctgcctgtcttctgggaaagatgaaacaagtggaggcaggcagagggaaagctctgccagccccaggctgccatggggacagaggtcctcctggggcaaaagggctatcaaggacccctttgcttctcccctcgctttctctattttgtccccctcctttttcttctaccttgcctgcctttctctttttcctctttctcttccctttccttgtacagcctcagttgtgctaggaggagtgggccccagccataggggaaggcctttctcatttattccattctcgaatccctgctctttttgagctgggggcctcatctttgcaggctgagaagataaaaaagaagagaaacacactctttggcaccttccacgtggcccacagctcttccctggatgatgtagatcataaaattctaacagctaagtaagtaacaccagttatctactctggcaatgtccatatcatcctcagaatttgagggcatacagggcctccaacaccaattccatttcctcattggtggagggacagctctggtctcctgcctcagcctttatttatctcctgccttgctcttaagtttgagtttattgtgtgttttattcacacatattctcaaaacttgttcctctgagaagaggcttcattcctattggggctcacaccaagtccatgcctgcagttctctttcctctgtcttcaggcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtgtaggtgacctctttgcggggatgaaggaaggagcctttgatgtacaggttgagaagtctgtggcctctgttgtgcttaaacagcagatggggcagatacccaggaagatagttcaactcatgaccttggtcaataaagcacaatttactcaggttatttctttatagttgtccttttggtgttctttccttgttgtatgctctgtgtgcccctttgggtctattgtgctaagtgtgtctcccttcattctttttcactttattgtccctaactaccactctatctacctttataaaaaatatgtcctttagtgaatttcaatgtaaaaatggcatttattctatttattgaacttatttattttgatttttgttccttattcttattgctaaagtagatgaatggaatgatgtttctttttgtgtttttgtgagaggccctataaagaaatagtcccttaaagtgatatagtcctaaatcctctaagctggaaaggcattcttgcccaggagggatctcctgcacaagcatgtctggctttccacctggactcttggatcctacccgctcttcctctgtcctggatcttccctctcccttttctcccctgcaagtgatgagagttgagtagagcagagccaaaaggaacaacactggaattcttcagtgaatgaagggagttttcccttactggcccacaattgaatttttctttggatcagatgctattttaagtaagtagaatagcccttatggtaaagctattgtcctaggcccatattctgccagttcagcgggagggcagaaggccggggctgggttaggggcttactttcagattctttaatcaggctggattcccactcgagacagaatttatttgtaattttatcaataatactttgcccctggccaagcctctttgttcttctaatctgataactcgttaggcctttaatcaaaggcttaacaaggacaggatcactgacaggcagagcttgatcctgacttgctgatctgaaggcttctgtgttctccaggctgggagggaccttaattagctctgagctacccaatccctgcccccagcccttcctttattacattgatggcaggccgaagccctccataaatcagattctcttctccttttggcctggctgttgaccctagatgctgcctggctgatggggcgtaggttcagtgaccgctctctctgctctacatccgccggctcggatgatcagtccctctggaaataccccggtttgaggagcccctttggggcattttgtttttctgactttcgggactaaatcaacactcttaccccatgggtcccttctcctgcctgcttcacgcccctgcctgctccctctatcccctcagcactgtccctactaactacagggaggggttcgggggtgagaagaatcagcttgcttggcaagagctggacagagaacacccatggtaatggaaggcttaggcttctccctttagcgcagctgtgcaggtaacctggtagcccttcttccatctgggctgggagggaaagagggaaggacaaatgacccctttcttttctctttttcatgtttctcccttttcttcccagtttcccccttctttctcccccttcccccccctattccagacttcctcatcctcttcagcctctctttcgtaccttgaaagctaccagcatagaagccctacctcctgaactctccatcactatggaattatgctgtctccctggtggtccttccaaggcttcgctcacccttgtaacctggccctttctctcatctttaggtagaatgcagggaagcttatctatcaggctagaggagaaagaataaaggtctgcactctcttttagctgggagtgagcccaaagggggatgcactagcatattcctaagttacttggtgcccatgtatcccttcactgggcatagtggccattatctccaggaccccgatttgcagcctgatccaagagctggttctttgttgtttatgtgcttattggaaagcgaaaaagagtgaacattagcataaaaagcatccatagtcccaccatatttgagcaccttctctatcactcttttctgtgaaattttttatgtggttaagataatgatagccactgccacttattgagtgccatgacctgtttcaggtgccttaaagacattattgtgaagtctcagaagaaccctgcaggattttagaaattaggaattaaaatggggaagtcagctgctcaaggtcacagctagaagtgaaagtcctggtttcaacctctagtgtttggtattccaaagctcaaggctagtacctataattctgtatcctttttcccctctgaacattttaataggcatttttccattttcttcaagtctttttataagcatcatttttaatagctctatagtctcccagaaactggatatgttatcattttcccattgttcattatttatgtttactttcatacaactattaataaaaagtaaacaattatgtttacttctcatttaattattaataatgatgaacatgtttatgtataagtccttgtctatgctgtgaattatttcctgaggttggctttctgaaaaggctggttcttagtgctctcccggaccttatcccaagcccctatcctacccttccttgcttgtgtctacccactaactgccttgccacttccctttatagtgatattgcccataggtctccttctattggaattgccactaaaactgacctgggcacttcatcttcaatttcccatccttttaggacccctggtgggaggtttctgggaggaggtgccccattctccagattggcattagaggcccagggtggtctccagcaagcatttattcatgggcacctccttacctgccagcccaaagtgggctggcccctcctgacactttctttattctccttgcagcccctagcctgcagagcagtgttcggcagcgcctgacggagccacagcatggcctgggatctcagaggttggtagagggcgaggctggccacttcttgacaagccgggtatctctgcggcgaatgcgcagcctttcatctggacagtctttcagttctgaaggctacgggaccagctctccatctgcctctgctgctgcttcttgctcctcttccatcaccaccatcaccactaccaccaccaccaccaccaccttcaccaccgtccatgtccaccctgtttattaccaccacagcacttcctatttcctccagatggagccctaccctgacacacccccttctgacagcaccgctgtgatgcctgggcattcagagagcttggggtatcagctgtctctcttttctttcttcccttccttccctttctgctgcttttaccttggtttctgcctgccagctgctgcttgatcaactctgggggtgtgtgcagtggggaatcttcttatcctgtttgttcccagctctgggattcctttttaaggtcagcctactttctccccttctgtgtttggggtttgctgactctaaaaatgagtaacgactttcttccctcatgaccctatagcacttttgcctaaactatgcactttcacattagttatctcacttgggccctcacttcctttactccttcaacaaacatttactaatgcctactctgtgccaggctctgctgggcataggggttcactggtgataagatacaatcccagccatcaagaactacaatcttgtctgagagagatacataaataattatggaaaaatttattaagtgctatgggggtgttgaggaaggagtgactaacagtgtgtacctgggtggaatgcttcaccaaagagatgaatttgtgctaacatcctgtgtgaagggaaaggagaaagagtattctaggcagaggaaacactgtatgcagagacatggagattccagagaatacaatatatttgtggttagaacactggatatgtgttggtgggaaggagaaacaggtgaggctagaatgacgaaggctccgaaagggaagggttttggcctctacccgttaggagatggagaactacaaaagggtttctaagagaaagtgaatcagtcacatttgcattttagaaataacattttagtggctgtgtgaaggaaggaagtggaagactacaggaatttggaaaacattccagtagaccactaggggaggtaatgaggacttgggataaaaagacatgataaatttggtaactggctacagtggtgaaggaaagggaggatctagtatgacactcaggtttatagcttgagtgactgagtggacataacgtccttcatggaattcgggaaccaagatagcggacataggttttggggttttggacaagaagagtttataggtggggcaggaattaaaatacacattttaagaacagtaagttaaggttctaaaagggtaagtaattccctccaggtctcatagctagttgagagcagagcacagattagaacttggctttccattccagaatactccgttggatatttttgtcttttcacaaggtctcaaaaagtgtactggaaaataattggtgaaaggtttttcttccacagctttgtctggcagctgcagagactattcttgctaatacccaagatggtagactagaatcagagatagtagccttgaccttgcctggaacaagcttaggagaccttcagaaagtccttcccctctggaagtacttctcatctctgaaatggtgaccacagcccagtcctggcctctgggctgcagtctgcttactctgttgcttttttttagttctatctcactctggatacccatttattcagctctgccccttaaacctctggatagttatgcttgagggctgttcctttctcttgcacaaagggattgcccttactaggattattactcagcagagccactcatatccattctcattctcattttcatccaaaagcctaggaagggagactgctccttccagtacagatggagaggatcaaattgggttggggacactaagggatgctgtgaattccatgctccaaggtttaagctgagggcagtggggaggaagggcggagaggtacctgtatccacctggcctgttcactacttaattttcttttgcaccacgcaccagaggatcatctctaaaggcaaacaggctctctagtaaggtcagtagcttgggatgggagtccgaggcagcccagcctttggggagggacctctggcctgattgttctcagtgattcagggagggaaggtgagcctgcctcactgggccttttccctcctatatctccctaggcttcctcccaggttcttatcttgctttggcagtcccaacttttagctgatgagagaggcatagaaggacaggaatcaggctgggtgcagtggctcacacctgtaatcctagcactttgggaggccgagagcggaggactgcttaagcccaggagtttgagaccagcctgggaaacaaagtgagaccctgtctctacaaaaaaaaaatcaaaaatttagttgggcatggtggcacatgcctgtggtcccagctacataggaggatcacttgagcctgggaggtcaaggctgcagtgagccgagatcgcgccattgcactccagcctgggcaacagagcaagaccctgtcaataaataaataaataaaaagatggataggaatcaagatgaaataggggtctggtccaggagaagtgaggctgggagggccctaacctcctgatttctcctccttggtgttagagagggtaggatcccagaatcttcacttcctcagcttagaggaccctttttctcagtgtgattgcttcccagaacttccttggcaccttgctcattggtttataatagtgtttggagaaggcaagatatggagaggatcatcttggggcttagagaaacaaggacaagtttagaagcaaggacagtgtcagatatatgaaaccaaatatgagactgaatatttgtaaatactagaatatgtggctaaaacagtatttgtagaatggaagctgagttggaattgttctctgctgcctgctgagtccaggaaggtactggcccatggggtggctacttagttatttgcttccaactgagaattaaatctacaatagctatgagccaaccccctgcttttgcctgtttcaggggcctggtacccttcctaacttctgaccctcagcctctttctttctaggtcctatggtggtctccttttccattcatgactcttcccctttggctagcagacgtttaaacatttcccttaggtctctcctctgcttttgctgaggttctcaggcctctaggaaggcagaaggaggattcaggattggcagagagagcacctccatatctacctttttgtctgtagagcaggaggagtggcatctggaattgattcatggtcttagcaaccaccagctccttaaagggtctcaagttcctagactagcctgtgtgtgtgcatgtccagtgtgcggtggcatgtctccataactcagccttgcaaagaagcctcttgcgaccggcccgtacataggcctttcagcttggcaggcctcatcatcttcattcccacaataatttctacatttccaagtgctttgccagcatatttgatcctccaaacagtcttgtaagataaattgaattggtattatcttcattaggccaaagttaaggactagcaagtttagatgacttgacttgtccaagatcacacaggagtccagacctcttctgaaccactgctctttaaaggccaacatcctgtctttctatgcctccctacattctccgtcagcagagttctgaaagagaccccacccttcctgccgcaccacagactttggtttgaactctgcaatacctatctatgacctcctttgaatcctatgagatggttagaagaggcagcatcctggccttttggggtgggtgaaggattatttgcaaggctgttctaaccttctcatctccagcctgggtcaggtccactgactgcatgtgccctgttccttggggcctggcccagactggataatatcctaaggtgtgacaggagtaagtggggaaggaaggcatggaaaatggtgactcggagcaggctgtaggttctgtgttagcttgagtcccaggaaatacagccagctatgagaaggcagagattttattgaggatgccgcctgtggaatttaagcctatggctgcaccagttcagagccagagcattcaccactggtggggcccaggtattggaaaaccatttgccagacagatgatggtatgatgacatttgtttttgtttcttatctgtttcttccctccctatcacttttccctttcttgtctttctctcttggcccttctttctacctgcttatccttttgcttttcttcctctacaattctactctccttttcctgtctcttttccaatctatcctcattccctcctcctgcctcctctcttatcctatacttatggctgctcaacttctgtctattcctctttcctctctccttcccacctgcctgttcatcctatttctctctcctgccgctctatccccattttcctaccctgtccttgtcttctcgtgttgtccctctctcctcttcgcctttcccctatcacctcatccaatatatgtccctttcttcctctctgccccatgtcttgcagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcgggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccact
